United States Patent 11,667,974 (DIAGNOSTIC, PROGNOSTIC AND THERAPEUTIC USES OF LONG NONCODING RNAS FOR PATHOLOGIES AND TOXICITIES INDUCING HEART DISORDERS) - sequence listing, part 2

SEQ ID NO: 1939 - DNA, 488 bp, Homo sapiens
acatgagccactgcgtccggcctaaaaatcctatatttgcaatctatgtgaccacaactgatttaaacccagatgaagataaggtatcaaaataaacctcaggcagactgagctgtgccacaattttaacactaactgatgaaggcaggatgcttctcctgctcagctgagcatcctgtctcccaaactcaaaaaactaaaatcctggaatcttagaactggaagtgacccttgtctttgtgactgtccttgagctctgctacccatgagttttgcctccaaaattgtcccttttatatgaagtaggactctgcgcagccagaattttttgtgttacctctttgtaatcagatagggcacaactggctgagattgttgtcagtatgtgggtgtggctggaaaaaaataccctctgtgaccaatagttctttcttcactgtacacagctttcatactgtttctcatgaataaaacatattcacatgaca

SEQ ID NO: 1940 - DNA, 22743 bp, Homo sapiens
ggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaa

SEQ ID NO: 1941 - DNA, 477 bp, Homo sapiens
agagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgtctgtctattcatttagctatttcttttcttgtctttgcgatatttttttttgtaagtaaaaaattttcagactaaataa

SEQ ID NO: 1942 - DNA, 917 bp, Homo sapiens
ccctccgtctccttgactctgggtgggctgtgtgacttttccttgctcaatagaatgagaaggaggtggcgcaccggctacaaggctagaccgggggctcgcatatctccacttgcagctgccactgccattagaagaacttgctcagccagctcctgggccccaggaaaaggacaagtgtcacccagaacagagccacctccagctgcactcagctccagaagctggcccagccggtccagtacaccttttaaataatgtcctctacgtgccggtgtggaagtagcccggatgcaattgaatgaacaacagacggtgctttccaggacggcgctgtgctttccaggatggtgctgtgctttcattcatttgggtagctcctctgtgagcctcccagcgccgactgcagagcccccactctccagcctgcaagaccccgaaattcaagccacacaaagaaaggaggagggggccgttggcatttactgaaccttataaaactgtcagcaaaacagcccttaggcttggactccctgctagccgggttttacggtgctgaagtcagcatcttgattcagctgcataaataatctcctgcagtcctgcaaggcctggggtaggagagggtatggggaccagggcactctgtaagggctgggataggaaccccagggaataagacagaccaactgcgggacttcagactccactgcagccgggatcgggttgttgttaatttcttaagcaatttctaaattctgtattgactctctcatgcatgtaactgatccttagatattgtcagccaaatgactaaaggatttagaaatctgattgacttttggaaatctgattgactggcacactctctctgcctctttctttctcaacattttatttctaactatagtttcttc

SEQ ID NO: 1943 - DNA, 2117 bp, Homo sapiens
ggaggcagagaaccgcgggcccgggggccacccgtcactttcaagtcgccccgccagaagcccagggcgaggaaaaggagagagacaaaagagcgctgcggggggagtccccacaccccccgcggccccgcacacggcccggctcttactcgtagtggcggaagatctcgttggtgactttacagtagaaaacttcctcgtcgggccgcaggtccgcgggcggcttctgtctcacaaacggctttcggtgtagcagcggcatctcccgtccgcccgcgggctcgcctggaccctcggccgcccgcgccggccccgcttccctatcaaaattggagggaaaggaaagccggtaaggtggggagccctcggcggcagcgtgggccggtccgcgcgctgggagaagctcggctgccttttgtgtgactgacgcgccgcggccgctaccggagccgagttcgttcctgccgctgcccgggtgtcgagcgagcggagccgccgccgcccctgccccccgagcgcgccctacctcctctcgtcctgccgccgcctcacaatggggcaggacgccccgccgcggggggcagtgcgggagcggcggcggccccctcccccagcgccggctcctcgcccgccgccgccgccaggctcacaacgtgctcggcgcgcagctggccggccggccagcccaacgccgccagagcgctcgccgcgggcggaccccggagctgctccgctttgttcccggctcgcctccacttccccgccggcgccggccggctcccgagcgaccctcacctgcgatcacgccgactgccacttgtccaccttctccactacaaaggcaacgaggggagaccccgtcctcccaggggaccgcctctctccggccccgccgcgcccctggctgccgcttctcccgctgccactgcccgactccgcgcggggaattgcgtcccaccgccacttccccgcctctcggagctcctgggaagtttctgatctactttcggctctgaaggaggaagagctgttgggaggagcttttcactcctcgcttctacctttttattggctactcgatgacttttacagcctgtcactgatacaggaagagacagcggagagcctgggagaactacattattaattaatggagcaacccctcgtgaagattcagaagcatcctccatgtttgagattatcagccaaaagatctagggaaagcgctgggggttcataaacacatggctaacaaagtaaagccttcaagtctggcacagactcttgactacacgatgggaaaagggattccaattacgatttaacttgtattttaaagatgagaaaagaaatgaataagaaaatttgttgctatttttcttcttccaaattagaatctatatctctaaaaatactttgcatgtttagtaaacatccatcttgaacagaagataccttgacatcagttctatttaatacttatggcaattaagagatttagaaagcagaggaaaagaccaaaaaaaaagtatgtgttacaaagtgtcatcatgcttgtaggaccccagcattcttgaaactaacgcacctttaaaaagtaatatttacactgctgtaaatatttgcaaagtatcaatgtttaattcacttagaattttaaggattatggatttactagcgaaaattcccctaaagcaactttcccatatcagtaacttttatttagggaaacaagtttaatgtacataatacatgtgaccttggaattcaatagaattttcgaaactagaagtaactcagaacgttcactagatgtgttttaaagtcttttttgatactgtccttaacatttgcttatttgcaaattaatatgtaagaatgagtctaaaagtaagttttaggaatggttattcgacaaagatgttattcctattaccaatactgcgaaatgataattacagaaacaatgtgggatccgttttataacttcaaatttaagttcctttgtactttggagcagaaaatgtaagaaatcgaaatcaagagttagtattttttatctttcaggctggctttaactgttcatacacctagcaaaataaacatttgtgaaaggc

SEQ ID NO: 1944 - DNA, 732 bp, Homo sapiens
caaccttcacaccatgggggcctgtgagacaccccacgtggatgggttggggccatggcacaggtctcgagggtcctgggtgctaaagactgtgcagaaggacggggtctgaccagtgaagcagccggcaacatctgcagacagtcactggctccaacttttgtttttgtcactgtgtcacccaggctggagtgcagtggtgcgacctcagctcattgcaacctccgcctcctgggttcaagtgattctcctgcctcagcctcccgagtagctgggattacaggcaggcaccaccacgcctggctaattttttgtatttttagtagcgatggggtttcatcatgttggccaggctggtctcaaacaactgacctcaggtgatccacctgcctcggcctcccaaagggctgggattacaggcgtgagccaccgcgcctggcctccatttatttgtaaatagataattctcaacagtatgtttactctggataaacatcagtcagtgcgtagaactggtaaatgtcagagaaatgtatcacttatcagagcgtctcacagtctagtcctgtatttcttctgaactcacgctctgcaaagccagggctgaatgtatctaccatacctgcttgtttacctccaaaccttgcaatacatttatacaaaatatttatttcacagcttatcttaaaacaaatgtaaaaggtatcttcaaataaatcagactgaatctct

SEQ ID NO: 1945 - DNA, 2181 bp, Homo sapiens
tggcagcataagaaaaagaagaaaaaaagtgcatagaattctgccttgaacatcactgtccacgggctgccttcaaaagacagaagggctctaccacggaatgcctgtttcagatttaaaaaataacctgctgagatatgctggcagggcttccttcagcagccacaagaagcttctcaggtgagaagaaacccactgctgttagcactatagatttctttaaggtcacaggcctcttccaattaggggtatcatccatctctggtggcctttccctcctgaagctggggaaatatttcctccccctccaacccatttaccacccgctccatataaccgccttgaagacctctttgggcttgaagaataacttaagacagttttcctattgagtgctgaacatttgcctccccctccccctccagcctgtcactctttccgggcttgtgactgcttcagaattgtgaacttcaaatttccccactgttttgttgatcctgggcttttgattcaagggcctgtctggcaggagatggcctaagcacatcagcaatagcagatgacaaatgccaaaacagaaagaaaataggatacaaatgatttcctcctacatatttacatttacctgctccagagattgtgcatttggggttctacccgttattaagtaggagcctacgttatgcctataatgacctcatcatgctgcgtgattatgggctgcagccgccaaacactttcagacgacactgtgaactttaaattggcactccaatctcccagtggcctgtcagtcatgagaatcgcgtctttatgccagcaagccccttggatggagtctgacattgcaatcttcagtaaattaccctgtcactgacaatcttgcagttatctcgcaaacaatcaagcaggcaatcaaactgttctgaattgccagttcaggacctgagaggtggccgatgtctccattcaacagcagagggaaagcggcctggccctcctatgacaatggacgatttctttatttatttatctacctacttatttgttagtctggttggctttttcctggggaagggggtgaggatggtaggagaggtttgcagagtcctcaaaaagggcccaatactgactcagcggttatgggaaagcgacttaggccttctgaatcagcccacactgcggtggctcatgtctgcttaatcttacttcactcagtgaaacggggccaaaaagaattatctaggtgttttctgtcagaacggacgctaaatcacagctctggttctagtctactcatacacgtcataagctaattgtaatgacaatttcagagaaatgtgatcatggagaaactttctgggaatgataccaaggcattctatttattgcttttgataaagcaaatcagagagattcttccataacagttctggcaacgtgaaacaggttcattaatgctgaattgaaacctttggattagaagtcccaaggtaaaaagccaaaaattctacacagcatcagaggtgacagcctggcctctggaatcagatggatttgggtttgaagctcgtctctgctagttccctggctgtgtgagcttggaaaggaggggtgacgcttccttccccaaggaagtctgaagacaaggcagtggacacccatcaacaggggaaagagaaaatgaatgaatgggagctctgtaaaccacatcagcaacctcgaaaatgtccaactgcaaagacccatgtctacaaattgctgtcagccagaggaatggctgtaacttccttggtgccgagagatgggatttcactatgttggccagactggtctcgaactcctgacctcgtgatccgcccgccttggcctcctgaagtgctggaactataggcgtgagccaccgtgcccggtcaagataatttcttataggacaacaggacaggatcacccaggaaaagatggactccctgctcagttcctacttacagtatctgagtcacttaactaaatgcaatcggcccagctgcaggcaccactgctcgggccactataagaaccagcccctgagcttccggacaggaaacagcatctgcatttccagactgtagcagctcatcatgccaggctccacaggcaagaatcaagcagatggaagctacagaggaaacaaacagggtt

SEQ ID NO: 1946 - DNA, 494 bp, Homo sapiens
agaggcctctcttctgatatccttcttaacttaatctacactggctgtgggttccctttatttttttttctggaatcctagaggatgcacggatacaattcacccaatgtgtccatctctcctctcctaagtgtcagtctataggtttctgacctctagagggtaagcaacttgcccgagatcccctagctggtctgagcagcaaagcctttgaacgcagttttgactctggagctgcattcttcattcttatcctacacttgcttgtgaattctttttcgtccttccagaatccctgaagctgtacagctatactttaccggttacgtctagactataaaggaccacagtgttccacctcaggcaggttcagcgacctgcaagtagtgatacagctgggaaagttacagagcctgcgggaagctccggctgcaacttcagttctgaccagaggttctgtgaaccttcaggatttagcaggtttccaggaccgg

SEQ ID NO: 1947 - DNA, 548 bp, Homo sapiens
gcactaaatcatgaaggctggattcttgaagcctggcagaggcaaatgtctcattaatgctgatctgagagacatctgtgatgagcctgaacatcaggccaatctgcagagctgatcaggggctgctgagtggttctgaagtgagtcaggctgtgaatgaagactccaccagaatgaggagaattccatgcatggagattcaaataaagacaaaagggagatgcaactatggaggctgagaagtcccaccatcggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtgggggggggtcagcccccc

SEQ ID NO: 1948 - DNA, 2932 bp, Homo sapiens
caggtatctttttaaaaaaattctatgctttgcacaactggtttctgaaaatggattttatggaaactaaagaaaagtgcttttatggaaaaaaacaaaaggccagcatacagagaattaagaagccagtccatgagctgaaccaagcaatgataccatacaacatactttcatcccaaacactggcaccctaaaagcagtgattttccaaaagaacaagtacctcttcactcaccctcagctcccatggaggaggactcagccatagaagtaattatatacagatggccaactctgcatcaataggctttgcatagaattagaagacaaagtgcttttgggtcccaaaagacagtgaagctttatttggtgactttcatactgacttcactctacttactggtgatgatggtaggtgaaacgttatttcttcaaaaatatcaccttgtggtggaagagagaaagaatatccatgcttcttttatctacagtgaaggtgaagagcaacataaacttcagaggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaaggtaaaataagaataataacatctgtgttggctgggatgttgtgagtgtttgtggagataatagtacaaatgaaattactgagggacaatggtgaagatagggccatatcatggagcttacactagtgatggaaggagatgggagatacaaaagcaagtcaatatttcagatttcgtaaatgaatggcaagcatagagcagtgaggcagagaatgactggagaaagagactatgttaaactggatagtaaaggaagagcaggaccccactaaactatatggagttttgtgcaaatcacatgaacacacgtagaacattttaggctgctcatgtgactttggatttgtcctaagggcaatagtaagcctttgaactgctttagcatgataggattttaaaagatcactggctgctgtgtgaacaaaaataatgttgtaaagaaaaggatattagctgtatcagatcagctggagactactgaaataacccaagctggcttggactacataggagtagtgtaaactcattcattcatgcaagaaatacttactgagtgcctactcagtaccagacccttttctaggacatggagttatagcagtgaacaatatagaaaaaaatccccgaattcatggagactccagtgagcagagacaaaaaaatagcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaatttgatgtggcaagtgagaaaaatacatcaaggatgatgacttttataatttgacttgagtatctgggaacaaacaagtacagtgccataataagggcagaaaattttccattcactcagcaacttatgaactcatttgcttagtctttattgcctcttgcattatgtagttttcactttgctggagtacttgtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgtttccactggaacggtttctttgcttcctgattaaaagcttccctaatatatttccacgtgttattacatattttcgtattcactttgatggaaagcaagaatagcagccaaatacatatttcatgcattcttttgattaaaaatgataaaggtaa

SEQ ID NO: 1949 - DNA, 396 bp, Homo sapiens
cttaataaatatttgttgccttaatgaaacatactattttattcaggctgaggaatcattcataatttctccccatgtccctatgcttcagtaatacggttttttttaatcaaaataattttttaaagaggaaaaggagaaagaatatcctatcttcagttcccctcactgtgggactttggatcagtcacttgatctctctgggcttcaattttcttatctgaaaaattgagagaacagcatgtaccttacacagtttgtaaggttaggtaatatacataaagcacagagaaaatcctccccaaatgttagtgaataacacaagtatttactatttaccattttaaagtacttaccatataatattaaacaataaatgtatgggactcaaaacca

SEQ ID NO: 1950 - DNA, 515 bp, Homo sapiens
actcagaagctgccttgaagaaagggtctacccagcatgggttgcttagactcagtggtgtgctggagcaggctcctaccagctagaaagaaccagttcaatacgtctcttctcaactccatgttcagagttgtcagagaaccaattgttaaatatttactggcactccactgcttagattttaccagtgcttgcagtgctaaccaggagctcatccctggaggagaggcagagaatgtgtactcccagatgcagccagcttccagaagaagaggtaggagccaagcagagcatgcccacatcaatcttccagcatttaatggccatagaagttactgaacctcccttggatggatagaagatggcattatctttcttaaatatgatacctcttatctttttgttcccttgacacttgaggagggaggccaagggttgatcatgcaagcaagtttgtgcattttgcacatttattaagttatgcttttgaggaaattaaaagatcacaagggctt

SEQ ID NO: 1951 - DNA, 1213 bp, Homo sapiens
gcgatggagactgcggcccaagttaggattaggacagcggtttttcagtccggagattccggccacaactatttttgtctgtttttatcgtaagccagagtctttgggtgcagctctgggacacctaaagggcctggagaaattcaggcggggccagtgctgtgggggtagatgttagacgtggaagggaccctagagagccttgactgtgaggactgagacagggcctcctttgttgcccaggccggagtgcagtggctattcacaggtcgataatgcaatcatggtgcacactacagccttgaacttctgggctcatgtgatccttctgcctcagcctcccagcgctatcctcatcatacatatactgtgaagataaaatatctgttgaagattctttgagcaccttgggccagaagagctacagaaagccaaggtgtggctgtgatgacactgaattcagctcaagacccaggagaaccttacatctattcttatttccacaaggaagtgcacacatggctaatgcaaattcttccataataatgatataaacttgagttgtccaggtttgatgagacccacatcttgtatatacagtgtcatctactgcctctgttaggggctctaggggataaaggaaactatattaagaaatgcagcatctgtttctccctgtgtgaccaccctacttccaagaagtttctgtatccttggctgaagtgcactgtgtgtatgtgtatgtgtgtacactcttctacatcaatctgtaagtcactgaaatgctgcagatgttttaaaaaaattccaccatacttgcttactttaaactttgaaacaggcaaatagctaaggccaataacactagatagaattaagtaattaataatttaacagcacaatttaacattgtgcttcttaggatgggcagggattggttaatggatacaaaattatagctagataggaggaatgagttctggtgttctggagcactgtaggatgaatatggctaactataatttattgtatactgtcaaaagtctagaagaaaggattttaaatgttcacaacacaaataataaatttttgagataatgcatatctggtttgattgttatacattgtatacagtattaaaatatcactatgtatcccatgaatatgtaaaattattatttattattttaaaaataaaaggggaggaaagaga

SEQ ID NO: 1952 - DNA, 571 bp, Homo sapiens
aaacagcctctgtctcaggttgggagttgctgccatggagaccacaagagtggagattttctgacacacagaaaggaatggattacagctccttcttatgtaaatttccatggaggggaaaaaagattaaaaggaaaataattctgctttagtcgttttcctttaaggtgataagatcctttgattccatcgtggagaagaaggcaacagctgtttgtcacaaatgctatttgatgcacctgctattattactcttattaccattttccagtgggaagctgcttcttgggcagggtggatttccatctgcgtctccttttcggtgttgaaagctgatgggaaatgtgccaacgtcacaacaaggtttgagggaggcacatctcatgctcggacatgaacacccgatcatcatgcttatgaactacaaaaggatctccagtatgggctcacggcagttggcccttgaataacatgaatttgaactgcctgagtctgctaatatgtggattatcttctgcttctgcaccctgagacagcaagaccaacccttcctcttgcttcttttccttag

SEQ ID NO: 1953 - DNA, 566 bp, Homo sapiens
cattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgagtgtaactggatcttggttcatgctgagcttaaaatttgatcttctgaatatcagcagaaagactctttctggtgaatacagatcttctgagcaattatcgactgactttgtcattagactgccctttcagaagttgtcagtgacatgaatctttgctcccttcttcatggaatatttctgatctaatagcccctatatttcaaaagatggatataaacatcagatgaatatcacaggaaagctggattgctctgcagtgagtgaaacgtggaaaggcctttccccaccaagcagtaggccaaattgtaacagtaagatgtatttgaaataaaatggttcatagatca

SEQ ID NO: 1954 - DNA, 1078 bp, Homo sapiens
ctgatagatactaagataagaaataactgcaaccataaatgtatacaggttatgtgtccatgagccatctcttcagtttgcccatagatttttgtctgtggaatattttcttgtttcatcacactgaatcgttggccaagaaatgcttgaaaatcaaaacattaatatcatctttcttcttttttttaaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaagtaagtaaatgtttttacccaacatctgcaattgaatagttaccaacatttaagtagaaaaataccattaaagtttgttaatgaaacaaactgtagactacttatcactgaaaggatgagaaaaccatcaaatttctttgcctgacattgaaaacacttctattactatcaagacagtcgatgcatgtaatttatattggagcaggaagacatttagtacttcttaataaaatggtgctttaggattgtggttaaatctgcagtaaagtcatcaagattatgtttttacaaatctggtatatacagtcttaagcctttttttttttttttttttgattgtacaaatcacattttaggaatggtctggaattttgcatttgctgatcgtaggattcttaacaacatttcaaaaactaaatagacactttcatatcttaggcatttaatagatttaaaatactcattttaattgttttcatgagttttcaaacaggtccaaaaatgtgttgttttctaggaaatgagagttaatgcatctaaagagtcctctaatttaattgcttagtaattgcttttaaagcatgaaagatagagataattttcacgcgcagtaggtattgggcccccagcataccatgtatatcacactttaaaatcttaaagctagatacgtgaatttaaaagaatgtccactgatgtttttaaggaaatatgccttttttgtaagttaa

SEQ ID NO: 1955 - DNA, 1961 bp, Homo sapiens
atagtctgctctgagaaaagagccaagttcagggcagagactaccttcctgggtaccccccaagaaggagtcttgatcacttctctaaacatgccctggatgttcccagagctcatgaaaacgctgctctccagtggtgctagcagctctgatgaaggctaagtccaagctctgaattcaggagagcagagctgcctcctgctcccaccaccgtggttctcaggcagtaatggttctattattggccatgtcaattggagcaaccatttggaaagtcatttggcaacatctcccaaagctgaatatacatgaagcctaggagccaggaattccacttccaggatatgcccaatagaaatgaatacatatgttcaccaaaaggcgtgtcctagaatgtttataattgtgaacagaccaaagctagaaactatccaagtgtccatcaacaatggagtgggaaataaaatgtctcttcgtacaatggaatctacatagcaatgagaacaaagaacttacaaaagtacacagcaacatggatgaaattcacaagcataattccgaacaaaaaatgccatgtaccaaaaagcttatagcatatgactccatttatgtacagtagaaaaacaggcaaaacagctagcctgttagaagtcagaatggtggttaccctttgaggggctgttcctagatggggactcatggggtaatgttcattccatgtcttgaactgtgcactgattacactggtgtgtttagcttgtgaaatgtatccacctatacacttatgtggttttctgtatgtacattatatttcaataacattttaagaaagtgttttgccacttattagttcatttgacccacacaacagttctaggagataagaaggccaggtaacttttcttcagatttatagaaagaaaacagactcaaagtttggtccaaggtctcagtgctaattggtggtggaatcaggttaggtatgtcaacctcctgggccaagaaagatagtctctgttggagcaccttgcacagtgcttgatgcatagtaggtgctcaataaatttcatctgaagctggatcatagaatggtggccttctaatcccacaaggctgttatcctgctgtgggagtaaccatcttctctggtggtctaatgtcccttatagaatgtgcgtattctctcctaagagaagagtggagatgaggcctgagtcaaatatcctaagaagctgccaaaatacctgtggagaattgcataaccttgtccctctagggcttagaaaagaatgagtcagacagtcagttctcagacacggtgcccaggaaaacaggaagaaggttcacttaggcagaaatccatgtatgtgaccttggatacatcactgaacttcttcaggggcaacaatttgaaagacacatttgagacactctgcctaggatgacgtgatccttctgtagctgatcttctgagacccgtgaattttatgtactattttctaattatattctcattattttcaagggcatcagactgcatttcaaacttgacaattcctttgctataatttcagctcaaattttgactaatttatactttaaatacaaatatgccccattttctgcttgtcatcatagttcagaaagaagttataccgaccatgttatataaagtaatgaggggtcctattcagcttgttaaccatgtttcttaaaaaaaaaaagtacaatagaactttctttgtcaatataaaattcgagttatttatgatgtggctaaagatatgataagaagtctcaggaatggaatctgttattgcttggaaaataaaatctcaagaccttctttggaaaaaaatggagagtgataaaatgctttcatttagggcttggctgtgatgtcaaggtcagccaatgagcttagagggaatctgagaaaaataaagagaaaaatagaaaca

SEQ ID NO: 1956 - DNA, 430 bp, Homo sapiens
cttttacgtcggccttcgcgagcgtctgggcgggtggtaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttg

SEQ ID NO: 1957 - DNA, 715 bp, Homo sapiens
gtttctagacgaagggcatataccagttaaactccgccattttgcctctcagtgttcaagcttgagcccacgcatccaactcctgagatcttactgggaagctgctgatcatcagtttcaggtaagacgggttgaagatccgagaggctgagtcacttccacaaagtaacacagctgattttaaatgcctgcattcagcatccctgcagcaggctccaggtggaattctaatgggaccagcctccagtccctggaccttagccgtggaaggagagaagaggacatctgcacctcctctcagagaaagcctgatgcctactaaaggacttgggtggtggacgcagtgaccctcagtctggagcttgttcactgaacattggagactatcatttgcgcagatggtcttgggcctctatgagcagcaggctgcaccccacagtgacctcctcattctactctgaggcatcttcatgaaagcagatgtccattgaaaagcacccaagtgcagtctcagctgatgaacttcagaggcgattgagacaaaggctctcggtcccctctgcccttggatggtgcctctggtatgcacttggcctctgtgtctttatttagactggtcacttcacaacccatcatgtcaccccacccctaaccgtgcccactctgggtcctcccctcaactgcctgacttcccactttgagctcagcaaaggca

SEQ ID NO: 1958 - DNA, 560 bp, Homo sapiens
cttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactgatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggctctgccgacttccagttctggaacaagatggttaaactcatttttccctgctctgctcctctaaatacaactaagtaccttggaaactattcagcagacaatgataaagggctctgaaagctagaagaaaaggtgtacttgcaag

SEQ ID NO: 1959 - DNA, 648 bp, Homo sapiens
ctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctgacagctggggagacattgcttgtacctctaggttccctgtctggcttccccttcagagcctgctgttgtaccaggtggttgaatcttaaaactctttaataccaaatagcaatcaaattcccccttacagataaa

SEQ ID NO: 1960 - DNA, 342 bp, Homo sapiens
cttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtttcgtcgcgagccggctgcaagttttgaacctaagtaaacctcaatccggagggcctagcggtaaggtgggcgctgtgtctattgaagtgcttagcaataaagaaaggtagtgagttgattcgg

SEQ ID NO: 1961 - DNA, 281 bp, Homo sapiens
aggacaggatgaatgtatgagaatcatcttcttactgagaatggtaggacagaagggatagtttagccactatacttcctggaagaatcagtacttgagggttgctgcagctttttgggattgaaggagtatgttcatttcctttggaagattaattttttccttttttttgacatggagtctctctctgtcgcccaggtggaggttgcagtgagctgagattgtgccactactccagcctgggtgacagagcaagactccatctcaaaaaaaaaaaaaaa

SEQ ID NO: 1962 - DNA, 785 bp, Homo sapiens
gttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtggtgtgtcttttccttgtttaaggattttacatcatttttatgcacttgaattccaaaatcagaatctctcttttacctatcaacctttattggctattggcttttggcaatgacctttctgttcaaatgtagtcctgtctctttgtttccttagggagtagaacctgtcctttttctcatctttcatttttttgacgtgtcctttctaagagaaggctctctgccgcctgttctgggtgataagtgatattttcatctaatcgttatgtggttgggatgatcatggtgaaatactaggaagacatactctgttgatggactttttctctccaaataatcccaaatagattattttctagtgaatggtttatatctttctcgtcacaaaaatgttcctttgatttctagcacaaggtacagcaggatgcaaatgattctcagataaaatgatgttgacagtatttccttaacaatttatgtaaaactatgcataattttcattctaacttttgacatttttctccataaataaaagtaatgcctgatgtttagttaaagtaga

SEQ ID NO: 1963 - DNA, 564 bp, Homo sapiens
atcacagaaactgcacaaaataagcagcccatgaaaaacaaccgagaaaaagaggcgaaaaatgaacagcaaaccggaccctgcttcctccagcaggaggctcccacccactgctggtcacaacccgctgtctggacctgccgcttacgggatgaggtgggcctgcagggaacgcggggcttctggttgctgttagtggtggcttttcttctcactttgtgtagcccccagaaccgtgaggggcatccgagtgggtgagcacaggcgtccgctgaagagccgcctggaccagggcggtcagcgctgcggggaggcctttgcccgaccgcgccactgtttctcaccaacattcactgtgtcctgcggggcttgaggcttagactgacgggagctattccgggtgtttaattgaaggtctagcacttgaccagcccctggaggagctgacaaccacctaagacacatttggacttggtgtccaccaagagtgactttgtgcaaagaaatggctgagcactagaataactaaatgcaaataaaatgcgtctttcagtgcagttcaga

SEQ ID NO: 1964 - DNA, 1046 bp, Homo sapiens
ttggtgaaggcttctatttggtcaacttgctctgtctttatagccaatttatattgataagagtttctctctagataccatttgcggtattcctgagtcagaagagaggaaaggtgatactgccaccccctgtatgtatttccttttagatgtgggatgtggtaggcagcatgttccctccccagacttctctccgagagctgtctatgccctaatccctgcaacctgtgaatatgttatgttagttggcaaaggggactttgcagatgtaattaaagttactgaccatataatgaggagattattctggattatccaagtaggcccaatctaattacataaagccttcaaagcagagagctttctccaactggaggcagaagagatgcagcagcagcagcagcagcgagaacaattcaaagtacagggactcaatgggaactttctggtttgatgttggagggagcagcatgatgaggaatttgcacagccttaagaggctgagggaggctcctggctaacagctagccaggaaatatgatccttagccttgcagtcatgaaaactgaattcttccaacaacttgaatgagttatccctcagagccttcagataagagtccagtttgccagcaatttgatttcagtctgtgaaacctggaccagaggaaccagctgaattcaccagacttctgacccacagaactatgagataatacattgaatacattgaagttgtttaaaggagctcaatttgcagtaatttgttatggcaacaatagaaaactgacatatggaggtattgatatagtcatgattttgatgactaactagtttgtgatctggatatgaagtgtcaccatgctacagtgcctgagtctgcttcagattcttctacttcttggccatctttattgggaaaataagtatgtgaaataagtatagtctattgccctttttgagtaccactggttaattaattttgttattttcaagtgtatgtgctttaattcacatggcattaaaagaatcggtagtatagtttca

SEQ ID NO: 1965 - DNA, 1156 bp, Homo sapiens
agctgtgtcctggctcagacggacagctctgactcgctcgctctttctctgggcgcctgcgcgcctaccatgacaagccatttcaggcgagccgagccccagagccatgtgtctggtgcgcagtgttaacagggcagttataccttttacagacaactgtggctccaagtcaagtatgaacttacacaaacagtttatataacaagtggaggtgtgcgcctgcgtgccaaacttgctgactcgtgcaggcctggatacccgcctcagactattccttgaccgaagcacttccagggcaggaaactgaagctcttgggaaggtggaagttgcacgtggtctcacagtcaactgtgccagaataggaggccaggaaccatctctgctggaggaagacccaccacgcatcccttcaagaatgccaaggtccagagcaagtgcttcccttctatgggcacaggagggctgtgggagcccacagaatgtgcttctggccagagtgggatccccgaggaagatgttaagacctctaataatatttaagagcaaaattagcacagctccagcccatgggcaagttaagagacaggagtagtgtctgtggagtggaggaaagcagaggctgccgctgaccatcctgcagccctcgctctggctgctcacagctctccaccttctctggacttcgtcacttcagtatgtgaaacaaccatttcaaccagcttggacaaaagagagaagccaagatggggctgagaaaccaatgcaggcaggcccagggacccaggagtcagggaccaggtgctaccagatgcttgctccgactcgtgttgctgctgtcttctctgtgcctcaactctgtcctctgtcactgcaggcagcttcctcccaaggtgatctccatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagcgaaactccgtctcaaaaacat

SEQ ID NO: 1966 - DNA, 626 bp, Homo sapiens
ttccccggagaagttgtcatgggaggccagccgcctgctggcaaggaagatggttgattcttctgatcaatggaggccctgcagagtcctgtagtcactgtggcctggcatccatggtgcacccaatgctggtggatggcttaggacggtacgcctcacctgagagggcggctagagacagtgtctgctcaggacatcagatgtcccgtgaggaggagtgtgtactcacaccaggggagttgactgaggcagttgctgtgggaggtgtggtaactgctggaaggaagatgctcaattcttctgagcaacgaaggccacacggagtcctggattctgtgtggcctggcatccatggcgcactgtgtgctggcaggtggctcaggacgagtagtgggctccactgttgggcacatcttcctggaagtcgtctcttggcccgccattgccgagcggccacacctgctgcagctcgtgtgagcaaatatggctctggatcctctttcctgctttgaaagcagcttccatcctgaaggcgtccagagggggcagttatcatgggacacccgccatatgctggcaaggaagatggtcagttcttctgagccacaaaggcccccaacatcctg

SEQ ID NO: 1967 - DNA, 2493 bp, Homo sapiens
cgcaagcgcaggccgagacgccgcaggtcgagtaccgggtggcaaagcagctggcccgggccgtggaaggtggccaggccaccgcggcctgtgacgcgcacctcggcgcccaaggcccgtagccgcgcagtttcctcgggcgtcaggccgccgcgcagcccggccgtatacacgggccccgcgggctcgcagagcaggagcgcgcccgcctcagtccccgacggggcctcaatgcctggctcggcctgcagccgccgcagccagcggtcctgcagccccagtagctcggcgtacggcacccgacccaggcgcaccaaccgaacggcgggttgccgcatcgtgcccaccgttgcgtccgcggggccccgccctctccgtgggcctgggggcgtggcctgaggggcggggactcgggggcacaccccgagccgcagctcccaggtgcgtgttaaaagctggaggggggatatgtgatcccaggaccaaaagcgcggggccagactcatcggttcattcaacaaccagtatttagtgcctgctgtgttctgcaggccctgccataggcgcttgatacagcggtgcatagcgtatgagaaagatctgtcctggctgagcatccgtaatataaaaatctgaaatctgaaatgctccaaaatcctaaactttttgagtgctgacattatgccacaaatggaaaatttcatacctgaccttatgtgagttgcagtcaaaacacaggtgcacaacacccagttcatgcaacatccccagtgggaaaaaagacccccccagctctcttctgctgcagtttttctgctcacacctggatttccccatgcattcccacaaaaagtaattaaatggcatgcgtgcaggctggacacgccaacaacaggtttcccacaatgccccacatggggccaagacctgtgtgcattactcactgcatttttttgcttattctctgctgtgtggtataaatatattgttgaaaatgtcaaaaagacctaaagatacccctgtgaatatcagtgataagaaaaagaggaagcatttatgtttatctatagcacagaaagtcaagttgttggagaaactggacagtggtgtaagtgtgaaacatcttacggaagagtatggtgttggaatgaccaccatatatgacctgaagaaacagaaggataaactgttgaagttttatgctgaaagtgatgagcagatattaatgaaaaatagaaaaacacttcataaagctaaaaatgaagatcttgatcgtgtattgaaagagtggatccgtcagcgtcgcagtgaacacatgccacttaatggtatgctgatcatgaaacaagcaaagatatatcacaatgaactaaaaattgaggggaactgtgaatattcaacaggctggttgcagaaatttaagaaaagacatggcattaaatttttaaagacttgtggcaataaagcatctgctggtcatgaagcaacagagaagtttactggcaagttcagtaatgatgatgaacaagatggtaactttgaaggattcagtatgtcaagtgagaaaaaaataatgtctgacctccttacatatacaaaaaatatacatccagagactgtcagtaagctggaagaagaggatatcaaagatgtttttaacagtaataatgaggctccagttgttcattcattgtccaatggtgaagtaacaaaaatggttctgaatcaagatgatcatgatgataatgataatgaagatgatgttaacactgcagaaaaagtgcctatagacgacatggtaaaaatgtgtgatgggcttattaaaggactagagcagcatgcattcataacagagcaagaaatcatgtcagtttataaaatcaaagagagacttctaagacaaaaagcatcattaatgaggcagatgactctgaaagaaacatttaaaaaagccatccagaggaatgcttcttcctctctacaggacccacttcttggtccctcaactgcttctgatgcttcttctcacctaaaaataaaataaaatacagtgtacagtaaccttttagtcaaaacagcatcatacttggaaactgaaagcctactgttatttgttattgttgcttaacagctgatacaggtattctggtgacactactgtgctggcttacttaacctgaatacactatttttttcgttgtattactggtatgtcattttttttactgttaagtacttatgtgtgaataagtgtaaaaaaatgattgcttatcggtaacatataaattcagaatcaggaatgatggtgatgccaaacaatcacagatcgtccacatgggtggcggagatgttaacacctttgctttctgatggttcagtgtatccacactttgtttcatgccaaaattatttaaaatattgtatgaaattaccttcaggctatgtgtataaagtatatatgaaacataaatgaactttatgtttaaactggga

SEQ ID NO: 1968 - DNA, 483 bp, Homo sapiens
gaggaaaagtaaaagtaattttgtcatttcctgaaacttcaagttaaacctttaagctgttcatttcctaaaagggtgaaaacgcgggcacccctcgagctagttcatcgccttttaacctgttgttggatctttccagatcaccacaccacatcacccagccactctgcccaatgggagggcagacagtgttccagtgtaggaggaaggggtgtaaggtgcgggcagtttgtgaggagggcaccaacgagagctactgtgagaaagtctgcatggtcaaaaagtggattaccaagaacaaagcatcataatgttgtccagtggaccccaggtgcacagcagctccctgaggtacacagaagctcttgctcacctgccacttccagccttggtattttccagttgtcgggtaaggagtttagcaatggcggtgaagctgttgctcatgcggaagatgtctctgctctgagggcccaagattga

SEQ ID NO: 1969 - DNA, 2750 bp, Homo sapiens
ttttagtagagacggcgtttcactatattggccaggctggtctcaaactcctgacctcatgatctgcccacctcggtctcccaaagtgctgggattacaggggtgagctacagcgcccggcctacaaaattttctagttaaccatcaggcaatcaaagcaccccactctgccaagcgttctcagtgacaagggtttctgtgctgtcaggctgctcagccatgctccctgcactctgcgccaccttcccttgcactaggtgtgctacttactagctgtgcggcctcagtccatgccgagcaagggtgcagggaatgagctaaggcacaggaagcgctcggaacagagcccggggtaaaggtgcgcggtcacggtaagcactatgacagcccgaggtggcagggtactcaccagcggggcctctgactctgtagccgggccctcattctgtgcctcatccttgggctccttgaccacctcctctttgatggcttcttcctccttggtggcttcttccttggccgcctcctccttctcaggttcaggtggggacacgaccttttcaggaaggctcagtagcatcttataaactctatagccaaaatccctctggagcatctccagaaacagctcggccagcaccatcacctgatggggaggtgggagggtccatgagcatcaggaagaaagactgcttcaggcccacaaatcccagcccacagcctccccaagactcttgacacctgcctcaaaagagatcctttcctttggcctccgatcctccacaatcccatggagggacaggtttacacagccagggcgtgcgatgacagcaggttctagggggggtggaggggcctctgggagatcagtgtccgtttcctgctgtgtggtggcctctggagtttctgcgttccgtctagaagtgtctgctgcttgctccaaggcatcaggtgcctgttcagtaggctccgtttcctgtgacaacagctgaaatgagaccctctgggtcccgggattaggccacctatatcccccgctgctggctaaggcacagccttaccccttgtgcctcctgggttgggggagctgcctctgcagctttctgctggcacagggcctcccactcctccaaagtaggcatgatggtccagacatccggcaggtacaccaccactgtctgaagccgccgggggggtcccggctgcaggtactgaaactcggcaaagcgccacctgcacatggcaaaaggaggtactaacttctttagtgacaactccacgcagacaccacgttcacaggcaagggcttcagtttccagtcagcactcaatgagcacacactgcgaaccaagctttgaagacacaacaggaaagctacagaccaagtcctcaagaaatgatcagtcagtggggaggccgcaaccacacaagcaccctacaaggtgcaaggacaactccagggagtctcaagtgcagcctggtggctcagccagattttggcatacaccccaccctaccctgaggcaccagagggggaaggaacgggactagggggcagagagctaaccagcagaaaggggcagggaccgggccttcccaacaaaacctccccaacctggtgcgttggtgcagctgaggctcaggaagcccactcaccacttggtacagccgctcaaatcaatgccagtctgggcctgcgcacagcggatggcggtacgcaccagcacctgcgggtcagcctgggggtcgaggccatccagggaaggagaccattcacccccaaccagcactgcctcctcttctttcctgcccagcaaaaactgcaagaagagatcagggatacaaaacaaaaaactacattacctgggtctcccactgcagggcaaggctgccacccatcaggatgaaggcagccggaagtggggaagtccaccacacagtgaggtctctatctgcaaacatgaaccagccacctcgctctctctgactagtcgtaacagctctgagctgcaccttcctcctgggtgaaatgaggggtgttcggctctgagatgcctcgttttatgcattcaggaacaggagccgaacactcaaaacatgacaggttgtgcacattacccgtgaatgcatctcctcctgctctccagctcttaccttaatctgcttcagaggatgctctggcgtctcccttggctcagccatgtcatccacaaagagcatgcaacaacgatacaattcctccaaccccggggaagagagcagcagtacctgtgcaggaggagacactcagagctgccttcagcctccagaaatcagataagtgagagacgcctgtcagcttaccttcgaactataagcggggtcactgtctgcagtgatgggctcagcaccagcgtctggagctgcctccttttcagaagagacctggatccggcttggatgatggagggaaaagggctggctcagggggaaggctgatagccaactcagatgcacggacagaaaatctgaggggaccaggaggctgcggtaacggcgctggagttctaggaagtcacagatggggctacaggaagacagcaagggaatccagactgagcaaagactaaaacattcgaaatgaaaccatcaaagatttgaaaaaatgggcgaattttttttcagtctgagaacttttgaagtaaggcacctctcaaggaagctagatcagatctgaccacttaatttacaaactctagatggcaaaagtc

SEQ ID NO: 1970 - DNA, 2289 bp, Homo sapiens
tttttttttttttgagacacaatttcactctgtcgcccaggctggagtgcagtggtgtgatctcagctcactgcaacttctgcctcctgggttcaagcaattctcatgccccagcctcccaagtagctgggaatacagttgtgtgccaccacactggcttattttttgtatttttttagtagagatggggtttcaccatgttggccaggctggtctctaactcttatcctcaagtgatctgcctgccttggcctcccaaagtgctgggattacaggcatgagccaccgcacctggcctacttatcctgttaatgaaaatatttgattggacagaacatcttattccttaactctgttatgtgcttttgtagattgtttttacttactgtagatatctgttgctccagagtcccagaaatcagtatgatgagttcagcacagttactagaaggagacaaaaagatatcttcttaattaggtgatatcagggatagttctggttattgattgctgtgtggaaaacactccaaaactcagtgactttaaacaacaccagtcattgtgttatttctcattatcctaagtactgactgggctcagccagacagttcttattcgggttctcatgcagttatagtcatcatcagattgtggccgcgactggcataatctcaaaggcttccttagtatttctggcagttgatgctaggacctcagctagtgctggggctggaacatgtctacacatagcttccccacagcatggtggctaggtactaggagtgactgtcccaagaggaccaggcagaagcagttacattttatgacctagtctcagaagtctcataacatcacttccactaaagtcccaagcccccccagattcaaatggagggagcatatatcccatctcagtggtaggaatttcaaagaataaattctgtgaaactgtagtagatagtctgttttctcccctgtttaaaacctcctgaggacctcacatgcttctggataaagctcaggctcttcaacatggtttagaaggtccttcctaatctggcccacatttgtccatccagctccaactcttgctactctacgcccctcttcccctcttgtggaatggctaattcctactcatcattcaggtcttggcttagacatcttttcatctgagaaggctttctggtctagtctcacctggttaggtgaactccccatgtgccccatgtacctcatttatcaaagtgcttatcatatgcctgtcactgtctgttttcttcactagactcaggtgccatgtctgtcctttctgctctgtttgctgggtgcctagcatggtaggggatgtatcagaggattagtacttatttaactcaccagctcatttaactatattgtataacaatgttggtggtcatattggtcccccatggacagcttttcgtctctaataccatacactcagtgcagggtctgaatgtccccccaaactcatatgttgaactccaaatccccaaggtgttggtattagatgatgtagcctttgggaaggaattagggtggtgccctcatgaatgggatttgtgtcattataaaacaagcccaaagaaatttggtcaccccttcctttaagcgaggtcatggcaaaaagacgctgtctatgaaccagaaaatgggctctcactagacaccaaatgctggtgtcttgttcttggatttcccagccttcagaactgtgagaaatatatttctgttatttataagccacccagtttttggtattttgttatagcagcctgaagagactaagacagccagtcccaaccttccacatttagacctgactccaagttttgctcagcccactgtgtatcccttcctcctcccaaccaaagtgtccccactctttctctattctgttctgcctattattcaaggtctaacttgtgtcactttttcaatgaggcatttgcaagctctttaaattctcaaggattctccattaattcaccatatctattttgagaatctacaaaggacaaggcactacgaaagactctacatgccacagggaaaagacagacaagatctctgtcccaacacagaaaattttagcctgccatgttgactcccagggatctttttgtttctgtaggaggtgctcattacagagtggccaaattcctactgaagaatggacttggttgtgaaataaaacaatcctgggcaatatttgttgatagttttgttgaggatgattcaggaaataaatacaaacttttaact

SEQ ID NO: 1971 - DNA, 338 bp, Homo sapiens
catagagatatagacacagacgcaaatacagtcacatagagatatagacacacacttatacacacatatatgtaaatatacagtctcattcactttataccacacatgtataaacatacacaattgtatgtagacacacatacacataggtactcagaccgcatagatacatatgtacacacatacaaatatatgcacatacacagatatatatatacacacatgcatctttaaccagaacaactttacttttgtcagttttatatgacagagtctttaaaaaaagatttcatctggcttgtgttctactattaaaagagaaaatgaatttgcttgtt

SEQ ID NO: 1972 - DNA, 524 bp, Homo sapiens
acaaccaacacgttctccccacacgactctctcgttctccccacagccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccac

SEQ ID NO: 1973 - DNA, 607 bp, Homo sapiens
agagtgaaggagcaaaggggactcggccgccatgttaggagtactgggacgattccgcggagccgggcagaggttttaggggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaatgatcttctgtgtcatgtttctgggaacaagtcaagatgaat

SEQ ID NO: 1974 - DNA, 1727 bp, Homo sapiens
actcggtctctctggctattttgtgtgttccgatctgacagcccacatgcctctgctgtacgcctcggccacaggacacagagcactaagaagacagagaacattcacagtctggtgagacaagtttgagatctcatattttcagctcatccttgaaaacctttcttcgatttgactgaccttgatggctccctggaatctcacctacattttatgggaaattcaactctccagagagaagagctttcagatagctgcgggacttgcaactgtgactttcagctttcgcttttgaatgaggctccaaatgtctcaatggtggcactatttccagatttgggagccctgcaaagctaatctgctcaaccttcacctactgggttcaatgaatatgaaaagctgccttcctgaaacttttccttcaaagagggaatgatctcctggaattcaagcttctacaaggtggctacctggtgttttccacttttgccgtctcctaaaaagcatcattcaagccttgccctttcaacccactgaacacataaacatgctttctccttaactgaacttatggccacgatgaacttgaactctgagattcacagaggagagtttgttttaacagctgcttttacaatgaagccctggagttactactctcaagacccctggttctgataggccatcttttcactgtcctctgcattttctaatgcccagctgtcaaggaacacccactgaagttttccaaaacaaaggcacgaaacacaagaaaggcaagagaatgctaatcaccagatgcatgggcatcctatgggggaaccccttacatgtggaatacggtttttctccccaatttatttttataaatttattgatttctttgctagtttgttattaattgttagagatgtcctgttgcctgaggttgccctgtccgatatggtagccaccagcgacaggtagctatttagagtaatttaaaaattacattaaaaatgcagtttccttgtcacttaaccatgtttcaagtgctcagtattaaccacatgtgactagtggcttccataaaggaaggcaaaaatagagaacatttacatcgctgcagaaagctactagatttttttggccaaggcataagctctttctcataagagaaaggggatgcagatcttgctaagagtgatggatttctgggttcagcctacatgagtcatcttccatactacccctggacatgctttccttggctgccaattttctattttataaatttcaggaaagagagattatggttgttaaaaccattcatgacaatgatcccactttagagaaaacaacagcaacaagcaaagaagatggtgtggagatccgcacattccacatcttttaattggtacccattaaataacaaagggaaaaagtaccctcagaccacaactctccaccttgtgtggaggccaaggacccagcagggagaaggcagaagattaggttctccactcatcctggctctcagaccactgaactcacatttgggttctaatggaatggtgattggaagcatattctccaataggaggtttttaaaagttctgtgccatcagccaggcagcatctgtcatttaaaatgactggccagttgcacgtttaaaagcaaagataaaattgctaatttatacttactgaataaacatcagcagtatccatgaaggtacctaccctaa

SEQ ID NO: 1975 - DNA, 531 bp, Homo sapiens
cactgcagaatctgaaaagaaatggcaatgagcagaggtctcccaccctcacgtggaggacagggtccgcaaagatgagtcacattgtagaacttcactattcagagaaagccccttcacatgcagaatctcgctggtctctcaggacaatcctgtgagacatatacttctattgactacaatgagaagtgtgtctcttaaaaaggctggagtgcagtggcgtgatctcggctccctacaacctccacctcccagctgcctgccttggcctcccaaagtgccgagattgtagcctctgcccggctgccaccccgtctgggaagtgaggagcgtctctgcctggccgcccatcgtctgggatgtgaggagcccctgtgcccggccgcccagtctgggaagtgaggagcctcttcccggccgccatcccgtctgggaagtgaggagggtctctgcccagccgcccatcgtctgagatgtggggagcgcctctgccccgccgccccgtctgggatgtgaggatcgcctctgccc

SEQ ID NO: 1976 - DNA, 619 bp, Homo sapiens
gttttgttttgttttttgagacggagtctcgctctatcacccaggctggagtacagtggagtgatctcggctcactgcaacctctgcctcccgggttcaagcgattctcctgcctcagtctcccgagtaactgggactacaggcacctgccaccacgcccggctaatttttgtatttttagtagagacagggtttctccatgttggtcaggctggtctcaaactcccgacctcaggtgatccgcccgcctcagcctcccaaagtgctgggcttacaggcgtgagccaccacgtccagcccatacatttcaattttaaagggatgcgccctagtccttagttagtctctcctcatctctataaaatgttcagctactcacctcttgggctattgctagacatcgttttctcttccttctttctgacgcctacaatagataggacattccccctcctcattctattctcccaagtactttaaattgcaatttataaagtttctatgctacactctaaaaaaaattctgttttgttttctaatttcataattggtgcttcactgtgtcttgtcctcgaaggaatgagtattttgattgtgttcattaaatctgatttttcta

SEQ ID NO: 1977 - DNA, 1875 bp, Homo sapiens
gagcggtgggagcagcgctcgtccgccgttggggcccccagcccgcgcgcgtgaagcagctagccgaccaagccccggaaggcgagtgccggagggggcgggacagctcctccggggccagcgggcaccaggcttgggggctgaggcccagcggcccgagaccaactgggctgaccgaggccgcctccccgccagccctggggtccactgcccggggagcagctcccttcccaggtcagactcgggcttcatcctctcttgccgcgcgccgagcggttttcaactctcactgctagaattcctccaaccacccaggatagcaggaccgagatacatggccacccatgacccggagcgtccacttccagggacaggcagtggtgattggcttcggttgtcatctgtgccatctgtccatggttcgagaagctgctgttcacgttttggggaggatcatggtttgagggctcccgtggtagaatttggggagctctcataggcagaaggctgagaaaagttggtgctgtgggaagtcaactggcagccgatggagtcgggacccgggaggaatggaaagggaacccagataggaagctactgcagtaggctcagagaggtgatgacggcagggctaagacagcggccttgggcggtgactgggaagaacgttgaacaccgtgtttgggctgaagaaaagagcaagggaagagtcccagctgctctggagtttgaggcaggaggatggcttgaacccaagaggtggaggctgaagtgagccaagatcgcgccactgcactccagcctgggcgacagggcaaaaccctgtctctaaaaagaactttttaaaaaagcacctgtagatttaagcacataataactacacttttgtctgttttattatgatatcaaagttaaatttatgatgaatgactaactggacaaaactgagagcaaccaccacagaggtgaatatactgaatgtataacactctctaataattttaagaactccgctctaatgagcagatatcacagaaagagacttttcagatgaaataccgatgaccaggaaatctgtgagaccattttaaaaaattcgaagtcattgaagaaatgcaaagcttccaggctccacttttcactgatgaaattggcagagtttgggacaatgagatgttgctgtcccgggagtgcggatggggctgtgtcctgtgatggcggtgggcactggcactcttgtccagaaagacattcaccactgtggttcaagaagcacctcaaaggtcttcaccttggtcccttgtccacctctgcccgcggtctctcctcctttcagcctcctctttcccacacagtccctcccgccctggcttggtcccctttcttctgactgggtcaggcatgtgggtgactctttgacttccaaggctctgtctacttggcttttttctttcacctgttctgcagaataacagcctgattcgttcctctttttgggtccttcacttccatacctgggattcggggcgtggcccagaaagaccctgcagtcttgcagtgtggggctgccagcatttcatggcctccaagctcagctgggctgaatgaacgctgccatccagcgcttggctcattttctgtcccattttcctgagtgcttttgccagacttacacttttctgaaagctactccaccctaccccagacacaccctctctcctcggatgacctgcctcctaatttcctgagaaaactggacatggccacctttccccagtgtctgaggcccaggttgacccgtggtcatggtcgctgtcaccacccacctgcctgtatgacagagtgagaccctgtctcaaaaaaaaataaaaagaa

SEQ ID NO: 1978 - DNA, 3475 bp, Homo sapiens
ataaaggacttgtctaggggagagcctatggatctgagaacgctgtctgggcttggtaccaagagctggtatttcacagcagcgaccgcctcacagacgagctgtgggaagcaggagggagactctctcttagggtgccactactatggagacacagctgggctgaacaagatttgcttcaaacgacaacaagagagacagaaagtatctggttcaaccgctgcccgagcaggcaggcaccagaagagctagcagccaatccggccatgctcgaagccagctctgcagctcagccaatcagtgacatcattgctttctttagcttgcccatggtgatgtgaagatgagaagaaatagcaaggcccaaccagttcttcatctggagacagttcaacgttctgcaaaccagatcttcaggaattttactgggataattatccaaataaattgcaagcattctatccaaatggacatccataaaaattcatcagagagcattttactactgagctgcaaagggaaaaacttaaaatggatatgaaaagtgaagaaagtgatcataggagaaaaccatttcaggtgtctgatgatttgtgagcctcaagtgactactctgtggaatcatctgtccttgcctttgaattagctttccctaggccatgagtcaacattagtagtttatacatccaaattgatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaactgattgctgtgcattattttccactgaacagaccttcttttaacttctaatctcaagcacatagcagctgttgttttcatattaaagatcagtaagtgtttgttgaatgaatgtataaattcttccccaatctctgttccatgtaataagaactaagttagcattcaattataaagaggacttagaaagtctgcagacatttttgatcaaaaatccttttaactgtcttcttatggttcccggtaacacctaagcccaaaaaactcaggtcatttcttgcctgtactgttgcaatagcctcataataactagtcttctcctttatcaaccacagtcgtctccgctacacaaagaagagagggtgctaatctaaagtgtaaattattttaaatcagcacccttcttgtaatttcccagtggtttttcctgtcataagaataacatgcaaaattccttgcttgcaaagccaggtatgaccttgccccgtctaccttactggcatcgtctctcatgactcttcccctttttcactctccatcttgccttttcccaaccatgcctgctagtgagccttagcccttgtgttttctctgccagggatgcatgactggcttctttactttattctgatctctctgctcaaatgtcatctttttagagatagctttcctaaacatctttaaaagtaccccatgaactgtgaaacacctttcctgctttttcttcatagtacttatcacttcctgatattatgttagacaacaagcaaataagtatatgctgttcccactaaaatataagctccatttgaacaggagccttgattattcctgagtatacccctagtgcccagaacctagtagggctttaataaatattagattcatttgttgaatgaaaaaatgaatgaataattgaataaagatatccaggtagagtgtccgggcagcccaacctatgtgaagccagtacaagaatgtttctgtgacatagtgagcgcaattattcctctaaatgatgaacttgcatgagtacacaaggataaaattaagcacgtagtttagatttctgcaagtctcttcctcagattgaggaaaaacaaagaaattgagcttattctcacctcattcttacatgaactaaatccagaataaagcatcatttaaataccaagcacatccctacctcagccactcatggaatactttatctgtaaagggacagatagatagtaaatatttttggctttggggaccgtacagtctgtgtcgccactactcagcacttctgttgaggtgtggaatcagccctagacaacacataaacaaatgggtgtggctgtgttccaataaaatgttatttataaaactaggaaatcagcagatttagtccacaggctgtagtttgctgacccttgaattagagagtcttccccaaatcctcttcccaagttattgaaagaatgcccataggaccatagctccctcacctggttctttcaagaaatgagacaaattcagggatggttggagggtggaacgcctacctgtgacatgactattgagcctgatttctttccttttatctctttaaagtgagtcaggtcttaactttaaactgtctctaaagtggcaataactgggccatgtcaaatactcccaatgacaaaatttcttcttggagaatgaatgagggttgcatacagtggtgtgttggtaaatgtttagcaactggctctcttactgatttctgtagtgtaaattctcccatcctggccatctgaaactaccaatatgatgtcacttgatgtagagttgggaaaagacagtctcttgaataagtatgagctggttccagcccactgctgaacacatatttaaaagctacaatagctctgctcactgccattgcagagtctggaggaaagagtagcaggcttgataggagcaattggctgaataatcttttgcaatgccaataaataatgaaaaagtatataaatataacgctgtatagaaagctctcaagttcagtgtttggttaaaatacatactcagtaaatggtagctattattgtcttagtttaagttattgcaagcattaaaattaaatgtttagctacagactcaatccagttttaatgtcattgtgttaataaggcctcttaacattgaagcaacaaagataaaggaatttttttgtagctattcacgattctgcccagctcaaggtaaagatagcaacaaaatactccaaccagaataaaagaagtctccacttgactgcagctcttcgcaacacttcacaagggtcaagctgtgttagtttccttcagtgttaaacagaatgcatcttaagagaatagttcaattattgattgaatagtaggttcaagttgactataatcccaactaatacactctaagaccagggatgggccgacagaagggtaaagttttccactcaagtctcgaggcaaacactcagatagaagtagtaatatggatgccttctattatttggtcaatacaatactgttccagcccagttgtgcaaaactggtgaaataaaaggcaaaaatattgacaacagtttgggtaactggattccaaaatgggcatccatctaagag

SEQ ID NO: 1979 - DNA, 1454 bp, Homo sapiens
taggaaagtcaagaaataggaaggaaatcggtcagttttctatcatcattggttgggcttgaaagtgtaacaagaggttaaaatagaagttctagctgaagcacaaagaaagtagaaacaacacatcaaagtgagggatttataaagcaggagactgaaaaccagctggtgactcttgaattcctcacccttattgagagtataaaaggcttatagccctcaccctttcacctcaaatcaagagggaagggttttagaaacacaacttggagagcttaatatgtatccctgaagtttgaggaaaggggacgtagtgtactgacttctgcctggaaagtctaacaggtgggagattaattgactgcaatgaaggagaaagccaatgacaggttgcttcttgactggaattgttcagcactccagaggctgtcagggaaaggatgtgagcatgctgcctggaatctgatgtggctcagctgtaggacaaagatagtgtgttttcttaagttctgaccaaatgaaccaccttaagagacaaagatcactcagcaaggaaagctgaagatgctatgagatgccagaggttggggaaggagcaaacaaccagctggaatggatatgccttttctcaaagaaaattgcaagtggaagaattccagccatggggtctccaaagcatccgtgaaactgttccacaagacaaggatggatgactgaatgccaaacccagagagcagtgaagctaaatcaactcaatcatttcagtgaagaaagaaatctcctgtcctttcctgtccctgaactccatgatgaagggccatgtgctgtaggtagcaaaacaggggagaaagaatttcagttttccttttcccttgaaattttctagctaaatcagtccgaaatgtggaaggaaaaagcatgaagttttttatttttattttttgagactgagtcttgctctgttgcccaggctggagtgcagtggtgtggtcttggctcactgcaacctcctcttctcgagttcaaatgattctcctgcctctgcctcccgagtagctggaattacagccgtgcaccaccatgcccagctaatttttatatttttagtagaaacaggtttcaccatgttggccaggctggtaatgaactcctgacttcaggtgtctgccagccttggcctcccaaagtgctggaattacaggcatgagccaccacacctggccacatgaaagcatgaaatttaatgcagatagatttacctatcatataaaaatggaaaaccgaattactaagtggaactgatattttgtgatccaggaatgaccatgtctgaactttcatttgaggggaaaaaggataattaacaccattgaacaaatttaaagggagaatggaagacaaagtaaagttgttttatgtttacatacagctgtgctattaagaaaagctaccga

SEQ ID NO: 1980 - DNA, 648 bp, Homo sapiens
atggggagaacaggaggaacctgcaaaggagaatgaaaaggagtggagtcaggtgtctcggcagccaaaggaggaagtggtcgcctctgacagactgtgccgacaggccaagtaaggcacagctaaagaaatgtgttactgacaagcctgcaggccacatggcgagatggaaagcaagcagtaaagaccaaagaaactcgttgaggacaatggaagatgggctcagaagaaaatggatacagctgaagctagatgggtcatgggtgaaagcaggacaggacctcattctccaacagataccaagtccataaaagccctggggctcagtcagagcagggcagaagagagagagactatgggacaaccagcagcagagaggaactaccctccctgctgagagcttcagagacatgcagagatgtctgaacaagttgctgcggagaggagccacgctctccagggcctcctctctgctgagagcagcagacagtggaatgagcagtgggcagagaggagccaccctccccagggccacctctttgctgaaagctgaacactccatgggatgacctgcctacagagagaagctacccactgtgggtctcctctgagctgttctaacactaaataaacctccttttcaccttc

SEQ ID NO: 1981 - DNA, 2583 bp, Homo sapiens
catattagagtctacagatatgcctttcttacagcaatcctgcacccacataaaagctacattttcaatacaagattaaaaggtattctgcaaaatgtgcaaggttttcatgtctgctggtgtagctgtagtgatggcttcatgaatttttttcttttttgactatggtccttacgctggattcatttatcttgaaatggtgaacaatcacagctgcagaccctcaatttatggtacatatcaagcaatttggctttttttcttgtaatgaaaaaaaaaagttttttttgctttttttcatgacactgcttcttgggagcactgccagcattactagtggcacttcgtatgggtcctaaggtgttattgaaggtttacgatattgcactaaacacgaaaaataccagagaaccactggagatactttttactgtgatatgtaatttactggagacaggaactgctcgtttggagatggttagcatcacagggtgttttaagtcgatacttgcaacccttgagctcaccacagtagcaacaggaggtggctaggaaattattcacagcaggacagtacgcactgcaattaattgtatgcagttatgatttaataccacatctttatgctcacgtttctctcaactgtgaatggtgccatgtacagttggtatgtgtgtgtttaagttttgataaatttttaacttttaatagttaaaatagttaactattggtatggtaggaaatgataaagtagactagtatctgtatacattttctgcatttatgacatacctttttcttcatttttttcaatattttaattgaaaagttcatccgagtttcatctaagttttttcaaagtgatacaaatctccaaaaaattttccaatatatgtattgaaaaaatccaggtgtaagtggctctgcgcagtccaaacctgtgttgttcaagggtcaactgtgtatgaatccaagcgaaagcttttcttaacacctcataagaactattttttaaaaaacaggaactagcatagagtaaccatcacaggtaaagtgtaatttgttatcagccatcttttgcccatttcagtactggtagaaggctcaatggtaaaaataaaaacgggacagtcagaagatctggaagtcctgaccctgctttcacctggcatgtgtaatccagtcatgctcgtatcagtctctgtaggagcacttgaaggtattacataaatgctatctaactctgggaaacgccaacatgtgattgcctccagaggaatcttctttaaaaaaaaattcaaaatgttatttccttactaggatgtctttaaagaattataacccttaccgtgcctccacattagatagatccctgccaccagcacccatgtggccaccagcagagacagcaggaggagaggcagccagcctcccggcttgcttttgtctggaaaaaacaaagcttattcacctttggaaaacaaatccacacttatctcttaatttaaaaactaagacttggtatactttatagaggtttatttattttttattattttttagttttgagacagagtctcgctttgttgcctaggctggagtgcagtggcgcaatctcggttcactgcagcctccgtctcccgggttcaagcaatgctgcctcagcctcctgagtagctgggattacaggcatgtgtcaccgcgcccagccactttgtagagatttagatccctttaaaaccatcagtcagaagctctttagagagtctgccaatcatatctttttccctagagtgtgcaggtcttgcattagattctcaaaagggatatgggacccaggaagttaagaacagtcctaaaatctctttggcttctttgtcctgatatgcaccggcattttcacagtaggaactagggtttctgtccagtttttttggttctttaaggaattaatgttattctgggtacaactgcttacatacatagcacatatagatgacatttttacaggccgtcttgttagactgacatacatggaggatagtgccacccgcctcacaagaacatcaggtaagctcaggcacagagtgcccaggaatctgtaaggcttcgcccacgcacaagtcagggctgccagtcacctgggttgtcttcactttatttggctgcgtctaatgacaccttccaacttttgaccccacccctggactgttgtgtaaacattgtatttctccatctgtaatgaaaaagctaacacatctctaactccagagacattttccagaacatgctgttctcaggcactagtgaggcggtaccattattcctcatttgttatccaaatgttggccatgtgaccacaccaaaagctcatcctgggccactgagactggtaattgaatcagaatatagtgaaatattcattctcatatatacccagccatcttacatctttggcttttttcagcagatccttgtggcactcagaacatccattttgcactgtgtatttttttcccttctgtgtatcctgctttgtaaagagtcacgagtggttttacaaataaagcctgttcttactca

SEQ ID NO: 1982 - DNA, 487 bp, Homo sapiens
gcggagatatggcagttcaccaacacaatttgtggtccccctccccttctcttttctagaattttttctcttactttctagccattgtgttatctcaagtatctgtcctggtcttccaaaccaatctgctgggagtgggccagacttcccatgtccctgactgtcagcagcagatgttcctcctctagaccaccatcttgaatccagattcactccactctcttcttgctgcaatatctctgagaagaagccgtaggggattgttctccagtcttgactttgagaacttggtagagctcctgaaggctcacctgataagagatgtatgtcacaatctgctcaccctggcatttctctaaatagaaggttcatctgtctgaatatagatatcaagaagtggcagagtatcagaggagaaagatatcaagaaatagaatattcaagctgtttcaacttctacccgttccacatttccgaagctacttcc

SEQ ID NO: 1983 - DNA, 1953 bp, Homo sapiens
actaaaggtcataattaaaagaatagtgatatgataatagcacacagtaatattaaataaatgatgcaaagtacaaaataaaacactgtacagagagctgagttttctgagatgcacatgcataggaaagaaagaaattgggggttaactgtggttaaatttccagcagtctacattttctacaatgagcctgtattacttttatgatcaggaggggaaggttaataaaagagaaagatcatggcttgttcagagtggtgagactttcttgtgaagtgtgaaatgggtagtggggaataatagaataagggtctggagaagtaaggtccctatttttatccattgttagcattttatggttaccaagaacctaataccaggtgaaggagttcagcagaagaatatatatttgtgacattgttctggctggacagtggaggctgagctggtgaggggagaaaggaatcctgaagaccatattggcagtttttttcagagcccaagagagacagtgggattctgacccagccactagaagggggccagaggagaaggaatagatgtgatgttttgaagataaaatgagcagaccttaagggacacggaagatcaagcagcaaattcccaagccagaagtctgggcctctacatcctggtgagacctacgacatgacaaatgaggccaggcccaggtccgagaggcactgctttccttgcagctctctggagctaccctgtcttcacagtggctaatgcctctctgatgttgggaagggctggagacaagggaggagacaacccaactcatagcaggctacctggctatcgtaggctaccttgacactgactaggttccctacttgtaccatgtgtggttttccaggattcctgtgatctctggtattttccctccaaggactggggttccctcaaggcaagtcaccctactgaaccaatagcaaggttgtaatcatcactactgttagttgaggggttcctgtgtgccaggcaccatactaaatgccaaatgtgttacatctcatttaatcttcacctgaggagggaagttctcttatgccatttgcaaagccagtagtcccagtcaggattagaacaactctgatgtacaagtctgtgcccctttctcccaggtgaacttctcagtgcacccccaaggactcctctccccatgtaagagttctttgttaaattgaaagagcagttcttgcctgtagtaaaaaggtcagtggtgcaaaagcatacaaagagatgtgagactccctcccagtccacataaccagtctcctaccccagtggtagctatttttaaatgtcttgatttttcctcaagatagtcccagcatttacaaccttatgtatcccccttaaagaaacacgcacaaaaaatgaaaagcttaggatacagtctacaccttgcttttttcagtgtcttggagatggctttctattagcctgtaagatctacctcatttttttcactgctttgtgatatccattgtatgaatgtaccataattcatacagtccccctgttgatgggcctctaggttcttttctgccttttgctattacaaacagtactgtgccaaatatccccgcacactgtccctggataaattgatgaaattaaatcgtaggtgcatttgttattttgatagaaattggaaatgtagttcccagtgtgtgtatgaaaatgttcattcccctgaatcctctgaaactattgtgttgtttctgatctcataaatgaaaaatgctctcatattttaatttgcattcaactatgagtgaaactgggtaccacagcccatgtttaaaagtcatttgtatttattttctgtgactggcttatttgcgttctttagcagtttttctgttcatccttttaataatcaatttgtacaaactataaagaaattatccttatctgcta

SEQ ID NO: 1984 - DNA, 429 bp, Homo sapiens
caccagccggaatagcaaccggcggagcccgtgcgcaccgcagcgcagcgcagcggccggggggtgcgggcgccctcgccgcccggctacctaccgccgcctgggcgccgccgctgcctcccttccccgcttctaccctccagcagacgcccgccggagcgacccctcccagggtgaccgggggaaggtgttccacgtggccatagcgtttgcgtcacaatgacctggcggacaggtgggagccacagcgtacaccccagggttccctctgtgctgtgcgtagtgcctactgcttgcttccaggttaaatttctgtagctttagaggacaggagacttcatgacttcactgccaagaaaagttacagaggcctgctgtacctggaaatcaagtttgagcttcgagaataaaggtcatgttttaaaaaca

SEQ ID NO: 1985 - DNA, 3166 bp, Homo sapiens
ccttggtgggccgtgaactgaatggtggcgctggcctgtgcccagtatatctgggttcggtggctgagagagcttttgttgccctgtgtccgtgacgggccagtgttctgcatgcatcccatcacatggatccatggaggatgttgagcccagaggaagacttgcactgggcccaatggccccaggtcagcgtccatcagccaggtgtccagcccctggtgcactgaagatcgggcccttcctggtgccctggtctcctgcattgagctgtgtgagctcttccacatggaagacccctgtcattgactggcatagggttcagtggcggagagagcatcaggtggcccacgtctgtgatgggccagtattccacatggatctcatcacatgggtccatggaaggcgagcatccctgagctggcacaccccaccttctgccagcatggaaggatggtgagcacagaggaagaattgcgttaggccctttggccccggaccagtgtctgccagccacgtgctcagcctcccgtgcgctaaagctcaggtccttcctgtcatcctggtatcctgcactgaggtgtgtgagctcttccccccagcaggccccctgggattgactggcaaaggtgaatggtgtctgtggaggaagacttgccattgggttgctggccccaggccagtggttgtcatccaggtgcccagccttggtgcactgaagctcaggcccttcctggtgctctggtctcctgcactgagctgtgtgacctcttttgcccggcagaccccctggcattgaccagcatagatagtgagactggaagaaaactttcattgggcccgctgtcccggggtgagtggtcatcagtcaggtgcccagcccttggtgtggtgaagctcaggctcttcctggcgccctggtctcctgcacggagctgcgtgagctcttctacccaggcgggcccctgcccttgagcggcatagatggtgaccccagaggaagacttgcgttgggcccactggctctgggctcagcccctggtgagctgaagctcaggcccttcctggcaccctggtctgctgcactgagctgcgtgagctcttccacccaggtgcaaccccctggcattgaccagcataggtattgagcctggaggaagacttgaattggtcccaatggtcccaggccagcatccatcagctaggtgctgagcccctggtgcactgaagattgggcacttcctggcaccctggtgtgctgcaccgagctgtgatgagcacatccgggtcctgctggatgcatgcgccgggaaggacgtgccctgagttgggtcgatgatgagaaccttatattatcctgaagagaggtgatgacttaaaaatcatgctcaataggattacgctgaggcccagtctagtgagctcttccccacaggtgggccccctggcattgactagcatcgtgagctcttctgcccagcagcctccctggcagtgaccagcatagatgctgaccctggaggaagaattgcactgggcccactggccccgggaaaatgtccctcagccaggtgcttagcccctggtaatctgaagctcaggcccttcctgatgccctggtctcctgcactgagctgtgtgagctcttcagcccaggtgggctccctgacactgatgcgcatagatggtgagcctggaggaagacttgcattgggcccaatggacccaggccagtggccatcagccaggtgcccaccctggtgtgctgaagcgcgggacctacctgttgtcctggtttcctacactgagctgagtgagctcttcaacccaggcggggcaccctggcattcaccagcatagactgtgaaatgggaggaagaattgtgttgggcccaatggccctgggccagtatccgtcagcctggtgtccagcccctggtgtgctgaagctcatgcccttcctggtgccctagtttcctgcactgagcttgtgagctcttttgcccagaagactccctggcattgatcggcatagatggcagcgctggaggaggacttgtactggggccgctggccccacatcagtgtccgtcatcccggcgtccagcccctggtgtgctgaagctcaggcccttccttgtgccctagtctcctgcactgagcttgtgagctcttctgctcaggcgggtcccctggcattgaccagcatagatggtggccctggaggaggacttgtattggggccactggccccacgtcagtgttcgtcagcctggcatccagcccctggtgtgctgaagctcaggcccttcctgttgccctagtctcctgcactgagcttgtgagctcttctgcccaggtggtccccctggtcttgatgggcatagatggtgagcctgaaggaagacttgcatcaggaccaatggaccctggcaagtgtccgtcagccaggtgctcagcccctggtgcactgaagctcaggcccttcctggccccttgatctcctgcactgagctgtgtgagctcttctgccaagggggggcctcctggcattgaccaacatagatggtgagcctggaggaagatttgcattgggcccaatggccctgggccagtgtctgtcagccagtttcccagcccctggtgcactgaagctcaggcctttcctggcatcctggcctcctgcactgagctgtgtgagtgcttctgcccaggcaggccacttggcattgaccggtatagatggtgagcctggaggaagatgtgtgggacccgcaggccgagggccagtgtctctcagccaggtgctcagcccccagtgggctgaaactctgacccttcctggcaccctgctctcctgcactgtgctgtgatggtgagacttctgttgggcttgcttttcctgggccagtgtccatcagccaggtgctcagccatcggtgcgctgaagctccagcccttcctggtgccctgatctcctgcactgagctgtgatgatgagctctttcacctaggagggccccttggcattgactggcatagatggtgaccctgaagaaagacttcagttgggcctgaaggccccgggccagtgtccatcatccaggtgctcagctcccagtgcactgaagctcagacccttcctggttccctggtctcttgcactgag

SEQ ID NO: 1986 - DNA, 2182 bp, Homo sapiens
aaggaaggaagaaaggaggaagaggcaggcacaagacaaaatgaatctctccgctgtgcacatggagccttagctctgattccagttgagcaaaattatgaagaagatgattccccatatggatgacagataaacaccctgtggcgagtcactcactcccgaaaggccctctgaaggatcgcgcatgtcctgactgcacagcctgctcctccacggtcctttcaaagtcactgcctttggatgtaagtttctcagagagaatgagccttgtgtccaatgcctggaaagcaacagcatttggccaccaagttcctcttcatcctcatcaagcagcttttcctgttttgtttttagctccaaccttaggacaatggacaagtcaatcagtccagattaccctgcaccagggaagagaggcacctgacagctatacccttcaccaagtccacggggacaaaggcacaagagtaatagaagctgcagggagaatgcaattctcatcaacccttggggttgccgcattgtttttgctctgttttccagaaagtctttaacggaggagaaagggtgtggaggaagggagggccttgcctattagcagatatttcaatgcagtcatcaccctcccgccattcaatgtcagggatcagcccttgcaaaggagcagtcattggacaatgggcacaatcagggctctgggtttttctgtcctgctgcacattcgacccgccttcctctgctgaaaaggctgcttttccactaggcatgccctatgtatggaaaaaacttctacctctggtttgctttcgtttgtacccacccactgcaaactaaaattgcatgaagcagaggctaagatggttttcctagtacaacgaatatctgccaactctaaatagaaagacttagatcaatgatgactagttaattaagcaaacttgagaaaggggactattcatttattccttacctttcactgagcagtttagaggctttcattggaaatatcattaatcacctgaaatgccttgcaataataactggtatccccattttacagtttatcatgtactaggctctgcggtaggttctgggaatacagacttgaaccagacatgctttcaggccatctgcaggacaaagcaaatgttacagaagttaagtgacttgctcaaggccccttgaagtccagcttggaagactaagaactcaacatccctgtggatcctgccagccctgccagctttcccagagacgcccagctgttgagcttaatctcagagtcactggaacaaccacttcaaggttgaattcgtcaccccaatcacatgggaacattatctaattaagtggctctgccacttgaggggcaaggagagctgaagtcgggtattgggaaacacaggttgctcttccatgacaacaggtcacacagttgaaatcccaaaaccatgggcaggaccaggttgtgtaaatgaggttcagctgccctggctcccactgccaccctggcacacaaaggtcatctcatccatttcctccatgtctttgtatttgctattcctcatcccagaatcatggccccttccttcttccctgtggataatgcctcttttccccccattgcatcttacttattaattacaaaattgtccctggataattcttactttgcttttaagattcagcttagaaatgttgtctttgagtctcaatttcttcctctgtataaaggggacaatagtagcttctacgacacaaagttgttgccaggattaaaaaatagataatgtgtagaaagcacagtgcccaacatacagaaagtgtttaacaaacgttggttgtcactgtcatcattgtcactctcctctgtgatcacaaactctggccagactttaaccattgcagtgcacctcctgactgcactgcacttgtttattcctgtcttccccattaggctccgggctcttccagggaggggtgggtacatcaccagcatatctccagtgcctggcacacagtaggtgttcaataaacctcctgcattatctgaatcaacgaataaatccatactaaacaataagccctcctcctgcgggtctgtatctctgtgacacgtcttccctgtgaaaggcacaggaagaaaataaaggaagagaacagaatgttctcgatgctactc

SEQ ID NO: 1987 - DNA, 1225 bp, Homo sapiens
ctgtgtggtgctgggtgtgagtcggagctagcctgggtttacctgagttgcagggtcacccctcatcgcacccttgtcagtcctcaaataggggtgcaactgttccatgaaagggaacaaagagactgagctactagacaccaagctgtttaggactgaacccattcctgtccaaacggaagtgatccagagggactctgaatattacagaagtcaagagatttcatcatctttattcaaagaaaggggtttgtttgttgattttttggattttttttttggaccacagctctatctactccctgaagagtaaggattattaagtaaatcagatggaaaaagaatcgcaaataagcataatgtgaagagcatgagctttggaataagcaagcctggaattacaattttcttttattagctctgtggctgtaatactcaacttttgcaagcttcagtttcctcgtctgtgaaatggaataatagcacttacctcattggctgttgtatggattaaatgagaccatgactatggatgtatggcatttggtacccaataacccctcaataatcggcagctataattattcataataataatggtggtagcaacaaacccagcccaaacatctgaaggaccgatcactaaaaagaagatgaactcagtcctacgtagtaacaagaatgtgacatctatgttgttgccaaaagtctggaggagttgccaggaccagagagaaggaggtggtgaggccggcctggaagagggaggggacagatgtcaaggaccccaatcttgaggtggaaagttctgtgattaacccagatgaatgtctctaacctccaactcttctgttctcagagttttaatggggcacaccgtgtgctgggcattgacatagatgggaaaagcatgacctaaaataagggctggaagccaagactgggaggaagggcaaagggagcaggcagcctggcaccaggtaccagtgaggtgtctgctctttgtccccatcacctgtcagctaaggaattctgcatgtcatcagtgcaataaaatgtgatcgccagagtgaaaaccttgtaatagaccagctgtggcttctctcaacaccagtatgtccaaggaggatgcatttttattgcttttgtggtcttaacaaaaaagattcatgagcattgtataaaaggcatattaaaacaattcggtaaaaggatgaaagaaaaa

SEQ ID NO: 1988 - DNA, 811 bp, Homo sapiens
tgtgtttacagtattggagggattcacatcgttgttttctggattaagctgctaggagtatcatgtacttagaaattcagtgtttatagtaagatgtattaaacattgctaatgatgtatcgttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaattcctgca

SEQ ID NO: 1989 - DNA, 561 bp, Homo sapiens
agacatctgggctgctagctgcatgaaggagctacccgctgtgggtctcctctttgctgacagctggacacttgacagaatgacctgcctgaactcgggacctgcagaatgatgggactgaagaagctgtaacacaaacagggctaaaacacgcactctcctccccctgctccccaccgccccacccacttgccacattggaggtgatgagaaggagagaagagctgtggcctttcagggagcatagtcccaggggctccctgagccagggctgtgaaaccctcttccgggcactgcagttcctggcatctccaaacttctgagtgccaccgcattccccgcgtccggatgcaggtcaatgcacagaaagaaatctctctcctgactttagtacaatggcacgattggtggccacagtccaaggatggttgctggggcaccaagagatttctgacaaagggcattaaaactgagaaagtttgggaacctctgaatgctgtagaataatggcctccagctccacccaagttgctgcaagagactttatttcattttttttaa

SEQ ID NO: 1990 - DNA, 289 bp, Homo sapiens
gaaggggccggcggccacccctgggcccagccccggcctccccttgtatgcccccagccccccaccaatgccctcccctgcccctggtgggtcagagatctcctggaggctacagggagcaaaggcgatgcccgcaggtggcgagcgtgttctcaggagcaggtgggcaggggccttgcagactcttcatttcttccttcccttatcaccgttagccattttcatgggatagagatacagaggagctcccattacaaagcgccattaaactgtcgtctgtgcaactgtg

SEQ ID NO: 1991 - DNA, 476 bp, Homo sapiens
tgtgaggaggcccaggccacaaggagaggccacctataagcattcaggccagcagccccagatctgctcctcctgccaagctgaacccaagaccagcaccttcctccttgtgtaagatggtgacatggatgccgtctaattgctgcagaggaaatacatacattcaaaaacattttactgcaagaggatgaacaatttaacatcggactgacatcagactgatttgttatctcaaaccccagcttggccagcctccaagttacatcacctcctcaaacctcagtttcctcatctgtaaagaatggaccttcaggagtcatgggaagcttagaagaaaaaaaaaatgtatgtaaagcagcaagcataattattttcctctctcattcaccctgtccacagccgggcagggggagtgccatgaagtcagccagaaatcagcatattggacagtgtgagatgaagtcaggttgtaggac

SEQ ID NO: 1992 - DNA, 1774 bp, Homo sapiens
ggggtcaagcccccttggagcctgcagcccctgccttccctgggtgggctgatgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatagataggtgggtgagtgggtggcccttccattaaaagggaagccagctgtgtcctttccgggcctggaggcttggcccctcctctcccaagcctggcaggggcactggcccggcccgcaccttcctagcagccagttacccaagaggaagctgccttgggcctccagaccgttaaatgccaactcctggcttccggtatcaggctgggttgacctgacctggccccttcttgctgggccctgcagctttctaacttgccgggaggagcagtgacacccgccccacatgtggggcatggaacaagttccttgtggacccagaagggacacaagcaggtgtgcttagtcctgaggcgctgggaatagctgatcctccctgccttgagggggttctcagggcagggaagagttaggactctgtttttttttttttgtttttttttttttgagatggagtctcgcactgtcacccgggctggagtgcaatggctcgatctcggctcactgcaacctccacctccccagttcacacgattctcctgcctcagcctcccaagtagctgggattacaggtgcacaccaccgcacctggctaatttttgtatttttagtagagaccgagtttcgccatgttggccaggctggtctcgaactcttgacctcaggtgatctgcccgcctcagccacccaaagtgttgggattacaggcatgagccactgcgcccggccaatttttttttatgttttgtagagacggggtttcgccatgttacccagactggtcttgaactcctgacctcaagcaatctgctcgtcttagcctcccaaagtgctgggattacagctgtgagccaccgtgcctggccttttattgtttgtttttgagacggagtctcactctgttgcccaggctgaagtgcagtggtgtgatcttggctcactgcaacctctgcctcctgggttcaagcgattctcctgcctcagcctcctgagtagctgggcttacaggcacccaccaccatgcccggctaatctttgtatttttagtagagacggggtttcaccatcttggccaggctggtgtgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttca

SEQ ID NO: 1993 - DNA, 456 bp, Homo sapiens
agaatgaaaaccatgtagctggtcttattattctctaatcatgaagaccattattgttatttgtggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgataaggaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaaaatgaatgcgcaatgattcaattattctccagcgaggaagatc

SEQ ID NO: 1994 - DNA, 1101 bp, Homo sapiens
taaaagagagtgaagaaatgaggccaaccagatgcagtgtacagacttgggccacagtgggggaggtgacagcagacggtttggtgggaaggaacgcaccagagccccatgggcctgcctggccagctcgcttggtcatcctggtaaaacagcagagctctctgttccaagaggcccacgcgcagccccacatgcctgctgatctgtgtacacacgtgtgtgcactctagcaagcctcactttaattgtgaagaaacatgggaaccggtgctcccacccgggctgtgggagtgtggtgcggtggggcctggacacggggagggtccgaagtggggccagctccctggagtcaggcatgtctgtctcaagctgcccctgtcccttgctgaatgggaacccccaccagctgcctcgggagcccgtgtccttacactctattcggatctgctccagctccgtcacctcagcaatggactccttcaggtcctccacgaacttctgcatctcgtccgagcccagggcacagaaatgcagcacctgcttcttctcggagcccgagagcggggtcaccagtgtgatgccatgagagtaatctggaaagcagaccccaggcccccagtgggctgtgagcagcagcagccgagggccagagccagccagacatgaggagggcacggggtctcatgcctccacccactctgctgtccagcccttctccctcaactcgccccagccatttcatccattcattccttctcaaagacttacactggctgtcaaagacttacactcgttctcaaagagctggaactgcatgcccagcaggccaactgacttgcaaaaggtgtacgtggaggagctcttcttcttcgggcaaagtttgagaatctgttcaggagagggaaacaggcatgccctgatgaacagacactcacggacacatggatgcacaaacacccgggggatgcacgatcacacaaacccacgcagtgatgaatgtgcacatacagcttctgtgagctgagccctggagatacaggagaactcaggacagagcccctgcccttaaggtgcttatggaatgtggagtgtcacagtgtc

SEQ ID NO: 1995 - DNA, 432 bp, Homo sapiens
ccagccagaagcaacatgtagatctaatgaccttctccaggagtcgaggacccactacctcgctgaattctcagagtcaaaatgcgtctctacctgctggtcccagaacagtcccctgctgctgcattgaatgaatctcatctcacttcctcgagtcagccctacctatatttgatgatcacaaaccttatccttacgttgccagcagtaacattctgcatccctcacccactccactgtgtccttttcctcccactgatcttcactctgccttttctaggggaactctgaacagtatttctgagaagggtgctggcatctcttcatccctagagtgatgctgccatctccgtcttgaatgtctctgctgacatgacctgctaaacttgaactcataggcggggcaatcgcttgagcccaggagttcaaaac

SEQ ID NO: 1996 - DNA, 281 bp, Homo sapiens
tgactgtaagtgaaagtgaatcagtatgatcgtacctaatgaaacccgtctttggcctgtggctgagacgccatctgtaggcggtgaaatctttccagcctatgtgacgagggtcatgccacagggtgcgcacctgaaggaaaaggaaaaggaaaggttgaaacacagctccttcagggctttgcttcttacctggccaggggtgtttcctgtgtgccacagggcgttccgcaggtgctcgccaggccctgtggtggagtttacaactttcacagaaaggc

SEQ ID NO: 1997 - DNA, 4867 bp, Homo sapiens
gaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcttcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactccgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggtgggtgttgcccccgcctgcctttgcctccgccgtggccctgagagtcctgggctctgccccgcccggtcccttgctccccactcagttctggatttggggctgcccctaacccagcccgttgctgctttgcaccttttcctgtcattgggcatcccccagtagtcaccccactccaccgaaaagtaaactgcaggtgaggccgtgccccgagtctttcttcggtgtgtttggcttttccggggcgcttgccttgccatgattctaactctctgcccttccccaaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatcgtaagtggctggagtgtaaagaacacacatgtggccttgctgctgagggtggggccagctgcccggagcacaccgccaggcggacctcgtggaggggctggcgggcactggccgggggtctgtgcaccgggaggtgggtgcccatcgagtcaagccaagtgcagacctgggggctcctgttttctaagacaggagccccctgcctccttgtgttgtctctgtggcaaaagaattctataggcgggcttcaaatgtcggaccccaaaagaatttcttctttttcactcttctaaatgaatggctctttcattattgagtctccctttggctcttgtgccgcagggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaaaccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggcc

SEQ ID NO: 1998 - DNA, 2029 bp, Homo sapiens
ggatgttgtgaaccgggtcgcggcggccgaggctcgggcctccaggaccactggctgcccatgagagacgaaggatggcatccaagggggccggcgtgtctttctcccgcaagagctgtaggctgacctcagatgctgagaaatccagggtcacagggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtctacagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagaagactccacgctcgcttgccctgattctctccgccctgcacttttgccagctgaaggtccaggtaggaaggggcttgagttttctgggcgcagccagaggcccagggggaggggctcgcgccctccaggtgggggtgggggcgtgtctgggggaggagtctgagcgccctggggtgcagccagagccctgagaaatagtgtctgagggtgtcaggacccccaaggaggtggtcgagggctctgcgctgaagccagcccagaagtgggggtgcttgggcagctgggggtgggtgcttgggcagccggtggagggaggaggctgcgacagtgttagggtcctggtagagagggagacaggtccctggtcatacagagccaggaccctgggaaaaggtctagcaagggaaatcacagcctaggatgagagcttgggaactaggggcagagccagggtagggaggagtgtgagagtggaaccaggatgcaagggggaggagcctgggagccctgggggtgggatcagaacccaggagacgagtgtgcctgggagtttgtctggcatcccgggggctttgataggagttgtccgggaccccagggagatgagggttcagagggtggtgagggcacataggaggggagtggaagcctggctctcaggcctaggcccctatcctgccccagggcaggtccaggccctggaccccgcctagcgtaggctagtgtgtatccctggaaccagaagagagtaggtgggctctggaggcctcaaaggacccccgctagactctgtgatccccacgccccagaacatgcgtgggcgctatgaggcaagccaggacctgctgggcaccctgcggaagcagcttagcgacagcgagagtgagcggcgggccctagaggaacacctgcgtggcgccgtcggtcttgtcccgcaggcactggccaacatggcgaaaccccatctctactaaaaatttaaaaaattgcccaggcacagtggctaacgcctgtaatcccagcactttgggaggccgaggcgtgcagatcacttgaggtcaggaatttgagaccagcctggccaacatggtgaaaccccacttctaaataaaaatgcaaaaattagctgggcgtggtgataggcgcttgtaatcccagctactcgggaggctgaggcaggagaatcgcttgaactctggaggtggagattgcagcaagctgtgtggagtgcagtgagattgtgtcactgcactccagcctaggcaagagtgagactgtgtgt

SEQ ID NO: 1999 - DNA, 326 bp, Homo sapiens
cgttatgtccagtgcctagaaaagtacctggtaagtgttgtgaagtatttcctgaatagaggttgaatgttgtgataagtttcactgtgactcctcatcttgtacctgcacttgcaagtttcttcttgtctgcctggggcgttgcgctcagcaccttcagcccccaccactcaaggttcctgtctgcatgagtgtaatcaccatcgagtgtcaacagcaccatccctttccccactctcattcagaagctcctcatctgctctgggatgggacaaactcactcttgtgtcatcattctgccaagtttattaaaactcaaaatgtga

SEQ ID NO: 2000 - DNA, 1904 bp, Homo sapiens
ttttccctgttcttcacgtgggacacattctccctgctctgtctgtctctgtccctgtctctctttctgtctttctctctcactgtgtgtctctctgtctctctctctcttttttttttctttgagatggagtttcgctcttgttgcccaggctggagtgcaatggcgcaatcttggctcactgcaacctctgcctcccgggttcaagcgattctcctgcctcagcctcctgagcagctgggattacaggcatgcaccaccacacacggctaattttttgtatttttgttagagacggggggctctccatgttgcttaggctggttttgaactcccgacctcaggtgatctgcccacctcagcctcccaaagtcctgggattacaggcgtgagccactgcgtccagccgtctttgtctctttttctacatctctgtctttcttctctggttgtttttcaaccatcagccgggtgttttcccccataacgtcttgtttgtttgactatgaggttgacaggtgggtacatgaactctatagcagaaggtggacagtctgcacatagcagaggatgggtgaatttttctaccccttgcagagcacaggagagctgagcagatgccagtgtctgctccagtgtaaggaagtccaggaagttcaggtggtgaggtcacagtggaaagcaggacagatagagtttaggggaaattaagcaaaaataccacactgttgtttcttgacatattagtggaaagaggaagggcccagagagaagacagaaaattagatgcaggggcttgttttttctcttgacttgccaacccgcccaacgcaggggccagaactcagggtggtgagatctgggaacattgctgtgcggagaagatgtccctcctgctgcacgggcccccaagcaccacctgggggaagagccatgtttaattcacctggcagtgcagtgtggccaggcagagagggagggcctaccctgtgcttatgatcccaccccagttcccctggggtgtgccctggcggtgaacaccaggaggctgcagtggggcccaacgtgaaagggaggagcagcctcaccggggccagatggggcagcagcagatattcacagatgtccctgtgagtaaccagggcagaggccaggggtctggccttccctttcttggagccctgggccagctgggcaaggcgttgagagaaagattacccggtgacctttatcaaagcagagtaaggagggctttattcagaaccatcactgtaggtaccaggaccccagcggtgggattttgtagtaggggaaagaaaatgggctcgacgttgaatacagcatgaacaagtgagaatgtttgttatacaaactatagggtggactttttttttcttttttttaactttttttttaccttttagtgtaaaactgaacatagaaaataaattcatgaagaagggatattttctgagggtgtccagggctgcccaacacctcttgtctaccttctctgtcatagccccatttaaaacactctctctggatgaatacaccaaacctcacagtctttgctctcttgctaggaagaggagcaagagcgtgtttcactcttggctcctgcttacacacctgccgtccaatggaaactactacttaagacatttaaaaatagttgtggtgatagcatgttgtgttttggttggtgatgccagttagtctctgaaaactttctgtgatgagtgtaaaattctacaccttaatctcctttcttgtaggatctgggaagcagtatgcacttgattgcaccaaagattttacgttcatagaaaatttctggcatctgtgtgaagaaagtaaactatatcttccatttaaacaaataaaatatctttttgataaaa

SEQ ID NO: 2001 - DNA, 612 bp, Homo sapiens
cggtgtagcacgatggaatctggtggcttaaacctagctgtccacatttcactatctgaagagcagaaaatgtgttaataggagcctggtgagtggaggagactgaagatggagagagagcctggacctcaacatgagcatctggagccatttggcagcattaggctgtgaccgcttagagaaccgaaaggtgcagagctttaaaggattatggagtctgaagaccaaatgggatgatggagaacagctattcagtggtacaaatgtaaatgctcccaggcccgggcagaaaagagaaaacatttccatggaagaggaaacaggaaattccaacagatcagcaacagttggagtgctaacctgtcactggaatgggaaaaaaaatgctgtcgttgacacatcttttccttgtttttgacacaaattagaaacaccacctggaacacagctgtgacttgataaacaagtgaaacattctttggtgtggtgaggggaaaacaaatttctcaaaggacacgcaccatggtgtatgagaggacactggagcccagccagcatctgacatgctgaattcaaagtgcaggtgaaagtaggacaactgattcacaagct

SEQ ID NO: 2002 - DNA, 86 bp, Homo sapiens
aagagccaatgatgtttttattcaaaatgtctgaacctgtctgaagcatcccagtgatgcaacttctgtgtgatactgaggctttt

SEQ ID NO: 2003 - DNA, 3049 bp, Homo sapiens
gcaagcgccaagcttccatccggacttcaaggccagtggctgggtctggttttctcaacacggcctcctagtctccttcccgcttgggcatctgtttttcttatatagaccctgaagccgcccgtgatgttctgtaagcaggttccgcttcagaatcagaggtacttaagagggaacctggatgctagacctgcccttgctgctggcctcagtttctttacctgtaaaacagggattttggaactgttaaattaaatcaaacttaaaagaattacaacttaaagctgctggaactttacatgatcccgagccttgagaggaatgtggctatgcagcctgagtcatgtggcatgcagatgcaacctctgcctttttccgctgtaaataattaagaagaccaagtagcatccaagagtcacctaagctgaagattcccttgagaacaagtactgtcctgtggtttcatggcctttcttccatttgtggttcttgccaagcggaatttaaatgacatcttatcaagatggataaaccctagtttcccagtgctggaatatagaaaatggatggacaagtaaatcccactcagcacccatagcccaggcatggggacctcaacacatttgagccgcagagatcacctttcattgtgaatagctctgagatgatacttctggttgaatgtctttttgtcacttccggctggatctaccatgaaagatttctgaatccaggaagagagattgactgggcaacatgttattcagaaacaggaccttgccctgtcactcaggatggagttcagtggtccaatcatggctcattgtagcctcaaactcccaggctcaagcaatcctaccacgtcagtcttcccagtagctgacagggtctcactctgtcgcccaggctggagtgcagtggcatgatcttggctcactgtagtgtagacttcccagcctcaagggatcctcccaccccagactcccaagtagctggaattacaggtctcatgctctcactcaggctgcagtacagtggcacaacctctactcactgcagcctctacctgccaggctcaagcaattctcctgacttagcctcccgagtagctgggattacagttgaagcatatgtcctgtgagcttaggggtgctacaagttgaccactgcagcagtaaagatgattctgaagaatggcatgggatggatcctttcgaatgcacttgagcagcggtctccaaccacagggccacagagctggagctggatctaccatgaaagacttctgaatccaggaagagagactgactgggcaacatgttattcaggagatggggtctcaccctgtcgcccaggcttgagtacagtagtgctatcacagctcactgcagccttgaactcctgggctaaggatcctcctacctgagcctcctgagtagctgggactgtagggtctccctctgttgtccaaggctggagtgtagtagtgctatcacagctgactgcagcctcaaccttccaggctgaagcgatcctcccatctcaacctcccacgtggctgagactacaggcgcttgccactatgcccaactaatatttggaattttcctatacgtggattccagaggggtgacagcgaaacgtgggaccatccagttgcaggaaaacgagcttaacacgcccactgattctacattatgctcctacctcccggcagcctctccaggcccagaactttctccagtcggcctccacagaccaagctcatgactcacaatggcctatttaggcccataccctacctcacggcagtctccgcagatgaggctactgcctcacaacagcctccacaggcacagctccatcgttacaatggcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagttggcctccccaggcccagctccagcctctcggcggcctctccgggtgcaaaagttcctcgagtcagcctctccaggcccagctcctcctgcctcccagtgcctctttcggcccagcccagctcatgcctctgggcggccttcccaggccccgcttttgacttttggcggcctctgcaggcctcgacaaggcccggcctcctgcctcccgaagcctgcacaggcccagcctctgcctcacagcagactctccacgcccagctagctctcgcctcactgcggcctccccagtccaaagctcctgcctctcggccgcttcggcaggcccagctcccgcctgccagtgcctcttcaggcccatggggctcattcctcacaacggcctttccaggccccgtttttcccttccggcggcctctccgggcccagaacctcctcaagttggcctctccagacccacttgcaccctccgggcgtcctctccaggcccagctcttcctcccggctgcgtctccaggcccgactcctgcctcccaacaacctctttggactcagtgcctgcccatctcctggcggccttggtcggcccacagcttcctcaagccaagctccccaggcccaggtcaggcctcacggtggcctctccaggatcagctcctgccctccgatggtgtctccaggccccaaatggtctccggccagtgggctcctccacgcccagcttgggcctcccggcgacctctgcaggcccaagtcgtcctgaagtcggcctctcccggccctgcctcccagcaagtaagcaagcttttttggcttagctcctgcccagctcccaaccgcctttgtaggccccgaactttctccagccaagctcttcgggcccacctcctgcctcccggtggcctgtacaggcccagctctggctggagaacagcctctgcaggccccgctcttgcct

SEQ ID NO: 2004 - DNA, 1838 bp, Homo sapiens
aaaaaaagaaaaaaaaaaacggtcatgaggccagttctgccattgtgtgatctgtaagtggaggtcttcttctttgggcctcagctataaaataaatgagtcatgttactgtggctttgtttggttttgttgagacagggtctcgctctgttgcccaggctggagtgcagtggcacaatcagctcactgcagcctcaaccatctgggctcaagtgatcttgccacctcagcctcccgagtagctgggactacaggcacgcaccaccacacccagctaatgttttcattttttttttttagagacagggtctcactttgttgcccaggctggtctcaaattcctgggctcctgtctcggtctcccaaagtttcgggattacaggcgtgagccgccgcacctggccaggttactgttggtataggaagtctacccgcaagtttagggagctggaggcagccctaacacggagggaagcattgtcttctcatgccaggtttagctcccaccattagccgcaaattttatgtatttatttactttttgagatgaagtcttgtgctgtcgcccaggctggagtgcagtggtgtggtcttggctcactgcaacctccacctcctgggttcaaatgattctcctacctcagcctcccaagtagctgggactacaggcatccgccaccacactctgctaattttttttgcatttttagtagagacggggtttcaccatgttggccaggatggtctgaaactcctgacctcaggtgatccaaaagtgctgggctcccaaagtgctgggattgcaagcgtgagccaccacacccagccagccccaaattttaacacatcagcaataatttatagctggggctcacaactcttctgaggggatgaaaagctaaagcaatcagcatcttgaaggcgagggatgtgtcagggatgagaaacagaaggaaggtctcttgggacccactttctccatgagggcctctagtgagcctccgccagcagccagattgcaacccagtatggcttccagggtcaggctgttttatctataagtgcaaaattactgtttatcccatagaaaggacacgtctcccaactccttaccatctagaggcgtcactgcgaccgcagctatggaacctgccacacagcctgacacgaaggaatgtgcaaaggacgccttaccggcgagctcgttgaaccccaggttgttaaggttggcaaacagtgggaagtagatgatggagaaaggaatgtctctgcagaagaggaaggagaaacactgagctccgagctgccctggggctgccacccaagatggagtctcgctctgtcgcccaggctggagtgcagtggcgcgatctcggcgcactgaaagctccgcctcccgggttcgcgccattctcctgcctcggcctccctagtagctgggactacagagcacagaggctcatcaggaaggaccccctggcagccctggccccatccccgcagcaacggaaggaacaccagttccccatgtcccatacgctcacacctgctgcccagcctcccaggggacctgagaagcccacctcggtacatgccgaagaagccctccgcccgagccgtcttcatcaggcagtcgatcctggaagcagaggccagagtaggagcgggaggcagactgtgaacaaaatatttggagatggatttacctggaagtggtaagagtagatgatagtgggcctttcacaaaggaagaaacttgggacgataaagagaactgtaaacttaattttgtagttagagaagatgaacccaaacaattaaactatgttgaacaataa

SEQ ID NO: 2005 - DNA, 419 bp, Homo sapiens
ctgctctagtcacacaactggaaactgactagtctacgcatggccaaagcttgaggagtcatcatcaaatgagtagatgtacatctagttcttctatttgtctacctataggtgcactcataacattttaatttatttcatgtgttgtcatcgttatcctctgtattactctgagaaagaagatgttacctgtttgtgaaaaagagggtcacagagtatgtgtgaaccaatacttcatttgagacagcctcacatggagaatgcaatgagccattctcttctcacatacaggtaaattggaagttgaatatgacatttactgcagtttgatcactaagcataagacctttctttaaaaaaaattatgtaagcaaatttcttctttttcaaagggtttttaatacaatgtttatgcttca

SEQ ID NO: 2006 - DNA, 506 bp, Homo sapiens
aagcggctcggagtgttctggaagtggcaggagcacgactcccttaactctggtgcagggtttacctcggctccctcgggacgggttccgtgcagctcctgcttcctcccttctctttcccagtgccatccctggcgagggggaaaaaaaaaaacacggccaggagacttcccacccctgctttgctatttttgtacctccgtgacagaaaaacaaaaccctgaggaaaagtcaggcgacttcattccctgccgtccgcgccggggcctcgactactgctggcgtccgcggctttcgcccgccgctccacagagacggggtcttattatgttgcccatgctggtcgtgaactcttggcctcaagcagtcctcaaaccttagcctcccaaagcgctaggattacaggtggataaaaccttgtatgcatcaactacctctctttcaagatggaattttcagaacacatggtctgggattggagctggagcttggaaatattgagtggg

SEQ ID NO: 2007 - DNA, 1061 bp, Homo sapiens
gaggactgtgaagcaatcggggcgaggccgggtgtctgttcaactctcccgcgtatcgtctgtttcttcggcggcggacagtgttctgtaatgtgtctcccgttgcccgagctaaaggttttcctcgacggagtctttagaataccgtggtagaggcagtctccacaccactgtgctcgaacagctctatgaagaggcctatgtggagaggagaaaaagcctccaccaacagccagcaccaacttgccagccatatggcgtcttgctctgtcacccaggctggggtgcagtggtgtgatctcagctcactgcaacctctgcctcctgggttcaagcaattcttctgcctcagcctcccaaagagctgtgattacagacgtgtgccacaatacccggctaagttttgtatttttattattattttatttatgtgtttatttatttatttatttatttattttgagatggagtcttgctgtgtcgcccagggtggagtgcagtggtgcgatctctgctcgctgcagcctctgccccccaggcgattctcctgcctcagcctcccgagtagctgggattacaggtgcccgccaccatacccggctaatttttgtatttttagtaaagacagggttttgccatgttggccaggctgatctcgaactcctgacctcaagtgatctgtctgccttggcctcccaaggcagggagcctgctgggattacaggcatgagccaccacgcccagtcaaaatgttttaaatgtttctataccaccatctgtgtcaaagagcaaatggtctctctgcagctggaacaacaaaaactcaaatggtccacacagtggttcatacctataagtcaccaaacctaaactaagttgttatctgaccttctggaaatgagaagagatagataactgccagtttcccaaacaggccagtttaaatcttcctgtaagcatgataaggaagttccctctgatttaatccttacacacgaaaaagtagccttaaataacctgatattaactcatcagttttatttttatttatttattttttt

SEQ ID NO: 2008 - DNA, 3403 bp, Homo sapiens
agaacatgtctgacgtcagcgccagcctggacggagagctcggatcccagagaaggctgagcacagggaggagaggggcatgggcctctgcatttgagctgctctcgtcctgaagtttgtgccctgggccctgtgagaactcaggggccagcctgtgacaccccggccaggccatgcgagggtggcgccgggacgccgccctctgcggctcctttggggagcactgaccagcactcagggatggatccgtgcagcgagttgtcgagaggagagagtggaggaggactccgcagtatcccggctgatgcatattgagtcatccagaggagagagagggggaggactccgcagtatcccggctgatgcataatttgttcttcttatgcattttaccaccattttggctagcatttggtgcttcaaggaacagctgttagaagcgaaaatcagagaaaaaggcatttgcgtttcaaaggcttcgctttgtggatgacacatcccagagataggaggaactcctggcagcagccatagatttggaaggatgcatccccatcaggtagcggtggaggaatctccagggaggagacagagaagggagaggacaggagggagaggagtaaggggtttggatgcctgtgggtcctcagagagtggcctgagagccagactttctccctttcccctgagagcaacatggagctggggaaagagacctcagacacgccactcccctgccttcctgatggcgacagacacagagaggcctcagggctgggagccgggaaggtggaggagctgcccatgaggctggtgctttggcagggaaaggggccccccaggagctgccacctgccccaaaggtgcacctgggatgaagatgggggggaggcaccacagcgacctagttatggcgagcaagctctcaccatacagtagaggaggagacagaaattagttcagttacagaaaacagatacattggtagaatttacatgttataacataattccattaaaaagttggcatactcctgaaaacctacttactcttcccttaagaatcaagtaatattatgtttattagaaattatttggagaaatcaaaagattggaattacagtcttagcttcacactaattatgagaacgtcaaagttttttgtttgtttaattgagattaattcacatatgggaacccgcttttaaaagatcaggttccccatctctttattggatataagaatgatcctatttgtttgtactgttaattttttgtttgtatattggttttccctataaaattataacaggctaagtttcttgggacagagactgtcttgaaatttttatttctctgaagatcctagcgcagtggctggatagtccccttccagtgggcagaatgctaaggtggccccaaagtctccccgtgtgcacctgccgtgcgtgggcctctgtccttgagtgtggatggtcctgtgaacacagtatagtcattgcccccatgatggggtgacatcctatgagaccccagcccagctgccaagcagtgaggccaccggctgtgtggccaggacctgggggcctcatccgcggaggacgactctgcccaacgtccagcaggacagtcgggcctgacagctgcaagctcaggagctgagttctgccaggaacccgcatgagctagcagatgcaggaggaggcgcatcctggcgaggatctcactttagcaatccccacccctgctggtgccccagacccctccccatcctgcagggctctggatgggtcaacctgcctggcctccaggactagagatcacggcctggacacagcgcagcaacatttcctctcttttccctgaggtggtgacctggccagatgactgaagggctgatagtgaggggctgccagcccagaatgggggcatggggcttcgtaggagctggggcacggcagggttcagccctggatggaaatgctctctgtctccctcccttgtgctgcatttactcctgggctggggccaccctcccttccacctcctgcagatcacagagggacccagagctcaggagaactttcttcctgtgttataaaacaaggtatgccattgaaacatgcctgggtcaaacagaaagctcccaccgggcctggaggagcccctggcaatgtggtcctcattcccgccaccctctgcctagaaggggatctcagagagttgaggggacctctctggttgggaaaaggggagcatccagggagcgccaggagagtcctggaggaacattctgaggtgacacggccccagggctctgtctacggcagggatcagcattgctgacacacaaaatatttattccctgatgatgtggaatttggaatcatcatcagagacttcagtgcagagcaactggaacctcctgagtgtgccctgtctatatatctggtctctggacagggtggccagtccttgtccatgacagggagagcgaggacccctcccctccacacaattggcagacgaggaactaccctcctggggatccagaggcagggcgcccccctagagaggacagctggggagggtcccctcactgtacttcccccacacctccagacaccagctagtgatctgtcctgagatcaaaaccagaatcctagtagatgagctgcatgcttgctgtggacgccctgcgccctgagagtcttgtcctggatcgcacgggtgtgtccacaaatgagacccagcagccctggagcagccccagcgtctctccctactggcaatgcatccgggagcgtggcttgccctccgagtcagttccctcatctctaaaacaggaccacacagatctcagggcgcgttggttgaatgtttacctgtgttgtgtaaaaactatggctactcagcaccacagagaggcaagagagcatgcaggcgtcctgtttgggatcatgggagaccatattcccagcttcctggtactaggtgacactggggggcctgttttacttatggaattcccagcttccctaatggtaggtgacatcttggggcaggatttacttatggaattcccagcttcccagtgttaggtgacactgtggggtggtttttacagatggaatgagaaagaggtaaggtgtgctcctccagatccagaccctaaacacctccctcttgggatcctccacgttctcttcctctctctgttatggaataaaaacaaccgtatgaaagtgtgtcgaaggtgccagagcccttctccctgttgcctgtccagcactgtgatgtgtgtagacctcagctctgctcaaatagtttgaagtgtgtttgtcatggccgtcagcctattctcgctaatcttccattaaatgagatgactgatttaaaaaata

SEQ ID NO: 2009 - DNA, 2651 bp, Homo sapiens
acttattctctctcctgctgcctggcgaagagatgctttccgccatgattttaagtttcctgaggcctccccagccacatggaactatatgaccaacatatgtgctagagtgtctgacggagagaagaatttaatcgatgtctgttgaattcgctcaagtaaataaaacagaaaaactgttttataaacggcaacaaagtgcagtagtcattactagataaaggaagaataagctacgggcccactgaatttccaagcaacttgcagttctgcaaagagtattatcagctgagaggcaaccactatttcactcttcgaatctatgaaattgaccatttttgatatctcatattggaggtttgtggcaaccctgtatcaagtaagtccactgttgccatttttccaacagcacacgctaacttcatgtctctgtcacagtttagtaattcttagaatagtttaatctttttcattattattacatctgttatagtgatcattatatctgatacagtgaatatagtgatatcatactgttatattcagtggtccctgaagctggcagaggttggctcatgaggtgtaaggaaaaaaggcatctctataacataaaagtgcaaggtgaagcagcaagtgctgatgtagaagctgcagcaagttatccagaagatgtagctaagatcactggtgaaggccactataataaacaacagattttcaatgtagagaaaacagccttgtatttgaagacaattttatctaggactttcatagctaaaaaggagaagttattgcctgcttcaaagcttcaaaggacaggctgactttcttcttagtagctaatgcacttggtgactttaagtggaagccagtgctcttttaccattccaaaaatctcagggtccttaagaattatgctaaatctactctgcttatgctctgcaaatgaaccaacaaagcctggatgacagcacatctgtttacagcatggtttactgaatattttgagcccactattgaaacatatgttaaaaaaaaattattgctcactgacaatgtaggtagtcgcccaagagctctgatggagatttacaaggagattaatgtgttttcatgcctgctaacacaacttgcattttgtagcacatggatcaagaactaattgtgactttcaagtcttattaattatttaagaaacacatttggtaagactatagctgctataaattgtgattcctcttactgatctgggaaaacccaactgaaaaccttctagaaagatccacaattctatataccattacaaacattcgtgattcatgggaaaagacaaaaatatcgacattatcgggaatttggaagaagttgatttcaacccttgtggatggctttgaggggttctagcattcagtggaggatgtaacagcagatgtggatgtggtggaaacagcaagagaactagaagtggacactgaagatgggctgaattgctacaatctcatgataaaacttgaacaaatgaggagttgcttcttacggatgagcaaagaaagtggtttcttgagatggaatctactcctggtaaagatgttgtgaacattcttcaagtgacccaaaggatatagaatattagatgaacttatttgataaagcagtgccagggtttgagagaaatgactccaagttttaaaagttctgtgtgggtaaaatgctatcaaatagcactgcatactacagagaaatcttttgtgaaaggaagagtcagtcaatgcagccagcttcattgttgtcctattttaagaaattgccatagccatccaaccctcagcaaccaccactttaatcagtcagcagccatcaacattaaggcaagaccctccaccagcaaaaatacaaagacttgctgaagtcttagatgatcgttagtgtttgttatacattttgtgaattaaagaatagagtattctttaattaaggtatgtactttttttagacaaagtgctatcacacaattaagagactacagtatatagtaaacataacttttatacacaatgggaaaacaaaaaacttgtgtgactcacttaattgcaattttcactctattgtggttgtggtgatctggaaccaaaccctcagcatctttgaggtatgcctgtgtgtgtgcgcacaacttgaccctgagttaactgtcttattcttctcttttatttcttagcaaatttgccatgatttaaaaaagaaaaacagcttatatttatattcctacttcctcattcctcatttacttctcaaccatctgttggcttttgctcatatcactttatgtaagagaggtcatgccaaagctatatacatggttccttgttcctggaggggatatccatttgaaacagatataaatatgtgtggatatatatatatgtatgtatgtatgtatgtatgcaggcttttatatatgtattactgtgtatcacagaactttgttatagcctctgaagttagaaaaacaaacaatataatatgcagttccaagaatattttaatttttatgttagagacaaaattaaatgaaacatcaccacaactgaatgttaactacttaattttcacaattgccttggcattaataaaggttatatgttttcagg

SEQ ID NO: 2010 - DNA, 1585 bp, Homo sapiens
cggccgcacctcctcctccatccggagaccaggcccctgccccgcccgcggctgaggagataaggagaggctgatttgaaaagctgcgaggacgcgcattttaacctccagggacggcttgagccccgccctgcctttcgaaagtgctgggaacggattttatcagcaggcgaaactgtcctcaaagctccgtggcccagcaaaaggcagggcggggacgcccatggcccccgggccggccccctacgggctcagcctccgagtccccggactggacggcgcgggcgtcgggggtccaggctgctccggccgccccgctgtgagcccgagctgcgctgcagccgctggtcacgtatgggggtcccccgcgtcctttcctccaggccggcagtgggctggggccgcaagtgtccccgcgtacactggccgtcccccagggacaaggacagttgccctgaaaagctgcggctcccgccagaaggtcccagctcgggctgccccgggcagacgcagagcgaaaggcgaggcaggacgggcctgaggaacctggaagtccctgcagggcccctggaagaggcaggcagggggctgccccacagacgggcccaggagaggacacgccgggctggcatcacgtgaggagagcgtccagcaaaccacactggtcccgaggcctccacgaaaagtagatgggcatctcgcggcagccaccactgaggcagcaccgggaaagcatggtgggtgcccactggccccgcagagggcaaaggcatgcacacgccagaagggaacgtcaaggggagcaaagagaaccccttcctcctggaatggctgaggggaccaggccgctctgtgatgcagacatctcaaggggctctcccttgcactaccccatgtggactttaactcccaatttggaaagtaatgatgtcatcttctgtggtctcagggtcctagtgagtgtgtgaggataatagtgttacatgttatgcaaagggattgtgaactggcatgggggtcaggtttgcagggcctggagctggtgactccagctctagaacaaccccaggccggctctgccctacccaggagagatggtcataggggaaagagtccagtgggcattggaggcgtaggggccacttagggttgccctttgagctgacagtggggtacagattcagctctgcagtgcccctaacccccactgcggatccacccgggggaatgccctgaggacacgcgaggtgagggtcaggcgtgtcctgctgggtgggaactccggaccctctgggaaggaatgggtgaatcggctgctctcactctccagctcccactcagaggagccctgggggatcccattcctctacctcagaggactcccaggacactgtctgagcccagtgggaggaggacacacagccctgatctgccagtcagtggggctgagggtcaagctgtgcgccttgtgtgctggcggcgtcccgcctgggatggatggagatggtctgtactttcatgggtgaattgtagggcccctgaattgtatgtatctcaataaagctgctaaagaataaatgtaaaa

SEQ ID NO: 2011 - DNA, 457 bp, Homo sapiens
ttagaataacagaatttggtcccctcccacttcctggagaattatccctctgtaggcaagaagaagtctttattctcttcggaagctgctcctcttgcactccaaaatatagttctgatggaagctgccaatcactttatcccattcccagaacaggcatggtaccagactgaggtcaatcctatactccaccttatttgccatggaaaatagcctagcgatacttgcatgactcagggcagttggagtagtttgatggaattttttaaaccacagctgacaggaagtagctctgttccttattagttgcaaatgctgcaagcatatgaccctagagttatctgttgccagttgttgccttgtggagatcataggcttaagatgatgaaggcagcaatcagcaataagcagaggtgtgcttgtgtgtgtgtgtgtgtgtgtgtgtgtgtgtgtgtca

SEQ ID NO: 2012 - DNA, 382 bp, Homo sapiens
aagaagagagaaaacggagcaagctgcagcaaaaataaacggtgaagcgcgacgatgccggccaagaagacccccagttacttaccggcctgcttaccagccattttgaccagaaagagaagcgttgccttctggtcagtcctgtatacagcactaaagctgatgaatgatctatcttacactagccaaagtgaagtctgaaagatgtgaagaaatgcagtacatttgtacattggcacattgccctgcagaggactggcaacactccagaaatgatggagacaggatacatcaacctgtatcactgaagatgatgtggagcagagcctttgtggtcctaagaaacatgtataagataaaaacttttgtggtttttcaatca

SEQ ID NO: 2013 - DNA, 443 bp, Homo sapiens
aggagagaggaacctgcagcttgaggaagttcagagaaaacccagccctttcaccaagctgtgaagaagccaagcagttctcatggaaaaaccacatatatgtatttctgccaagaggcccagccaagatcccagcaacagccagcatcaactaccagacataaaccggccgggtggaggatgcagccgggcgtggtggctacaaggaagtgccctggtgttaagaactcagcctctgaaacccgccgcccagcttcgagtcagcgacgtacttttgttgtcccggccttagtatccccgctgcaataagaggtactcagctcaaaccatctgggtgaggattaaaggagttcatatccataaaggactagaacaggtcctggcaccacgtaaacattcttatcatcaaatgtgaaaaaacaaagttctctaagatttcgaaa

SEQ ID NO: 2014 - DNA, 278 bp, Homo sapiens
ctttcagcgcctgcaggttccgggaggtcagctcccagccgaggacgtcggatgtcatcgtccttgctgctttgccaccccattcccgtcaataaagtggtttgaacccaaccctggtgtcggtgtgtgtcgttggcgacgcgctgtctttgagcccccgccgagcttcctcgtggcgccgggggtcaatctgcagcgctagagcatgtgcttgcgcataactggggccgcctggcctcccgcgggcggcctttttaaccgcgagcgacaagaagtaa

SEQ ID NO: 2015 - DNA, 750 bp, Homo sapiens
ctgcagctgggcctggaggcagtggctctacagcagcagtgagagccgagctgtggcagacacatgctcttcccctgactcacggctgcccagttccctccagcgaggctgctgacctatttttctattaggaacaaccagccaatgtgataatgaggaaaatgtattctggcccctatgaagtttagtgaagcccgaatgaagtggaggaggccacggagatgcacgaggaagagcattccaggcagagggaacagcgaggacaaaagcccccgggcaggaatgggtgtgcaagcctgagatccaacatggcggagagcaagccggaagtgctgcgcggggatcctaagggagcactgaacaggacaagctcagttttgtccctcaaacctccacaatcagctattttacataaggaaagtgggtggtgattaacctcagagtctccagggacagactatccaggactgtgcctgaaatagaagaggaattaacatcatacagaactgaatacggtgactgaggggagtttgtgtctccccttttaggaaagaagatgagaataagtatgaaggagagtcatgtactgtacattaagcaaaagcatgatgctgttatttgaaatgttaattagaggtgcccactaaaaactgctcagcaattttcttggagacctcagtgctcatgttattctttcctctatcttatgttttcctctctcctgcccttttcagaaacagtctacagcag

SEQ ID NO: 2016 - DNA, 439 bp, Homo sapiens
ccagaaaagggtccatccacaaggagagaaacgtggaaagggcagaggcttcaccctacctttacagccacacttcttgcaggtagtgttcaagacagcctcaagggtgatcttctgcccagtgtaatcctggaaggatcgcctccgcctctcttcttgcctataatgaaaaagataccgactgccggcccccttaagagatatggccagagatactacaaggatgacatatgagttcgatggaccagacctgggcacaagaagaagaaataacgtaaagcagagggcatatctggtatttatactctaaactggataagaaggtagctctctcctggataaacatgaccagtctagaagcgttagcagtgaaaaactggaaacaacttaaaatgattatgtggtacatctgaatgacagaataaagccattaaatgtt

SEQ ID NO: 2017 - DNA, 3249 bp, Homo sapiens
tatgttgatgaagcctccggatggcaggcttcagagagaatagatgtgcatgtctcttataggcccttaaaaggtgtcagagtctccagaaaaagcctaataagggaagcagattctctgcagaatgcacatttcccccatgagagacagctttgcaagggccatttcaacatatgtcaaggaaatatattttgaggtaaaatactttgattccttcggggctactatgtgtcatgtgatgctataccggagtcccgttgaattgggtatcttattgctacagagagtctgttttgtcagtctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttgcccccactgcaagagtggagtaggttgaggtgtagccatgacattctggaaactacattttttgtaatagtcattttgaaaataaaacatttgaaaatactgtgcagcaaaaacttgaataattggaataaaaatgttcagtttaatgtcattgcttgctgccaccgttttctgattgtaaaactaacgtgattattaggtactattttggtaatgtagaaaactttaaagatgaaaatagatatcacttataactccacatggagaaatagttgcccctccaatttaattgatttacttttgggccacaggggcccagaatttgattcattgtactccttggttcatgccagtgttcctgcacccagcactgaagctgaacattgacagtgatttgcccctgccccagagtcctccctgcattcccctcgagggcccccgtctcctggccctggtgtccacttttctctcagctgctgggaacgtgttagtgtgcactgttctcctttccctcacctgctggcttcatgttagcatgcaccgttctgctcactttcttcccctcacctgccgggatcatcttagcatgcaccattctgctcactttcttcctctcacctgccaggatcatgtaagcgtgcaccgttctccacactttcttcctctcacctgccgggatcacgttagcatgcaccattctgcacacttccttcccctcatctgccagggtcatcttagcatgcaccattctgctcacttcaccttcttcttctcgcctgctgggatcatgttagtgtgcactgttctgcacactttcttcctctcccctgctgggatcatgttagtgtgcaccgttctgcacactttcttcctctcacctgctgggatcatcttagcatgcaccattctgctcactttcttcctgtcacctgctgggatcatgttggcgtgcaccattctgcacactttcttcctctcgcctgctgggatcatgttagcgtgcacagttctgcatacttgcttcccctcacctgccaggaacaggttagtgttccccattctgcacactttcttcctctcacctgccgggatcatgttagcgtacaccattctgcacactttcttcctctgtgtacgtgtgtgtggttttcctttcagaaatgggtcatactctgtggacatctttttccacttaaagtgatggcacagccattttcccagtcaagtaacatgaatgtacaagtttagcaaacttcctcctgagagatggagagatcaaggcttctgctccgtggcagccatccgtgcacatgcatcactgtgcgtgagttggtcccagtggcttgctgagacatgctctgcacaggggagatttcttataccagcagtgtgggaggcagtggggcaggtagagccacaagtggggatgagggagcagagtctagggcaggctcctggatggacaccagctacactgtctattggatgtgggacttccctcactgatgaaatgaataagagaatcttcctcatcctgctgttgttggcgttaaaacgggttaatgcatgaaagcaacaaagcccggcctgcagacagcacatggtaagtctcctcttcccagcatgttcaacaggaagccctcattccctctagaatgtaggagtcttgccagcagtggcctgtttgttctctgcctgttgccgacctgatgagaacataaaattggtgtcttctgtatagatttccttcttattgcccctactgtggctgaacataccttcccccgtgcttgaagtctgttcatatatgttctgctgtgataactgcccattcttgttctctatctaagaaggcatttagttttgaaaatattttgttggcttgtaagatatttgtacatattaagcacagcaaacctgtaacatattcactgtaaatcattattcctcatgcatcatttgccatttaactgtatttttttcctttttgatgtaacctgctatagtttacatttttaaatcagaaatgcctgcacattttaaaacgaagactcttatgctctagcctttgaggtcatgcttggaaagtcctttctcacacaaagattatttacactttcatctctttttctctgagtacgtttcagtgtttaattgaccaggaatgtatttcgaggtgtgatatgagacaaggatctgaaatgctttgcccactgaatcatcatgcactgaccgaaatgccacctgtatgagtgctaaaatcattgtcgctggacctgtgtctgcactgtttaattttagtgttgtttctcacatcagcttctgttgttttcatggttgtggttctcatacttttaatatctgttggagcaaataaagcctcgtttctcatcttttccaaaaatgtcttatgtatgtgaactttggtgttatttgtcaagtctgggcattctcccacccccatattaaagaatgctctctggagtttgtctggaggttttgtttaacttttagattcacatcaggagaatctttgtcttcatggtaagtggtcttcccatctaagactatttcttcaagctgtttgtaataaaaagctgtgtgatttttgtatgttta

SEQ ID NO: 2018 - DNA, 1138 bp, Homo sapiens
cccaagaagcaatgtaaagtttgaaacgagccgagcgcggtggctcacgcctgtaatcccagcactttgggaggccgaggctggcgaatcatttgagtagagacggggtttcaccgtgttagccgggatccatctcctgacttcgtgatccgcccgcttcggcctcccaaagtgctgagattacagacgtgagccaccgcgccctgcctatattaggtttttaaatagcaggaggcaaagcttttcggtgtgatcctgacttcacttggggaaaaagggcagacacagggtctcactgtgttggccaggctggagtgcggcagtctggaactcctgggcccaagtgatcctccaatcagcctcacaaagcactggaattacaggtagctcagagagctgcgctggaggagaaaagccagtcctggcaggagctctggtacctgggaagctggatggagagcctgggccagaatcccggacccctcacctctgcggcctagctttgtgaccttggcaaatccattctatgcacctccatttcctgtacagtggggatccttatttctctggcacagattggtatttgttctgtaaagcccagtaccactttattttattttagttattgatttttttgagacagggcctcactctgttgccaaggctggaatgcagtggcgagatcatagctcactgcagcctcaaactcctgggctcaggccatcctcctgcctcggcctcctgagtagctgggacgacaggcgtgcaccactgcgcctagctccagtaccatgtttaaacggtgctcagaaaacgtgctaaacttggtggatgggaattgaaaagagatttaatgttttaaaaatcaaagtcactcagctgcagtgccacatgggaaggaggcctggatgtgaatgttcctgggagctgagagctcctgtgactgtcgccagtttcctgtggtctcccacagactcaggacatctccctctgctccaggacacctcaggaccaccagagggcactcatcgcaccttcacccctggaagggagctggtcctggggccaaaacccactgtgcctgggaagcccttcctggcttctgctctcctcaatgtatgacagccctgatttaccc

SEQ ID NO: 2019 - DNA, 365 bp, Homo sapiens
aaactcgtgacgtccccgcgtgacctcaccgctgcggggcgatggagcgaaaagtgaggaaactgaagtcccgggagagacagtggcaaggtcaagtagcaaagtgcactcagccctcccagcaaggagtctgccactcgcgcttgaaggacgtgtttgaagagctgctttcccagtgggatgctgccttaaagtcttgattccctggcactctttcctattactacattttatcggtgctgtttgtgttatgcaacggtagcatcgtgtctccggaagataaaaaaggtctcgatacaaacatccataaccttccacccactccgtcaggaacaacccaatcaaaataaagtcatgagaattta

SEQ ID NO: 2020 - DNA, 1699 bp, Homo sapiens
ctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagagagtctcactctgtggtccaggctgaagtacagtggcatgatcccaggtcactgcaacccccacctcccgggttcaagtgatcctcctgcctcagcctcccgagtagctggtattacaggcgtgtgccacaaagcctggctaagttttgtatttttagtagagacggggtttcaccatgttggccaggttggtctcgaactcctgacctcaagtgatccactcactttggcctttcaacgtgctgggattacaggcgagagtcaccgcacccggacgactctgacatttttgaagagtccagaatcctgttacacctgggatttaggcactttcaatctgaaaaaatacatatcctttcagcactctggacggacttgagaactgtccttacgtgacctaaagctggagtattttgagattggagaattaagagccagtcttggtgctctgtgttcacctggttcatctgaggagctgcatctaccctgcccatgccatagatcctgccctgtttgcttctcctgttgctgctagtggacatgagaaggacagaataacgggctcccagattcacaagccccaccaagaggatcaccccaggaacgcttggaggctgaggagttcactgaggctactgcatcttgagactcaggatgaagacccagcttggggctgtcaaagaggcctgaagaggcagaacaccccagaggagcctggggccaccacccagcatcactgtgggaaaacggcagcaggaaatgtcctctcgcctgcgtgctccacctcggtccacgccttccctccttctggaagccttgcctgaccactggcctgccccttctatgggaatcactactgaccttgcagcttattatagacttatatgttttttgcatgtctgacacccatgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccacgtggcgtggccggcctcgtgtctattaaattctttttctacta

SEQ ID NO: 2021 - DNA, 568 bp, Homo sapiens
agcagacagttacagctcccactaggacactgccttctcagcggcttcagttatcagatattcctggacatactttccaagccatgaaaaataaccagagccacagctttcccagcactctgacaaacatccatgagcccccaaagaccgggaagtaatgatgatgcagctgcggcaccatagaagaaacaagtgatttcagtcaaagggcctggactcacgagctagcaactttggacagattcttgaactctcagcctcagtttctgcttctgtaaagggagataactacagtgaccttcaggttatcttgaagatgccaatgagctagtgaaaatgcaatttaatctgtacagaactaaacaaatgtaagtcagtgctaatattctgttcctagtggggacatgccaagtctctttactgcaaccagtggttcacatatggaaatattgtgctaatttccaactcctacttatatatatgatttgttaactctggaggatgcagccatcagcataagcaaccaacagaagaacacgctggatcctctccttttcctgacagtgtg

SEQ ID NO: 2022 - DNA, 1114 bp, Homo sapiens
catctgcgtcagcctcccaaagtgctgggattacaggtgtgagccaccacacccagacattcatctttatttttaaaggacatttttactgaacataaaattctctgagttggcagttttttctttcagcaatcttaagatgtttatgccttctggcttcaacagttggagcaagaagattgctgtaattcttatcttggttcctctggatatttttaaggttttctttctatcagcaatttgattacgatgtgcctcataaggatttatttgtgtttatcctgcttggggtttattgagctttgtggacttgtacatttatagttgtcactacagttggaaatttttaagccattatttctttaaatacgtttctatctcaagaagtacagttatctccaaatgagcgtcatctacatgtccacaactctgatcagaccactcttagagccagtaatgattattttaatacctaccatactttgtgtatatttactcctcagtaaatatttgtagagctgcacatagggaatttctttaacacctttaaagtttatttatttaaataagaaatacatgcccatggtaaatatttcaaatagtacaaaaatatttcaaatagtacaaaaaaggaggtattctgtgaaaagtaagtctttgtttcaccaaagataccaatccctgccccctccccgtcctaaggccatcactgttagcatttccttttttctcctcccaaaattgtctgtgcatgttcaagtatatatggatatatatccttgtgctagcatactatatacactgttctgcatctttttaaagtttaataatcttggcgatcattctatatcagtacatataaagtgggctttttatgaatggcctaacattacatcatacagatgtatcataatttaattaagtggtgccctgttggtggatattcaagtcgtctggtcttttgctattgcaaataatgttgcagtaaagtaaaatgtaaaataaaagtaaatgtcttacttacttaaaaacctattttaaaagtaaatgatggactttaggaggttaagaattaaaaattaataaacatataaataaatgaggtactctagca

SEQ ID NO: 2023 - DNA, 527 bp, Homo sapiens
acaaccacgtgtcccctcatgggtgctaccagagtccctccccagcctgagactcctgaagccccagactcagggattttctttccactaagctctgatgaggaaactgaggctgggagaggcagccacacagctagagtgaatggtgaactggactaggaacatgggtgggcgtgtttcccacactgccccacagtgacacagcgggggcggggacagcccttaaaatccgatcctccgcgaacaccttgaatcctcaaacctccatccatccaaaaggggctccgccttggggaggcccttcgcacacttctctacaatttgaggggccgtcggctgcaataaccacatagtggggccactacaagtcaacagaagcagaccctctctccaaaaacacagcagaccctgtctccaacacagactaggcctagttccgacttccagaatgccgtggtccagccctggcattgctgactcatggggtcaggctggcgttgctcctctgtggggctggaggggcccca

SEQ ID NO: 2024 - DNA, 638 bp, Homo sapiens
cggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctga

SEQ ID NO: 2025 - DNA, 746 bp, Homo sapiens
cgtatcaggaacaacaccaaatcagaggtgacttgtgccccatcagagactttaacaccccaaccagatgggaatttcaggacccaagaaatagaaagtggctgcagggttacaactactgttggattcctgaggtagcacagtgtccaaacaggatttcagcactacccgtattgcttagagccccagccaaagatgtgaggttttgccctttggagaatctgtgcccctgaactcgggggcctctttccacatcttgggggcaggcaagggcagagggtgtgcctaggcctgcggatcagcatgcgacagattccccaacatccttccagcttgaaaggggattgccctgcttctatttagaacctataggaaagcagaagttctagattgaagttaaaattgattcccagcctccaggggctttgggctacacctggatgaccttaattgaccctaagcatgggacaaaccacttcctgagagtattaggatggtatacatcttctctgggggcaaagcaacaagatttatttttcatcatggaccaaacacatggatacccactagaaactgtgtagtgaattttgttaaccctgacatagggaccatggtctttaggttaaagcataataacaacataatacataacatatatagcgaatatatatatgtattatatgcaatgaatgtaaatatgattatacccatcatggtcttggaggaaacagatgacacacttaaaa

SEQ ID NO: 2026 - DNA, 1433 bp, Homo sapiens
tttagacggagtctggctctgtcgcccaggctggagtgcaatggcgcgatctcggctcactgcaagctccgcctcccgggttcatgccattctccttcctcagcctcccgagtagctgggattacaggcgcctgccaccatgcccagctaatttttgtatttttagtagagacggggtttcaccatgttggccaggctggtctcaaactcctgacctcaggtgatctgcctgccctcggactcccaaagtgctgggattacaggcgtgagccaccgagcctggcctaaaacttctttcaatggcactgacctttctgtgttgtcactcagtcataataaaatcccaggtacaatcagaatgctgcattctccagccataaagatcgctccctcttttcaaacatccctgtccctcaaggcctagctcaagacggtcaccttaagaaaagctccctttgtcgagcagtgactccataccaggccctgctttaaacgctttatctgcattatcttacttgattctcgcaatagccctgggtggtaggtgcaattattatctccagtttataaaagaagatactgagggtcagagaagttaagtgactggctcaaggtgtcacattcagtaagcgttgaaggggtctgtgttggtctgtccttgaagatgccccctacgactacactttcaatgatttctgccttgaacctggccccatgactaaaaacctcacgtcaaactcaggcagcaataacgggaaggcttggtgcctcccatcactggagcaactagtctagctggtcactaagtggacagcccctctgtttccctgcagtaactaattagcagaatagcacaaagataaaacccgaaggcctttgtgcagaagtttcagagacataagcaaagtgagagcattaggttctgcatatctttcttgttgttgttgttgagacagagtctcgctctgttgcccaggctggagtgcagtggcacgatcttggctcactgcaacctccgcctcccggcttcaagtgattattctgcctcagcttcccaagtaactgggactacaggcgtgcgccaccactcctggctaatttttgtatttttagtagagacagggtttcaccatataggccaggctggtctcaaagtcctcaactcgtgatccacccgccttagcctcacaaagtgctgggattacaggtgtgagccactgcacccagtcacatgtcgtattttaaaagggatttaaaagtatcattggattgtttgtaacacgaaggataaatgcttgaggggatggatacccattctccagcatgtcatgattacacattgcatgcctgtatcaaaacacctcatgtaccccataaatatatacacctactatgtaccacaaaaattaaaataaatggtgggtgagaagaaa

SEQ ID NO: 2027 - DNA, 347 bp, Homo sapiens
tgggttgcttcactggttttgcttcttagctctccagttacgtgttacaaattccctaattaatttcctctgcttaaaatacctagagaggagaggtttctgcttcctggctgggtcttgattgattcactgatcacaggtatggagtaagacttggacagtcagagcataggttgtcaactgttccagatattaaccaaggtcaagtgaagcactctcctctccaagaaatttcagcatggagagaaagaaagttttaccaccaatttgtgcctgaaacacaagatgaacagacgtcttctgcattaaaaaaggacataggcatgcattaaatcccttatgtctta

SEQ ID NO: 2028 - DNA, 847 bp, Homo sapiens
tgcagtgagctgagatcttgccattgcactccagcctgggcaacagagtgagactctgtctcaaaaaaagagaaatacatttaaccaaagagatgcaatacgtatacattgacaattttaaaatactgctcaaagaaataacaaaagacctaaatgaggaaaaagtcatcccagtatcataaatcaaaaggcttaaaattagttatctccctctagggaacctagactaatacactcaccccgtctccttgttcggaggctctcctgcctatcagctgttctcctctgtgctttccatgtccctgtggttctctggtgagccccatcatgctgtcctagaagatccacttagaatttcggtatttactcaccattttgactcctcttaacgagacaggcacatgccagctgtttccattcatccaacctgaacctgagcccccgatcattttttctaccacttttcagtcctgggaaactcagtcccaatgtgcttgtcattcatttgagaataattttcattttctccagtagttttaaaattactttgtatctattctagatatcgtttgctctatcatagttaagacattaatgttatttatgaatttgtgcacattaaactcatgatctttcatttctgtaaaaatgtcaactatttcctttgcaagtatttattgactaacatactccttatttccttcattctgaaagtgtgacacatagagatatatctgtttcctcttctcactctattctttgtgtgcattaattatcttttctatttttttcatttctagtttttctccgatgactaatgaaaaatttaataaatattctacaccaa

SEQ ID NO: 2029 - DNA, 640 bp, Homo sapiens
ggagggtcttccaacggcggcgaccttcgcctggacagcggtatcctgcgggcgaccatgggccgaacggccgggactccaagcttacctcggacacgaacgccgcgccagtctccaagccaagctatacaagaagaagcatggcaccagcatctgcttctggtgagcagctcaggctgcttccattcctggtggaagggaaaggggagctgacttgtgcagagatcacttccaagagggaaatcaagagagagaggtaggaggtgccaggctctttttaacgtccagttatcttgggagctaatagagtaagaactcactgatacctactacccccatcctccatctcttcgtgaagagtctgcccccatgatccatacacctcccattaggccccccctttaacactgaggatcacatttcaacctgagatttggaggggccaaacaaaccatatccaaactatagaagtggcaaattgacaacatctacttattcgttcaaaagaaatagggtgaaaacatgagatgatccatggatgtttcagcttttctgtgactgaccctgcatactgaaaagcaataaattccttgctaacttaaataaagtaatggcagatatgcctaaggccacaaatcta

SEQ ID NO: 2030 - DNA, 2941 bp, Homo sapiens
aggaaggaaggaaggaaggaagctaagcaatataaccctgtggcaacatttgtaaaagtgactctgagaagacagaaagatcctctatgagagactggtgtccccaggaattggcgaggcctgctgaggatcatttgggtaaatgtcatggtcacgcggccccattctcttcgctgagctccggatttccgtagccaattgtctgctggacattcctccctgatacatctcacagaggctgtggacaggagcaccgagagccacttcctggagcatgctccccacccccgcagcctgtggcttcagcctctgcttctgcagacagcggtggaggaagtcaggactgtcccttctgacctgaacacctacctccaagtcctccctgtcgccacagagacccggcaatgcaagtgagtcctgtttgacctcgtcaatcatcgcagactgtaaaggtgactcggatgctcaagaaacgagcatacccagcagtgggccccagacttctcgcaggcccaggtcctcctgggtgcacagagacctaccagacaacggtccggctgcactggtgttgtgagatgcctgtgtcagaagacactgagttcctcactcgcctcctatcatgccgatgatcacaggagaaagagcagggcacatgcatgccagcatgctgaagggaggccaaaacccatgcttgaaaaccacaggtcctgttctaggagcaggagatatatttagccaagcaggatgtttgtgggtaaaccaacattttgctgtaaataaaattctgcaaactcgggactttgagaattgcagaagcttactttgcctgcgtattggcaagagagctattttcctaacacaagctcaccatgaccctcattcagagatgcgcttgacgccgagggtggtgccttttcgctaaggggtgctgtcaggggattgagtaggagcctgaagagctaggagtatcttctccctgggcagaccagcaggcagaccctgtcccttcacactacagtggcacgtgatgggccccactgcccacctggttctggtgtccaggctgaagtcctcgtgtgacactccaaactgttctggcaaggaaggctcacgggttctgacctacactctgaaactgaccagtagtgataaactccgcatggacttcagccatcattgcgtacgtaagaaatacgtgttgcacacagagtgcttctctacattcccaggtttgccactccccgacttttgctgaagcaggtttctactccatcagtcccacagatgtgttcacagggccagcactgagtgtggtgctggggaaggcatgtgcttggaggcagccctgtgagatggcacagcctaggggaggagtcgtggtggggaagaccctggccacgcatgatagaggaagcgtggccacacagtctttgctgtccctgccacagcatggtgctgtaagtctcctccttccgagtctgtgcagacttatgtgacacatttgacccaacagaaatgcagcatttgtggtgtgtgaaagttccagaccaggccacagcgagctccgtggcttcggctgtgtctcctggagcacttgctctcaggaccccctctctcagagcccaggcaccacgccgtgagagagccccagccacagagacaggctacgtgtaggtgctttcatcaaagtgccacctgtgcctccccgcagcagtgtcaggccaccagcttggacaggcagctccagcctccagtggaggcttcagaggacagcatcaaacagcatccacaaaggagacccaccttgtgaaaagcgcctagccaagccctgcccaaatccctggcctgtgcaattgtgagcaaagcaattcaatttggagtggttttatgctgcagtaggtgaccaaagcactatggaagtgaatatcaggagcccctcactgggatgtcagaagacattcaaggaaggtttcctggaagatttagtacctcaggtggtacaggagaaggtgagatggagagaaagcaaccccagtctgaagacgcagtggtaagaaagggtcattcccctgggcatgtgtggtctgctgggggatgacagccgaggtgaacttgaagcagaggacactcagacaagctgcactctgaatcccgctacgctgaccgcagcacttgctgaagaagccgcctcgccacgcccaagccctgcagagggaaggactgaggaaggcagctcagaggcctcaggcagccacagtgtgcatgcttgtctatgactcacagctacgacgtggcctgtgctgctgcagctgctgataagcctcaaacctcatataccactctcttccgaggattttttaaatacacaaaactgggagtgagaggggtatttaattcccctactaacacatgttgggcgcagctggagcagccaggcccactgtagctgggaagatgcggtgccttgaggtgcaggcactgctcactgccacatgtgagcacaggttctgagggtgaaaggtccctggtatctggccagagtgttagactctggaacataagaagcccccgaggtggtggagaaggtctagccaggctccagactggcttcacagaggtaatgctttttggtttgaaatccgtaagagcgcactacaacttcagggcaagctccaacagtgcttctcaaactttaatgagcacccaaatcatcagggggcgcgggggcagtgggtcgcttactaaaatgaagattctgcatcaggaggtctggggcggtgacacgattctgtgtttctaacacgttcctgggtgaggctgaagccactagtccatgaagcacactttgagtagcaagaatgtggaggaactgtcccaggatgggccatgatttacctgaattctcacagtggcttagacaatggagaccttgtccacaact

SEQ ID NO: 2031 - DNA, 571 bp, Homo sapiens
aatgcatttttggagatccacaccaatttattctgtactcagcctatagaatgtaaaataagatcttaaatatagccaggaaaaagccaaacttcctcagagaaatgaatattctattgattccaagggcagaaatggttcatcatataaggatcaatgatcataatgagctgtgaaggtcaaacttggccaaccatagcgggatgtgcattaaaaagatcagaatgctttgacgcagcgtggagtcagagaaagtgcttggaactggaaatcaagatacatgagtcatcgttccagttatgcctcttcctatttggccttgagcaagtcacttccctgcatgagcctttcttcctttgctctgtgaaatgagggcactagagaaggtggtcccttatgtaccagtgtgggctaaaggtctactggtacttataataggaaaaagaaagaaggcagagatcctgttctgacatttaagaatgaacaagaagcccagaagtttcccagaatgggaaagagaaatttgattaaagacaggatgcatcattgaaggcaaagtaactgtgcctct

SEQ ID NO: 2032 - DNA, 639 bp, Homo sapiens
aattttttttttctcagttgtcaccacagtcggcctcacttcaacaacagcaggcagtgttggctggtgtctctgatgaggaaagtgaagcctagaaataaggaattcacttcaaaggcaccttgtacgaatttcatacttgaaatccagtttggctgaaataaaagcctgtgatttttttcataacaactaagtataatggataaaatttggttaattaaagatttttttaggccaggcgtggtggctcacttctgtaatcccaacactttgggaggccaagtgatctgcccacctcggccctgcaaagtgctgggattacaggcatgagccatcatgcccagtcttcaatcatctctttaaagaccctagttccaaataaagttacattctcatttaccaggggctaggacttcaacatatgaatttgggggaggcacacttcagcccatgacagacacaactggatattagatgatgttatggaattcttggtacttttttcaggtatcataatggcttgtggttctgtaggaagatgtcatggggggatgcatgatgaaatatgttgggatgaggagtgatagagaattgcacattaatttcaaaggttccataccagcagaagtgtttgtgggg

SEQ ID NO: 2033 - DNA, 2475 bp, Homo sapiens
gtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtgagtggtattcagttaagagaacaattatttcgtataagccacatcagagacgactgaagatgaaaaaactaccatccccgtatataactaatttgtgctgtgcaccaacaagaacctgctttaaatttccatggcaatttacaacccccatactgtaccaggcaaggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgcttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 2034 - DNA, 451 bp, Homo sapiens
atctcaggccacacaggattccattcatcgaacattcctgagacaacggaattctggcgatggagcacaggatgcttcacagtctacggcaaaggacagaacgttggttgctcgagagcccgtcttaagtctcctatgagcttcaagccaacacaacagagggcaaactccaggctacctgatccctcagcaaagatgcagatggacacagcgttctggccccacgcatctgaagttcgtcttaagatgtgtgaaagcctcagcgcatgagccaattctgtgcagtgctcgacatacagatgagaacactgaggcacgaggcacagcctgtgatctggccaccgcgctcaggaggaggtggttacccgcgggcctgagggcgctgactttttagaatgggcgagtgcagctgtgtcccagtgtcccagtgaccagaacgattactgccttt

SEQ ID NO: 2035 - DNA, 8636 bp, Homo sapiens
caaatgccattgaaaccgctagtcttatttcctttctacttttctttggcactcttactgcctgtaaggagtagaactgttagggcacactgttgctatacagtttaactcccattttcatgttttgtctttcttttcccatttctggggcttacctcctgatacctgcttactttctggaagtagtgggcaagtaagatttggctcttggtttctaatttttaaatttctgaatactgccctagtctgaacttggcctttatagattaatctttgcttcacatttttagtgttgtatttaaactattttataatttaaaaatagattctaatctgaagatacttttcaagaaatattattaactgatgtcatcctcatcccagcagctcatctgttaggaatgaagttgagatgcttctattccatgtttttgtatttgggaaggattcaaagttgaaggtttattgtcgttgggtttttcagatggtgacatgtaaactcaggatagcaaaccctaatgttcacacagtgctctgcctctgcatctcagttgggatagttgctccttttgagtgttttaatcatcgtataactaatcatagtgccaagaagttcataatgtgttatgtagctaatgtcactgaaaaacagtcctaccattttaggtaagaccaaacagagtctctaacccaaggacttgttacacctgacaacctatagtatatttgctttttctcacaaaatgaaaccaattttgccgaaagctagctgggataataggatcatcacaagttgcagtttctataactaaaattagattgaaatctcttctgacctagaacattttacttcaggcattcagcagatttcagaaagaattaccttattttaagttagtttctttgttagtttactgtgtgtctcttattcaataaacaagcagaatttgtgtcctgccctatccatgtcttaaagatgagaagttggatccactgagttagtttcattggggcgggggaaagaactgtaattaaacttgtttaatccttattttgtattgtagctattttttgtaaaagcaacttaaaatcttttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccactatagtggttctttatttaaggaataactcagctgggtgcagtggctcacgcctgttatcccagcactttgagaggctgaggcaagcagatcacttgaggccaggagttcgagagtctggccaacatggtggaaacccatctctacaaaaaatacaaaaattagccaggtgtggtggcgtgcacctatggtcccagctatttgggaggctgaggcaggagaattgcttgaacctgggaggtggaggttgcagtgagccaagattgtgccgctgcactccagcctgggtgacagagtgagactctgtctcaaaaaaaaaaaaaaaaggaactcatacagctcaatgattcattgatcccaataataaatcgttttaataatgatgaaaacatcctactggggttttcttgttaaaaactttaggacaggcgcagtggctcatgcctgttattccaacacatttgggaggctgaggtgggagaattgcttgaccctaggagttctagacttgcctgggccacatagtaagaccctgtcccagctccctccaacatcgtccccaacccccccccccccaaaaaaaaaaagcgccaggcgcagtagtgagtgcctgtgatcccagctgtgttgggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagcttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 2036 - DNA, 666 bp, Homo sapiens
attgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagcggccaggacagggagcagaaggtgactgctgtgctgcctggagctcttctgtccggaggtttagtgaaactagagaaactcagtg

SEQ ID NO: 2037 - DNA, 446 bp, Homo sapiens
ctaagatagtatgagaaagttctgatcttgacagttcacgtaacattcaatcaattataccattgctctatctctaaagttttctttttctccttttctcagtgtcttaccaagaatgaaaggcaacctatgtaaaaactatgggctttctagtataaataaaaactactcatctccagaaaataaacaatgactgctaagatgattgaaaaaagaaaggagaagaaagtagcttgtaaaagcgtgtgaaatgcattcacgttggaatctcctacaggcacttcaggtcttcagactgtaaacattttaagtgtgattgctgtgaatgaaggaaacccagagccatcatgacaagcctaaactcaaaggggactgatttcttctacactgaatgtttcattagtgacagggcccagataataaagaattgtgctcacttcctgtga

SEQ ID NO: 2038 - DNA, 400 bp, Homo sapiens
gcagcccccgcgctccccaataaaggatgcacccaccgagcccgaggactgaaacattgtttaggggaccccaggcactgaagggcgggttcctggagatggacatttggagtgcggtgccaggggcttgggaggattcccgcgtatacgtggtgtgaaagtcagtctttgaatgtagagcagatcaatgtggaatgaggactgaaaggtctgtcaactgaaaaaaaaaacaagaatgaatataaaaaatcacaaattaaataaaccatggtccatccatattaatagacattactcagtgattatacaatataagcttatgggagcaagggagttcctgaatatccttgctgactgtgccgaaatgcaagacctacctaccctctaactctgagccact

SEQ ID NO: 2039 - DNA, 504 bp, Homo sapiens
cacactcaaatcagaaacctgcatccttcccacagagacagcccctgccctttgcattctcaccctgcccccctgccaccagtctgtcccttctagaatatgccatgatcgactcgtatggtcgtggcatttcgaggtgggcattttctgtgagcgtggtgccgagaccccatccagctgtccatgtgttcacagtttgtgccttcctagcccacggttgggttttaccagagtgtgttcgaccagcactcagtagagtacactggggctatttctatctgttgctgttgtgaacaaggttgccaggaatattcctgtgcgagatgtgggtacaagccttttcatgtctaccactgagtcccgtgtgccgtttcgtgagaggctgaggcaccgcttcattccaccgctgagccccgcgtgccgtttcgtgagaggctgaggcaccgctgagccgcgcgtgccgtttttaacttgattataaaatacatttaaagttcacatgca

SEQ ID NO: 2040 - DNA, 509 bp, Homo sapiens
agcaaagcccctggcttgacctggctcccttctgggagggaggaccacgtctcaatttgacagcaggaggctgtaggtcagtggggtgatgacctggccctgggagacctgctctttctctcagcagaaccccataaatccttcaaaaggaaggcatgctacccatcaagctaagaggccagaagaagatctttttataatgtaactcaaaggaggggagaaaagagccagagacccttttagcataatggagcagatgatttttactaaggcgtgcactctcaccagggaaatggcttgattgctgtgtaaatagatgcttgaccttcatcctgccattcatccatatggaccctaaacgctctccagctctatcctaggggacatggaatggaggttttccaaagacattggaacacccctgtagccatagtagctcttttttaaagaggagaggaatctgtagattctttcacatgagggtgggtgagtaaaagttaagcaaacaa

SEQ ID NO: 2041 - DNA, 2049 bp, Homo sapiens
ttctcaatgagcaagagaagatgagggaaggtgctagaagccaggcccaggaaggttcctcaggttaattctcacgtagcaggctgcggatcctcagcaggtttttctcctgtgccgacagcttccttgggtctggatagacagacaactcatcactggctgttcccgcagactggctccgggcctggcccaattgcttctcaagctcttgaacctgaggatggtgtgaagatgaagacataggaagatgaaggggtttgcccaaggtcagagttggcagaccggtggccaaacgtaaactcaggtctcttgaaccccaaggccatgcactatcatctattagcttcttggagtttttccccctttatattggcttcaaggatcccatgggagacactgaagataaaagccactgtgaccctcgaagtccctgggaacaagggtgatatgcttggcaaatggtggaagtcatacaccttctcacatgtttctcagtttgaagggacaaagggaaaagaaccacacctaacttttatacagtgcttcctccatgccaggccctgtgctgagcattttacaagtattgactcaattctcccaacaatcctgtggggtaggcatcgttattatccccattatacagatgaggaaactgaggcacagagctaaaggaacttgcttaaggtcacacagctggtgagtggagagctgggatttgaatctgagcagtgtggctccagagcccctgctgttagctgcttttggtatgctccaaaatattcagacaataaagagggagacaaggctaaatttttattgggtaattaaactttcaaaagactacaagcatctggacaaaactggaaaaagcttacaattacaacagtcacgcaaatctacataaactaagaaaaaaaaaagatgcctggagtaaaataaatcaaaccaaaggcgttggcatttgttaagctccagtgcctggcatgtgctaagtgttatataagagcttgttcattaaataacaaattaaaatcaggctggttggcgagaaggtaaaacaacaaccccgcacgagtgcactgtgagacctaaaggccttttttgggtactgtgtgcttaggtctctaagggggtcagggcagctctttctggggtgttttaaatcctttgttcaggccaggagaagtctgatgactcactcaccttgctctgcaaaacaagaatttgttgagcccgacccctccaggtccctggcgaagataggagctgctgaacgttgatgtcttccccaacctctctggccaaaacctgaaataaggcagggccttcaatgtggccaaaagagagggctccaccagaccctgatgctgctacgtatttagaagcatattcagaagcagtcttcacctacacgatcttcttcccatctcagagcatagccctcaaaggtcagttttccatgtcccaagggcagctctccctgggaaagtagtaaacccatcatccctggcatttcttggcaatgcttagagcagccaagaaactgccagcaatgcccagatagggccccttgctcttgacatattctgggatgactgaaccacaaagctgaccaactcctgcttccttaacccactcacctgtcacctagtgctgagctaattctggctataggaagtacatcaccacaggaccctagcctttgtgaaaacccacggacaagtggacctctgagtgcagcaaaaggtgggctactgaatgtcagttggggtgctgtggtccaagaaggacccagctttgcggttgttgaagtgcagcactcaggcccaacctcaaggctttgaggcagaaacaatacgctccagcttgtgacctgggcccctctgaagcctgtcacagaaacccgatccagcgtaccaagtctctggcacttgtttccacaatagaacactgttttggaaatcttggccagtctgagtggttccagcagggaagacaaatgccagagaattcgctatgtaaataaaaataaataacgaaccagctggg

SEQ ID NO: 2042 - DNA, 2010 bp, Homo sapiens
aagggggctgggcgggtggcgccgccgcttgggcgccgggagggtggcagcacgcgtgggcgcggcgagggctgccttctccctcgccctcccgcccccaggagtccggctccccgacggcagagcggcggggaaagggtggggggagggagctggaggaaaagaaggggtcggccgagtctcttaccttgctctccgctgggagttgggcgggctgggtggcccggggaggggaaaagggtcgggggagggggtggggaaaggggggagcccttgcgaggtgtagcttccgagcagctcccgccgccgccacagccggcgcctcctttccgattcactcaaacaaacaagatggctgccgttacgccgcggctcttcctgccgcccaaatcctcggttcaaatcggcaggatgtttacggtcaaaatggtacctgtgcgcctgcgcagccagcccaagcccccccctccccccagaaggagcggcgcaggcgcaatgactatttccttttctttggaacccgccctctgtttgtggagtccacaactgagcaagcgcaaagagatctttccagtgatgaaagaaattgaagaggacacacaaaaatggaaatatattccatgttcatggattggaagaatcaatattgttaaaatttccatactacccagagcaatctacagattcaatgtaatccctatcaaaatatcaatgacattcttcacagaaagaggaaaaaaatcctaaaatttatatggaaccacaataagaccaagaatagccaaagcaatcctgagcaaaagaataaagctggaggcatcacattacctgacttcaaattatactacaaagtgatagtaaacaaaacagcatggtgctggcataaaaacagacacatagactaacggaacagaatagaggacctataaataaatcaatacatatacagtcaactaatttctgacaaagctgccaagaacatacgttgggaaaaggatggtctcttccaaaaattgttctggaaaaactagataactatatgtagaagaatgaaacagatcactatcttttgccatattaaaaaaatcaaaacaaaatggcttgaagactggaatctaagatttgaaactattgaaactactagaagaaaacgttagggaaatgctccagaaccaaatatttcttagtaagaccttaaaagcataggcaagcaaagcaaaaatggacaaatgggatcatgccaagctaagaaccttctgcaaagcaaacaacaaagtgaagagacaacccatcaagtgggggaaaatacttgcaaactactcatctatcacagaattaatagccataatatataaggagctcaaacaatataataggaaaataatccaattaaaattgagcaaaagacctgaatggttatttctcaaaaaagacatacaaatggccaacagggatatgaaaaaatgcttaacatcactaatcatcagagaaatgcatatcaaaactaggatgaggtataatctcatcccagttgaaatggcttttatccaaaatacaggcaataatgaatgctgataaagatgtggagaaagagaaacactcgtacactgttggtaggaatgtatgttagtacagcactgtgaagaacagtatagagattccttaaaaacctaaatatagagccaccatatgagccagcaatcccactcctgagtaaatacccccccccaaaaaaaaaggaaatcagtacatcagagtggtatctgccctctcacatttattgcagcaagattcacaattgtcaagatatggtatcaacgtaagtgtccatcagtggatagatgggtaaagaaaatgtggtacacatacacaagataatatttttcagccataaaaaagaaaaaaagtcctttcatttgctgcaacatggatagaactggaagacattaagtgaaataaaccaggcacagaaagacattagtgtgaatgttcacactaatatgtgggagc

SEQ ID NO: 2043 - DNA, 559 bp, Homo sapiens
attcgttcaacaagcgctttggacctgacgctgttagacgccgagaccccagagaagagacgcagttactcatctcaagggcagggtctgggtctttatcgtactgcaggctccacccagaatgggcaccgatgtgtgtagtgaccactaacaaaaatggctcagtgggaggagcgggggcaccacgggacaggcggtctggaaaattccctaaggtgatctctgccttggatgggccctccacggccagtgacagaccccctgtaggtggaggtgtggccaagatcagaggtcctgccctcacccctgcccctggcaccactggctcctctgtggcctgcagcaggtgagagggaacagtcagtgactggggaaggcccaggagtttgacccatgctatgactgaagctggagagtgaggaaagaacaaggtagttaatcatgaaaccagcgtggcaggagaggtgcgtcagctgcaagagaaggagtgctgtgcccaagtggggttccatctgcccagcctaactcttgcctgctccccaagaggcccccagaccat

SEQ ID NO: 2044 - DNA, 371 bp, Homo sapiens
aagactttgggtatgctcacaacattcaagggcttaaatgattagttatgcctagcatggatatgggagggggaattggatgatcagttatgtctgacagcagcatgaaaagggagaatggcaacacgcttactgcactgcatttactgtttctgagctggatagctttgaagagatctttgaaggctaactttatgcagttctgcaaaaatcaacttctccatatttttcaaaagagcttgccacagagacagagctgggagactgctggaccaccataaaccaattgaaagatcatctcttgaaattcaatcctaaatgccattgctggaactcagtagcttctcaataaaagatacacactgaataaa

SEQ ID NO: 2045 - DNA, 1791 bp, Homo sapiens
agaccaatttgtcacccaatatgtgggtgtctaatactaagtaatttaaccaacttttgaagccccgcttatccacaaaaatgtttttcagcaaaactttgtttcctgttaagctattaatacgggtcatcttttagctttgtaattgaaaaaaaaaaagtttagatagtagtttaccttaaaagcccattcgaactgacataggaagatgaaagagactgacttgtccaaattgtcaggtccacctctgcatcacagtggatgtcaggatgtaaattttcagtttttctcttacatctagaaagtaaatatattgctgagagggaaattgtttgcatcaaaccagataaggaaggagggctaggcaaatttagttctcatttagcaaaacttcctgatttgttttgttacttaaatggtgacatcagtgtttggtcatggtagacacttaggtgatgatagccaaaacatccatcgattttactaaaatcactgccattaagagagttttttgtctcttcatgttcaatgtttgaaaggtattcagtaatctatttcagaagcaaatcaattagggaatggtgtttattaaaatacggtacagttgccaggactttaaaagatggtactggtttctaacaacttacgagtatatagggtatttaaaagatgggagagattgaagaaagacaaaggtttaaaggtcatagccttcgagcataagaggcatatgaatggtgtcttggccttaactcccaattatacgaacttctgttttagctgaataggccagtgcctcgtgccttgatatttcggcaaatctattagtggttccttaagcatagggaactttgtactttatgctctgtcgccataataatgtatttatagaattaaacattctcaaattagggtcttgttaaactgactttttctttcagaaagtagctacttaaattctgttacagctacaaaagatccatcaagtgctgactgcttaaactgaagaaggtgtccagggccttaattctgcaaacatttcctgttgttagaaagtatgatgcttgaacagcgatctcagtgtattttatgttttaaagggggtaacgtttggtgtgtttaagagagctgatgtgttttggatgagactaaagttgatccttggttttacattaagatgaacctgggtccatgtgtctgcttaaagaatgtaaattggcatacttgataggaggataaagctttgtaggaattagaaaagatcattctcttttttgttgcagaagcagtatagtatagtagttagagcatgggccctggagccaggctgcttggtgtcttcctttatttatttatttatttaattataaaaagtaaatataaagtgagctatgttgaccaggttcgtcttgaactcctggcctcaagcaatcctcctgcctcagcctcccaaagtgctgggattacaggcatgagccaccacaacctggcctgcttgggtttttctatcttggctctgccacctagctgtgggtccttggacaagttacttcatctctctgtgcctcaggtttttcaaatgtaaaattgggataattggatctgtctcatagggttgtgaaaattaatgagttaatgctcttagaagagtacctcatatgtaataagcacgcaactgttaattattgttaatgtagaagttaattctgtgtataaatcagatacactgtggtcaaagatttgtgtgtatttgtaagaaaagaggagaatggagaatctatttttaagtgg

SEQ ID NO: 2046 - DNA, 1679 bp, Homo sapiens
atttcttttagtcatgttgatttgatttcagtttctggctatgaaaaacatttttaaactcgtcacccacaacaaactgaacaaaactactacagtgaaagcccttttcagtgaaagatgtcagaaacctcaaaacctttggcctgactcagaactaccatgtgaaaatcagtactctcttaatgtttgaaataaaaactgaaaaaaaaaacaaaaaaacaaaaaaccttttttgaagcaccttaacgtggccatccatttgagaagtgggtgccacttttttctttgagcaccttattgatgtgtttgctatctgctgtctttctgttacctgttggctgaatggctagctgttaacatatacatgtgcacagaagagatatctgggcatgtatgttctcaatgaagtttactgtggtgactgctgaaaggtgaacccatttcctgattttcccgccgcagtgttgtgataagattcgaagaaacctttttccctgcacagaaatgtttcttatcacattgtatcttagtatggaaaggaatatggtcccttttttgcaattgctactgtgtacacacacacacacacacacacacacacacacacacactgtatgtttagacctaaaatacacacacccacgcacacactgtatgtttatgtgacctaaaacatacacacatgcacacacacatacatatccattcattcattcattcaagtggtgtttccagtgtctgtgtgtcactgtttatgcagtttccatttcccagtgaattatgagtggagggcaacttttctaaccagattgtcttttcagaacaaagacctgggaattgaggaagagtttggaaagagggagaggcaaggaaagagagctttaaattgaaaggttaatttcctaagaggaacctgggctgaatgactgcagtgttataccctccaatctttgcaggtgggcatggaacactgcttgtatcactctgtgcacggtataaatccatatatccacaaaaacacacatccatccatcaacatatacatggtttgggatgagcaggtcaatagttttgagagggagtttgttcctttttttttctcattatactcttaaattgttgtcagttatcaaacaaacaaacagaaaaattgtttggaaaaaccttgcatacgccttttctatcaagtgctttaaaatatagactaaatacacacatcctgccagttttttcttacagtgacagtatccttacctgccatttaatattagcctcgtatttttctcacgtatatttacctgtgacttgtatttgttatttaaacaggaaaaaaaacattcaaaaaaagaaaaattaactgtagcgcttcattatactattatattattattattattgtgacattttggaatactgtgaagttttatctcttgcatatactttatacggaagtattacgccttaaaaatacgaaaataaattttacaaggtttctgttttgtgtggaagagtaattgatgttgctaagaatgatgtttgtttttttggggtttttgttgttttttttttaaatgttaccagcactttttttgtaagtttcactttccgaggtattgtacaagttcacactgtttgtgaagtttgaatatgaaggaataattaaaaaaaaaaaaactctt

SEQ ID NO: 2047 - DNA, 329 bp, Homo sapiens
ggccttgggactggcgctggagcccagcgtgggatgaccgtgccccgaaaacatgccagtgaatggaaagaagccaaggtcccctccctccctgcttataccctcaactttgccaatgaggaccctaaataccagctgcactacaggggatgtaactacatacaccgtcaccaaagttgcagcctggccaagaaatgccaggggacgtcgcggcgattgcagactccgcggtgactgtgtagatacgtccagaattcgcccttgtagcgcggggagaggcgagagtgaaggcctagaaaaaaagaagaataaatgggacattacacaag

SEQ ID NO: 2048 - DNA, 1966 bp, Homo sapiens
attaatcaatgcagagacggggcaagtggagtatttgcagggttggcctggagcccagcatgcgccccctcccacacatccaggacagggatctggacggctgtgggttcaggtcaacaaatgtccatggagtcacccatcaatccaaggctcccagcagaaggcagacagtgtgacttggctacaggctttgccattcgctgcctgtgagacacaagcaagtaggcgaagatatccaagcctcagttctcatgaagcatcagaatgatggtgccactggctacatggagaagcaaggagaggagaatgctagctgcactccctggctacacgcaaacagatgcagcacgaagccttgggaaccttggcaagggatttaaacagtctccctctaatgcatataacatggtgctgctggatttcccagaacaggattttaagatggttccgagagtggaacctggtaactcctgggagcacctctctgcttggtctgctctgggggtgggctgctggcccatctgtggctagcctcaggatagagggaagggagctgcagcagctgccatgacgtgttgggaagggaactgtcatgtttgcagcagccctggtgggtctgatgtttttttaattatccttcaagttccaaaagcacatccatgtctctggggacacataacaagccatgtcactttatgttcctttggaactatgtctctttggactgtctggcttatagttgttgttcagggccaagtgatgtgtcacccttctctgaaatgtctgcatcctgtgaattgtttagcctactttcccctgaccccaggctcaggcccctcttctctgctctcaccatacctttcaccccacatccagtcccctcccaaaatcctcccagttttacttctgtgcccttttgagagggcacagtcatttatactttaagctttccaccagaaagtcggatgctgaagatgtccaggacaaacttaagtttcagtgtttgttgaactctctgtgccctctccagtagactgcctttcctcatgccctcagactctactctacctgcctgttctgcaggactaaccccacgtggagacagtcagcccccaccccagtggggacatgcactggagagcttccagaaggcctgcagatagcttctctcctgccctaccatagtgcccgaaattcccaccagaaatgccactcttgtggattacagcatccagctccagaaagcctttgagttgttacctcaattttgcttttgaggaaatgaaggatgaggattccagtgacttttccaagttcaagatcaaccactggcaagatcagagctgaacctggccaaatgaacacaaatcccatgctctttccacaccaccacactggtgcaggaaggacgatttgatttttcacagctctagagcaggatgacttgcccagatttcaccccttgagaattaggaggagggaaagggaatttcagaggatttcttcttcttcttcttttttttttttttgagatggagtcttgctctgtcacccaggctggagtgcagtggcatgatctcggctcactgcaacctccacctcccaggttcaagcaattctcctgcctcagcctcccgagtagctgggattacaggcgtccatcaccatgcttggctaatttttgtattcttagtagagatggggccaccatattggccaggctggtctcaaactttttaccttgtgatctgcctgcctcggcctcccaaagtgttgggattacaggcatgagccaccatgcctggcccagttttcttctttatacttattttttcaagacattgcagcattgccttaacctctctctttctttttttttttttttttttgagatggagtctcgctttgttgcccaggctggagtacaatggcatgatctcagctcactgcaacctatacctccctg

SEQ ID NO: 2049 - DNA, 589 bp, Homo sapiens
gtgtcgcgtcccgggaccggacgacaggaggcatgttctgcgctagcaccgtgactttgttcccagcgtggggactgtgggagagatggagagagactggtacagaaatggtgagacaaggagagagccataaagaggaagacagagagaaagaagacaaatgcataaagaggttcagagacgtgtgactgtggagatcgaaggcctggttttagggctagcgaacaccttctccctttggttttggtccacagaagactggtgatacagagcatcctcgccaggagaggcagagtccatggagcagccgagacagctgtggaagagaaggtgccatgcggagctactgagagagagggaagggcaccccatcactacacacagcaaaaaatgaccttctgccaaagaagctgatggttcaggaagaaaatagagctgactatccctgaaggaaaaggaaacgtggtactgttttgctttatcacaaatacaaacaaaaggtttaaagatggaaagaaaagaacagaaaggaaaaagagtgaaaagccaggaaaagcacctaggaggaatagccctctgctgccatact

SEQ ID NO: 2050 - DNA, 2368 bp, Homo sapiens
gttgacccgactttggctgcacatttgactggcccctggatcagctctaggactagatgtacccaaaaggatgcccacatccttgcctcagctcctgcctctgcccacccagagagctgccttgcccccatgtccacgatgcagccaccaggcctgggtaagcgtgggtgtccgagacgggctgggacacccagaagaggagccaggacttgcttggtctgtatcccggctctgcatgcctcagtgtccctgcctgtaaagtgggatctatgggaacccatgtgtgggccgggcacagtgctcacacctgtgaacccagcaccttgggaggccaaagggaggatcctttgagctcgggagacagggtctcgctctgttgcccaggctgtagttcagcggcgtgatctcagctcactgcagcctccgcctcccaggttcaagcgattctcctgcctcagcttcctgagtaactgggattacaggcacttgccaccatgcccagctaattttgtatttttagtagagatggggttttgccatgttggccaggctggtctcaaactcctgacctcaagtgatctgcctgcctcggcctcccaaagtgctgtgattacaggtgtgagtcatcatgcctggccaaaaaaaatttttttaaattaaccgggtgtgatggcacatgcctgtggtcccagctacctgaggccaaggtgggaagatcacttgaacacagcacttcgaggccacagtgaactatgatcgcgccactgcactccagcctgggtgacagagcaagaccctgtctccaaaaaaaaccctctaaacctatgtgttatggatagggcctctaagaaggtaattaaagttacgtgagtcctaagggtgggaccctgaactgttgtccttaaaagaagaggaagagacaccaggagtgagcacacagaggagaggccacatgaggacgcagggagagggtgccgtctgcaagccatggagaggcctcaggaggaacccaccctgccggcagcctgatccctgacatccagactccggaagtgagaaaataaatgtcgtttaagccgcccaggctgtggtgttgagttatgcggccctagcaggtcatttgtcacgtcatgggtatctggacctggaatcgtgtgctggcccaagtcagcagcatggcacccatggtcaccccttcagctgagccacatgcccgggtgccccagggacagagcagggtgtgccacgggcactgcctggttcctgaagctgtggggcaggccggtctggccctcacagcctgtgctctgattcgagggccgttccgttgggttgagctccacggtcccagagcgcccgccgtcagctcaggccgagggcccttcctggtgccccggtgagtgacacggccaggacctgaccctcccatgcctctgtggcagagcaaggtgggtggggaactggctgtcctgctcccagctgcgttcctggcacctatgccccacccacccagacacacatctgggtgtcaggcagccgcatgtcactgagtggggtaaacaagggagggtgagaggaaggtcagaaggccatggctgagggcgtaagtgtgggctgaggctcttgcttcccagaacacagactgaccttggtggcagacctcaccatgggagcccccaaaagctgcttgcttgaggcctccaggcctcttgcagggccctaaaagcacagggatccaggacaagaggtgcgggggcccccgcctgggcaccagcctgcatgggccagagcaagccacttcctctcaggtttggggaatgcccacgtcagacttgcagaggcaacttctccatctgtctggctcacaggccctgtggcaggagaggagccaagaaatgaaagggcccggtgggtgtgggcgggccctgctccgatctggatctggccagtgcctgtggcacgccctgctctgtccctggggcacccgggcgtgtggctcagctgaaagggtgaccatgggcaccatttgcctggctcccaggtcctgaggccagagaggagccaagaaatgaaagggcctggtgggtgtgagtgggcctcagtgtctggctgctccaggaggaggggggtgggcactgactcctgcctgagggctggaggcagggaggctcctctggacaggaagaccctccaggaacagaccagcaagactggcactgtccagatgggaccaggagccggacagcggcgtcagacatgccccacagcggccgtgaccacagccacttcctggaggtcaagacctggaggcagggccagtgctgccagggatcctggtgtggacacgggcaggaccaggggatgctcc

SEQ ID NO: 2051 - DNA, 549 bp, Homo sapiens
cgctcaggcagttctcttaagaaatgatgaactgctctattggcagccgccacaggagttcacaaagaagaggcattaggctggcaagcagagctggtgggatttacctttgacgtagtgagctccttgaagctacaacaatgccatatgcatcctgtcacagtgtctggtagaagctgcaaagccttctgggagcctcatatcatctcccgtgggcagctgtcttgtgtccctgggcagaatcactcttcaagaaagcatcagcaagcatcacaggaggctgaagcacgagaatcacttatctgtataagaaatagtgtcaagatgaattgttgtgtcctcaagggtagcaagctctccctcattccttctcagatatcttgcattaccctattttactaacgaaaaaatattctctaatttaagcacaatggcatattttattttcctaatgaactactttctgtgattttggactatcccattgctgaaatgttttatctgatttttgatgctctaatgatcccaataaattataaacattttgca

SEQ ID NO: 2052 - DNA, 5284 bp, Homo sapiens
tttttttttttttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtgagtcactgaaaactaagctgcgctttcctaaagtcctgcgaactgaagccagacaacttaaacctcagaagaaaataacagcaacctatttatatacataagccactttcatacctgcctactgttgtatagacttcagagtaatgtggcctgtatcgattttccaggagtattcttttgtgtgttgttttttctcaattcctcctattttctctttacaggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagataggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaaggtcagttgataggatgaatgaaaaacaaaaattggaagtaatggtactagtaataagtggggattttcatgtaggtaaaggaactgataagtcatagggaatccgtgagttcttaatcttactgagtttagttgtgttctttgattattttggatagctttgtttaacggtgaatgaaatgattaaaatggaaaaattaagtgcagaaaatatgtttaacattatataggatgtcttgttttaggcatttattgctagataacatatgtccattcttgtattgctataaagaaatattggatactggctaatttataaataaaagagatttattggctcatgattctgcaggctgtacaggaaatatgattctggaatccgcttggcttctggaaaggcctcaggaaacttagaatgatgacacaaggcagaggggaagcaggcacatcttacatggcaggagcagggagcaagaaagagtgaagcgggaggtgctacacacttttaataatccagatctgagtcaggcatagcagcttatgcctataatcccagcacttttgggaggccaaggcaggcagatcacctgagggtcaggagttcaaggccagcctggccaacatggtgaaacctcatgtctactaaaagtacaaaaattagctgggtgtggttgcacctgcttataatcccagctgctcaggaggctgaggcaggagaattgcttgaacccgggaggcagatgtttcagtgaaccaagattgcaccactgcactccagcctgggtgaacagagtaagactctgccttaaaagtaaaataaaattaaattaaaattaaaaaccagatcttgcaagaactcactgtcagaagaacagcaccaagggtatggtgctgaaccattcatgaaggagccatcctcaagatccagtcatctcataccaggtccacctccatctaatattgggaattacaattcatcatgagggttggtggagacatggatccaagccatgtcacatattatcctgactgtagtggtttaagataacaatttttatctcacaatttattttgaatacaggcatgatttagctgtgtcctttggttcagtatctcttcaaagctgtaatcaggtttttcatgtgtttgtcatcaactgaaagattgactgagtatggttctgagatctctcaggtgattattggcagaattaagttccttttcgattcttggtcttatttcttcacccatctactatagtgcattcttgccatgcagccctttttatggagcaagtcacaatacagcagcttgcttcattagggcaagcaagcaagacaagctgcagcaaatgcaagtaacatggaagtctttataatctaatcatggaattgacatagttaaaaacaaatcattaggtaggctccaaattgatcagaacatggttattggacaaaaccatgactgtcaggaggctgcatcatggggagccattttacaagcagcaccatgggtgttatgggggattttattacatttgttctgctcttaagagttgaaagtctttaaaaatgtgtaagtctgtcgtttgttcttgacttctgtcatgttttcaagaatgcattatgcaatgatgtagaatactgtttgtaaagtagttgtctagactctagtgaaaataattacagataatctcagttcatcaacgaatcggtatattaatgtcatatttaacagttataggaataaactaagcataataataaatgatgatttgaatgttattataatta

SEQ ID NO: 2053 - DNA, 536 bp, Homo sapiens
atcatctaaaaggactggacctacatctgcagttaactgcacaatggaagaaacggcctctcctgggcagcctcatggatggggtgaagagacaaagcttgggagtgtagcatgttgagcacatctgctcagaggtaacatttaagcatttaggttgtctccaagcataaaaatggaaatactgatcctgtgacaacacagcctgaattttctgctttgcagatgccagatttatttttaaatggtgtgaatcaaatctgtgctgagaggccaacttcaaaatataaaagaaaaattggcaatgggaggattgtgctggtttggctgaaatgaagtgctctacggcatttcattctagtggagcgtctgactgtgaaaatccttccaattgtaattttctttggcttgtcaaaagaggattatgaactaaagtcagtgttgcaggaaatgtcacctgtcctttgaaagaaaataataaatcaaaatggcttttgttcatcatgtttaaaatgaaaaaaaaaaaaaagttgatccac

SEQ ID NO: 2054 - DNA, 542 bp, Homo sapiens
atagtccctggccaaatgcaaggaaactgttcctcagtgccttttctccccctccccatccagttcgtggatccccgtaagagccctaacttgggactgagcacggagtacgagtctgacacaagctcagactaactgacttgggaaatgctagctatacttaaagaataaccctgtcaggtcggtgcggtggctcacgcctgtaatcccagcactttgggagaaattaaggtcggaagagtggcaggggaggactgaggatcagtattgtagctggggagggggatggctagggatgaatcttgcccaccgatgataccctgacattcttgcctggacagggttatttggagggaaaagggaggtgcaaggatgcaaggcagagaatgcttaccccatgattctacgctccgagtaagcctttcgcttgttggtgaagggagcagcaaatcccatgaaggaacggctcgaaggtaagccagcctcagccgccaagatctgggcagcccgaggcaagaggaggctgcaggaggtcagaaacc

SEQ ID NO: 2055 - DNA, 609 bp, Homo sapiens
ttgtaattgcagtggaaggggagaccaaacattcaaagattgctgaagagccaacgaactctgattctgtcaagatgatgtctttgatttctttcacaaacttcagtggcacagcctttagctgatggtattgcctctgaatttgctgattcagaagatgtcggactcatgttatcctatagaagatgtaacaacccatatacatttatgaaaatcaggaactacattattataatgatgaaggaaaagcccaagaaatcaaccaacctgaaacctgcaatgaagctgtgcagctgtctttgccaacagggttctgcacctcaaaactgtataccccactgtcactcggtgctacattgatgatcttaaggccggatactttgttgaagaagcttattttgtatttgttgtcacttgttagctcttttccatccttaaaccacttagtactgagttcaggggtgccagctactgtacactccaaggtacaggtgtctcccgtggtaacttttatggattctggcttttctacaattgttgcaggctctggaatgaaatgtaaaagatatccatattttaaactcaaattgaaaaactaaagaaaataca

SEQ ID NO: 2056 - DNA, 597 bp, Homo sapiens
agtgaactggcagtgaaggatttacactcaggtctcttgggccccaaaatctaagtactgcacacgactctgcagacctccatggagtgactctttctaaaaagctttatgccaacagacaccagaggaggaaggtggtcaccaggcatcactgtccaccttacatagagtctcgctctgttgcccaggctaaagtgcagtgatgcaatcttggctcatggcacctctgcctcccaagttcaagcaattctcctgccttagcctcctgagtagctgggattacaagcacacccaccgcgtccagctagtttttttgtatttttagcagagacagggtttcaccatgttggtcagagtagtctcaaactcctgacctcaggtgatctgcactgcctcagcctcccaatgtgctgggattacaggcatgagccactgcgcccggcctaggccctctcttttgatgatctcaacaatccttgccagatggtgttcgtatccccattttaaagaagagaaaaaaagagacatggacagattaactgattcatcaagggtcaagccaagctcatcagtggccaagcaggcatgggaagccaa

SEQ ID NO: 2057 - DNA, 1899 bp, Homo sapiens
taatttctgtcatttattcacgtcataatccccaaagctacctttattccacgactctttccaccattttcctacagtcagctttttttaaggctatagcctttaaaaacttgaaacagaaaattttaaggatgcaaccattagaaaatgttcccatactaccatttaacattccccatttatcattatgtttactatcgtgtaatttccaacataatattatgaggtcaaaggctctacgaacgccgttttacaatctacctagggaggcaatggctgtgaaacacaccacaccaatgacaggaatgcgggtcactgtgacacaacggatccctctgcaaagtcaaagctaagagttcactttacgctgacggagcttctttccaggacccccacccccacccaaggacaggagagtgtcgatttcccaaggtgtctggcactgcttcttgaaaacgcagctctcatctggttcctggaaggtcatactggttcgcgcagggctcgggacggggcgcttggcttctgaggcacccgcgctggctcctcacccggtgaccttcaggcctctgcgcttggcctgaccctagaagggccaccgcccttcacagcgggcgggcaccgtccctcccacggccccgccgactgctgacgcggtggccccaagggtccaggcccgcacttgccccactcccgcggcgccgtcccccatagtcggtccccgagggccgcgcccagctcctgctcggatttcagcccgcaccgcaccccagccgccagggaaccttccagaaccctgcccctctggctttctcccgaaagcccagggtcgccgtccaggaagaaacttcgattcatttattgagcgccgactgtgtccaaggccgagggaggggcggggtttccacgcggggagaccccctaggttctcgcctcggtaagcgcccgcgttccagcacctcgagtcgcccgcgggcccccacccctcgggccgggcccggtcctcgaggaaaacccacggcggggcaggaaggaacgaggagagccacgctccttgcccgcctcgtcccctccactccccttcacctcacgggaccccagggaagccgccggagctaaaattagcaacccgcgcagcgcgcgctcacgtgcgcgcggcccggcgggggcggggagcaaggggcgcggtccgggtgagtcaccggccccgccccactcgccaagaacgcgctgacgtcagccgcttccccgaagggtgacgtaagcgcgccacggggaggccgaggcagctgatagaatgttctgagtttcgatgccttaaagggaccaggcctgggatcgtgaaacatctggggaaacgactccactcactcacctgcagactgagagcccatcttgtaccgtgttatactttaagagagttgactgttgagatgatgatgaaaacggaagaacaactgagcctagttggaggctctttgaagtcccagaacctcctcctggaagccctctttggttaaccagatggacatctcagttgccctctgagcctgaaccaagtgtcaggaagagttttctatggcccttgactccttaactctttgcttatagcgtctctgctctctgatgcctctgctgtcagagaaaggctgtggtttaaatatttatttatgaatccatcagcttgggccaactaggtccatttatcaccgttttgactgtgtctaaactgtcattagtggtgtgactagaaaccagttaatttcgctgggtggtaaattcgtggactgatctccaaaccctcctactgtgctaatgttgccaatggaagtttccagaggccaggatccctggccaacacgtgatcgtaaacaacatcagggcctcacagggaactca

SEQ ID NO: 2058 - DNA, 855 bp, Homo sapiens
agatgcttttagcctgaaaaggagaatagaaatgcattttctctaaacatacaagagcactcatttccagagagatcctggactggagggacaggagcgtgacccaggctgttcatcatgaatggctggctggggcttccagggagctcaagatcaaatccgggggcaaagagacagaagaactaaaactcagagtgaccaccaatgcagctatgaaacaggtggcaacagccaagtggaagaagccaagtgaagggctatggggacctagaagatggagtcgtcacacagtggaagaattgcagatctctgagtcaccatttggacaagaacctactagaacaggtgcctgaacaagaacactggactttgtgtgagtgagaaacaaacttttattgtgttaagccaccgagattttgggttggtttttatagtagctggtgttgcttacactgactaatacatcttgaaagtaaatgatgcaaaacaattctacttattcacagggggtggtatttataagggaaaagaataacagggtggtgtcagtgatgggtcctgataagtaagcaacaacaaggaaggggccccaggtagggaagaacaattgttctgagagactgttaatcacaaacaacctgctagccccacatcctgttctcaaatactttgctcagcatgtagccccagcagcatgactttgtctgcatgtagaccctccagcatgaccctataaaatttccctccagccactgcctcttggcagacagtcccttctctgctgtgctgcccactgctttcttacaacgttatctttgtactttctctaataaatctgcctttctttacccacaa

SEQ ID NO: 2059 - DNA, 1029 bp, Homo sapiens
cttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctttagttgaatccatggacatgaaacccacagatatagagggttggcccggtgcagtggctcacgcctgtaatcccagcactttgggaggccaaggcgggtggatcacctgaggtcagaagcttgagaccagcctggccaacatggtaaaaccccatctctactaataatacaaaacaatttgctgggcatggtggtgcacgcttgtaatccaagctactccagaggctgaggcagaagaatcgcttgaatccgagaggcaaaggttgcagtgagcccagatcacaccactgctctc

SEQ ID NO: 2060 - DNA, 718 bp, Homo sapiens
atcacttttcctttcatgttttttctacatgctattatctgtatgaaatgaagaccaagaaaggatgggaagaaggagaagaaaaattttgatttatctcagaaactatactccgaagtgagagtcctggttgcaggtgcaactgaaggactatggctatggtagctgcccaggaagactggccatccgattcatgcttgtgcagtccttggacttttagatctaccagttatcttcttttaaaaaattccccaggaaattcagcagagattgagcatccctgacccacagtgatggcttctcgtactattgtttaatggaaggagatccttttagcagaaatcactcatgatttagcagtctaggagccatcatgaggaaagagttggagtggatggttttaatgcagatggtctcaatatgatggatcatcacattttggagttctcagtcctgtgtacaaagtccaactatctgaggccaccatgcacttaggatgtccaggccacctggagaggctaccagatatgtgtatgaagaagttgtcttgaaagtggatcttccagcccatgttattctagctacagctgtttgagtctccttgtacaagccccagacatcatggaatggagaagagctgagccacggtgtcctctccaaattctcaatccacaaaactcatgaaaataataaaatgattgtgtctttgtgctactaa

SEQ ID NO: 2061 - DNA, 465 bp, Homo sapiens
caccccatgcggtcaccagcagacagccgctttctgcacaagttccaagatggactcacagcagtccccgccagccatgacgctgagatgggtgtacacccagctctggaggaacccaaccgcctgtggtctctccacaacggctgcaaaatactattctccgctgtaaccaacctccaggtcacagccacaggacttcccacggacttcccctgctcttaaagcaaactgcagaaccaagcgtggacttctgctcctgagggggacggaaggacagtcccctgcggtcatctctataggagatgggggccatgggtgggagagaaactccctgttgcactttgtagccctcagtatgattaaagtgtttaccatgtacataaattatgctttttaagttcacatgtcttatatacttttacgttactttttaaaattaaaagacagttaacttttaagaataaa

SEQ ID NO: 2062 - DNA, 713 bp, Homo sapiens
acacaacgaaggagaggaagaagggaggaaggcacttcacaagcagagctgagccagcagggcagcaaggcagaaagggactgagattgtacctggaagtatcccagtggctggatattcaagatcattatgtccatgccagagaaatcaagttataccaccacttcttggccttttgcctaagatcaagtgtagaaatcaagttaaaccaaaccaagtgaggatttcagttatttctctgaaaagctggaagtagtctctttgaaaaccagtacaagataaggatgccctttctttccactcctattcaacatagtattagaagttctggccaggacaatcaggcaagagaaagaaataaagggtatttaattaggaagagaggaagtctagttgtctctgtttgcagacgacatgattgtatatttagaaagccccatcatctcagcccaaaaacttcttgaactgataagcaacttcatcaaagtctcaggatctaaaatcaatgtgcaagaatcacaaggatttatttacatcaacaataggcaagcagaaagccaaatcataggtgaactcccatttataattgctacagagagaataaagtacctaagaatacagctaaaaagggacatgaaggacctcttcagggagaactacaaaacactggtcaaagatataagagaggacacaaagaaatggaaaaacatttc

SEQ ID NO: 2063 - DNA, 310 bp, Homo sapiens
cttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagcctta

SEQ ID NO: 2064 - DNA, 585 bp, Homo sapiens
gagttgcatctttttgcctcgggagcctggcgcatcggagcttccctgcactcatccacgcgggatggtcacctccactccggaatgggcgtgagtcgggcaaagggctcggttggctgtgcatataaactgggcatgtgctcttggaaataaatttataaaatcccccgagaaagtaaagtggggacagccgagagggccccacacacctccttatggacacccaaggctgaggcagctctgtttccagccccttcctcaccggacgccaggttcaccccaggccgtgagaacccaggcctgaggcagcgcagccaaaggccccgatccggcccagagccgtgccctgattaggcccaaaggagaagtcaggatcaggaagagcagaaaacatctgagcaatgagacacgttgggaataaagctcccgcccaccgcatgataacaggcagagttcccaacctccagaggcacgtgactttaaagaccatatcctcacaaaataggatcaagtaaaagctgctcagtggtgaagacgcggagctggaccagccccggtgctgggtgcagcagccgctgtgcagga

SEQ ID NO: 2065 - DNA, 2271 bp, Homo sapiens
cgatctcggctcactgcaagctccgcctcccggattcacgccattctcctgcctcagcctcccgaggagctgggactacagggacccgccaccacgcccggctaatttttttgtatttttagtagagacggggtttcaccgtgttagccaggatggtctcgatctcctgacctcctgatccgcccgcctcggcctcccaaagtgctgggattacaggcgtgagccaccgcgcccggccggtactccgaagccctcagatcggcgacctgggcgctgtaggcaccgagaaaatacaggcaccgagccagaagcagtgccgcaaccaagagacctcggcttggcgaaatggcggcgtctggagcctgcgagtgacgccagctggtggggctgtcaaggagaacattcgttacggcgcaaccaacggtactgtcaccaagaaaccgtcgtctctgagaaaaaaagagacgttcggccgccgagaaactccgtacaagtgctgtgacagaaaaaccgccggctccgcgcagcggcaaaagagccaacgggaacgccgggtgctgcgaccatgaccccggcactggaggacgtgggatggagaatgggacacacggagcgagaagggaaacgtttcgtgcagaccaactagcgccgccgccaccggaaaactgactcgccagtgctgccaatgaagtgcgtgtgagaaaccgatgactggtgggaggagcagcgctgggcgctggacccgcgagtgtgagaatctggcggcgctaggacccttcaggcgcgggcacgaggcgaaacccagcgctgttgccaaagacaaatgcgcgttcttttgggcgccatcagcggtgcagccagtgatcactcccaggctctgagaaactagagatgtcagccacaaaccctccgttcagggaaagtttgcggcgccgtgacggatcgactggcactgggtgcaacattgtcttgtggcctagagactagaatataaaaacaaaaaccaaatacaaaactgctgctggcattactcctactctcccccctcaagtcagtggcttcaggcttaagaaaacctgtatttttcttggctgtgccataatccgtaattaccgaggcccccagcgacccacccagtgtgattcgcagagggaaaggagctggaataaggaccgtgaatggggcggatgtggctcgtcctgggagagagctaaagcttatgctggtcgcaaacagcattacattgcaggaaactgctcttccaatggccgtggctgggtccttccacaccatccctctgccctagacctttgtccccgttcagagccatcagagattctaggagagctgtcgacaaccgcatctcttcggaacttggaaactctaggttcaagatctccgtggagaatgaaaggcacagtcgcctgacccgggcatcaggcttgccccgcacatcaagtccctcccctactggatggaactctgtggcaatcgctccttattctgatggttcactctgtcagatatcctcgatatttggggatagtagttcaaaaacagccggggaggaaaatgggctgaaagattccagcgttggatgtagaattgacagcgagacatacacctcctctctaagcccagagaaaagctcaagttgtggttctctgtctctagcagcatgatcttcaaaatgcatcattgatttctatcttctgggaaatgcaatgcaggtgaacttcttttcatcttagcaaaaaagttgcaatcagcaccccctagacggaaggaatatcctgtcttaatgggagtccataggaggctgcaggctgctcccctacagagactaacatcaaggaggaaatcagtggtgcttcaggatattgtgaatttggtcttctgaaagcagaattctgatttaacagtataatggaattcgtgaacgtcatgatgctaatttgaaccaacaagcacccttgtgagaggaatctgcttttcctcaagtctgaagaacaccaggagaatctttctgtatggagttaccaggaatcctctgctaaggaaagtgaaagggaagatgcaatttctcctgggaaggggggatgctgatgtagagggtgacaagtaatatgccatgaaggattcagtcacctggttagatttagagttagagttatggttaaggaagaaggaaggaaaaaaggcagaagaggaagaaaggaagcaagaaaagataaaatttattctaagataaaatttgtgaattttgctaaa

SEQ ID NO: 2066 - DNA, 449 bp, Homo sapiens
cagaactgtctcggaaagccctggaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtcctta

SEQ ID NO: 2067 - DNA, 3370 bp, Homo sapiens
gagacacactacaacaggagagggagcaagcgcgagaggatattagaagagaggcttgtctccaagatatggaaggaagtgagaaatgacagggctgcaagctttgtatgtaggagcccggcagggcgggggagcggcgaggagagccaagtggattctcagaaaaggggggaagccatcgaagagctaaaggtgattagagggggatattgatttcttattctgccagagatttaagcaggcatgcgaggaatctgcaccatggttggcaaaaagagacccgttgcctcctgtaaccagacactcaggctttccaggagcccagggagcaagccgagaagaaagggggcagtgtggtctaggaaaattcaacttgtcgctgatttgtgcctgatgcctgctgtccgtcagcagcctcccttacaatctttttttctctctctcctttttttttccttgccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagttgtgttgatgttcctttcagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgtgaa

SEQ ID NO: 2068 - DNA, 2732 bp, Homo sapiens
ccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggaactgttggaaactactgaaactggccgacctgatcttcaaaatgtgcccctaggaaaggtggatgccaccgtgttcacagacagtagcagcttcctcgagaagggactacgaaaggccggtgcagctgttaccatggagacagatgtgttgtgggctcaggctttaccagcaaacacctcagcacaaaaggctgaattgatcgccctcactcaggctctccgatggggtaaggatattaacgttaacactgacagcaggtacgcctttgctactgtgcatgtacgtggagccatctaccaggagcgtgggctactcacctcagcaggtggctgtaatccactgtaaaggacatcaaaaggaaaacacggctgttgcccgtggtaaccagaaagctgattcagcagctcaagatgcagtgtgactttcagtcacgcctctaaacttgctgcccacagtctcctttccacagccagatctgcctgacaatcccgcatactcaacagaagaagaaaactggcctcagaactcagagccaataaaaatcaggaaggttggtggattcttcctgactctagaatcttcataccccgaactcttgggaaaactttaatcagtcacctacagtctaccacccatttaggaggagcaaagctacctcagctcctccggagccgttttaagatcccccatcttcaaagcctaacagatcaagcagctctccggtgcacaacctgcgcccaggtaaatgccaaaaaaggtcctaaacccagcccaggccaccgtctccaagaaaactcaccaggagaaaagtgggaaattgactttacagaagtaaaaccacaccgggctgggtacaaataccttctagtactggtagacaccttctctggatggactgaagcatttgctaccaaaaacgaaactgtcaatatggtagttaagtttttactcaatgaaatcatccctcgacatgggctgcctgttgccatagggtctgataatggaccggccttcgccttgtctatagtttagtcagtcagtaaggcgttaaacattcaatggaagctccattgtgcctatcgaccccagagctctgggcaagtagaacgcatgaactgcaccctaaaaaacactcttacaaaattaatcttagaaaccggtgtaaattgtgtaagtctccttcctttagccctacttagagtaaggtgcaccccttactgggctgggttcttaccttttgaaatcatgtatgggagggcgctgcctatcttgcctaagctaagagatgcccaattggcaaaaatatcacaaactaatttattacagtacctacagtctccccaacaggtacaagatatcatcctgccacttgttcgaggaacccatcccaatccaattcctgaacagacagggccctgccattcattcccgccaggtgacctgttgtttgttaaaaagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccagggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgatttgattccccaaaaacacaagtggggaatgtagtgtccaacctggtttttactaaccctgtttttagactctccctttcctttaatcactcagccttgtttccacctgaattgactctcccttagctaagagcgccagatggactccatcttggctctttcactggcagccgcttcctcaaggacttaacttgtgcaagctgactcccagcacatccaagaatgcaattaactgataagatactgtggcaagctatatccgcagttcccaggaattcgtccaattgattacacccaaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagc

SEQ ID NO: 2069 - DNA, 2466 bp, Homo sapiens
ggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttcttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgttaaa

SEQ ID NO: 2070 - DNA, 773 bp, Homo sapiens
agactgctgtgctagcaatcagcgagactccgtgggcgtaggaccctccgagccaggaaagggaactccctgaccccttgagcttcccgagtgaggcaatgcctcgtcctgcttcggctcgcgcacggtgcgcgcacccactgacctgcgcccactgtctggcactccctagtgagatgaacccggtacctcagatggaaatgcagaaatcacccgtcttctgcgtcgctcaacgctgggagctgtagaccggagctgttcctattcggctatcttggctcctccccctggctgtgggtttcttatagatggcttttattacattgaggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattagatgattaccacatgctgagggcacctgacacagagcccggtgcagagcacttgcccactagaggtttgccactgagactgccagtgaagaacaaatcaatgcaagggcactgaagcttgtcgttctt

SEQ ID NO: 2071 - DNA, 539 bp, Homo sapiens
agaggctgcctgccgctttctttcgcagttttgcggcccaaggcttgggcgaatcagttcacatcaacacccctactagcctctccctccggggtcgaccatttatctccagcagcggaccaggcgcccgggccagggtgacatgcgcgccctgcctacacgcagctcggatcctctgctgtttctggagaggcctccacaggtagaagctccctggaacaactgctggaataaggttccagagtggaaggtggaagctccctcttgggataaaggatccacagtggaaaaaaaaaaagttgccctctgctggaaaacagcatctttgtcctctgagaaaaacagtctcccttcttacggaggccagtggattccatcctagaggctgtgttgaccgtatctccaaatagacaataacgaggcatcttgattcccacaactccagcagcacagggacctgaaatgaaggacagaaagcaggaagtggaggcaatagaaattgcagagtagagtgaagacaggtggcatttctgggattg

SEQ ID NO: 2072 - DNA, 601 bp, Homo sapiens
taagaacaactgctaggctggtttttattgaacatggtttggaaatctctcgaacaaatgattcctgagacccaccccaattccaatgctatcattttgtgagttttattattcatctgaattcttacaactggtgtttggtaaccagaagaaacctgcaaggtgatgctcatttggacccaagcagtggtgaaattgctgactgaatcaaatagtgtaaatagatccacagaagaagaagtataatgaacctgaaattgctaaaccccttttaaggaaaattttcctagcataatatatgaagatggtccctctctttgttgcccaggctggagtgcagtggtgcgatcttgactcactgcaacctctacctcctggattcaagtgattctcctgcctcctgtagtcccaagtagctgggactacaggcacccgccaccaagtccagctaatttttgtatttttagtagagatggggtttcaccgtattggccaagctagtcttgaagtcctgacctcaagtgatctgcccccctcggcctctcaaagtgctgggattacaggcgtgagccactccactgagcctggccttttaatcttt

SEQ ID NO: 2073 - DNA, 1320 bp, Homo sapiens
gaactccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagcttgcattgcataaacgttgtcgccattaaattctggctgcggacccgaagtgtgtgcgggcccaggacttactcgaagggcgcacttcttgggaatgcgcatcccgtaggcgcaggagaccctgaggaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggtaaccaacagctgtgtgaccctagacgagttccgcagtctctctgagcctcagtttccttactggtcaaacgggataatgggatactagcgcccacctcatagagttgttctgagg

SEQ ID NO: 2074 - DNA, 2615 bp, Homo sapiens
ttgaatctttgatacatatttgttgaggagcttgtcagatcactacctttcactgaacagtaaaacatggatcatttatttcacctcattttgcacttcaatgcaatttcactctttaggtggttgtacttggacagttaaatgaagactgtctttaagggtgcagggatggagaacacagcatatatgagaggtgggagggcagagacgccttgcgattcctgtgaggagggacttaccgtctcctccaaaacagaaattcagtgctgcagagacggtagcaaagtgcagttctcttgttaaaacacaggctaaaagcagtgactgcttaacttattaagcagagaaaaccaaaatgtcattttcaaccaaaattgagtgttagagtttatggtctctgttatgatacttttcaagacctgggaaatatttgtatcctttagtgaaaaggggaagaatcaattactgaaagccataagcttacagtaacggagccaattaatcctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaagcaaaaggaaaaaaaagtgatattctaaaagccacacttcttttatcaccagtgcagttttttccatcatcataaacttagttttatgaaaatgttaatatcttggatttaaacattggggtagaaatcaggacaaaatttaaatgtcatatccaggacttaatctcagatattctggtagaagatatttagataaggttgtggctgcctgtcaagttttttaattttttaaattatataatgtcagaaaattaaatcacaaatgagccttccagattgtgaggaaaattacttggctgaaaatgactttgcataatgcccaaatcttgaagtatctgctcagatgtttgttccatctgaaatgctgccaaatccatctgtattgaggaaagagctatgaggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaaaatttaaaatga

SEQ ID NO: 2075 - DNA, 429 bp, Homo sapiens
ttttaaaaaaagtcacagaagaatgtggagacacttagcaaaacggactctcataagagtgttcgatggtgctgctactaatgaaagatttgaggaaactcctaaggtccctccagtgtacaacaatttggaacttccattttctcaacaactgctcttccaagatgctgcctcatttcagagccatgttttactcatgagctggtcctgtccagaaaacagccaatgctcattcccgacactttcttgtcactgctcttttctgttccctattttgtcagtaaggaagtaaacaaccgctaaaacaaccctctaacaacagaagaccctcatgagaacaccaggcagcagaagcttctttagcagtaaaagatatctggatattcatattttgttccatgatcttcaacattaaataaataaacttaa

SEQ ID NO: 2076 - DNA, 724 bp, Homo sapiens
attctcaagctgctgcagaactcgactgccattgaaatgtgcaaaagaaaaatttcctggcatcttaaaaaaaatgtcgaagtcagttactccacaagccctgtttgtaagagtccttgaaaagagaagcatcagttttccaatatgaagtaaatggagagtctggagttgcttctgttggccatcaatttcctgtggtgcagaggggctacaaatataatacagattaaactccctgcaggaagtctcttatggataagaacaagttcagcttcccattggggatgacagagctggtgctcaggtcatcaacatcctgctgaacctatgagaaagcatttgggacaacttgacaatgcatggtgagtcagaaagtttgctttttgattcaactatttaaaattccctattattttctttgtttttggctgccttttgcttaattgtcttgtcagctgtcctaagcctgacagccatatgaggtcaagcagaaaaactgaactggggaaataatcatagttcttcaatggattgtttctgaaaactgaatatgaggagagaatattcataggtatggcataacttccattttgtagctggaagaaatcatacccccaaattatgacaatttatagaattatgagttgaatgtttgtgtaagtatatgccttcatatttttaaacatgtataggctgcattattttctgccaataaattttatgg

SEQ ID NO: 2077 - DNA, 775 bp, Homo sapiens
agcgcgctaagctagctggcccggcaggggcgacggcggcgggtagctcgcgggctagcatcgagacgaggctcccgcccgacaggccgagcgcgaaacgggcgcgggcccctgccaggcagcatgctgcgcgctgggccaccagctgcgctagcgccgcacccagctcctgggaactcgagaacaccgagatgaggcccggggccggcgcggccatggcgagggcggcggcggggaggaggaagcgctccctacggccgtcgctagtacgcctgcgcaagggccggccctgccgcttggtttcgagtactttgggtgattgtctttggcacatgcgcagtgaggcaagtgaagcaccgcgaaggtcgggcagtcggtccggccctacccattgaatctttgcctgctgtgcctgagtcgaagtgagttcgggaagccagtgcccgaatgctcaaccttgctgtatcagggagggccggagaggggagctcaagaagaggacgtcctatcgaggtggcagggattttctgaaggagggcgtattttgatggaatctcactctgtcacccagactggagtgcagtggcccgatctcagctcactgcagcctccgcttcccaggttcaagcgattctcctgcctcagccttccaggcagctgggattacagtcgtcccagaagcggctggccgagaatttcttgcggaggacgactgtcagcccatagatgagacactgccccacgccgatgatgtttcctgcagagggtggccttg

SEQ ID NO: 2078 - DNA, 959 bp, Homo sapiens
atgctcagtgtaaattctcctggagcctgtcaagctatgtttgaactcgttccaggatagtggatttacttttttttccccaccaggaagaatactcgattagactgcattttgccttgcttttccttctccctttctctctctttctttctttctttctttctttctttctttctttctttctttctttctttctttctttctttctttctttttctttctctctctctctctctttctttctttcctttcttttctttctttcctctttctctttccttctttctttttttcttctttctttccttccttccttccatctttcttttctttctttccattttttttttcctccagaagaatggaaacagtattcttttccgatcagttcagtaatacaatgtccttcagtgtccatatgagcatttcagtggagaagaaaagaaactttgctacctgggaactgaagactacttaggcaaagatgggctgtctggaaagctggactcagcctggagcatgttccccagattgctattttgtgaaggcttccgcatacaaatgactcagatccaaacattcaaaaatgatcttggagggccatctggttcttgctggttctaaaagcttccttcagcctggagtatggatccagtacaaaagatagtgagagctgttcattgaggtttaacatgttccactgaccgaggctagaagctggctttaaaaaatagccaacactgatgctccaagggccaattgctgatgcttgtcacagtgaagatcccggtgttacacatccaatcgttcacctccttccaagactatgacattccaggaaaccttcactgctaagaggaactaagatctagagtatctcctcgaggaagtacaactgacttgtctttggacaaaattgagaagaactcataaacttggcttcctcgcttctgctcctc

SEQ ID NO: 2079 - DNA, 327 bp, Homo sapiens
ggaatagcgtcatcagttctataagagagcgtgtgccgaaggcctcggcctttcacattcgggaagcgtcgggattaggtgaaagaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 2080 - DNA, 2255 bp, Homo sapiens
ctttcggagtggagtttcctagctggtgcctgtcctctcttgagcctttgtttcttgagtgagcactcactggggctgtggctccatgaactggatttcaggaaaccagccaaggcattctctctctctctccattcctagaaaggcagaaagcctgggaatgggttcggcaggaagatctctgtacctcaatctccattgctttcagcaccactggctttctccccagctcaagtgcaaaacctgccatcgttgctacctggggtgcctcagactcacccaagtcccccaggccagaggacatgctctcaagccttgtttcagaaagagggacccaaaggctgttagggaagagaaccagggtcctcaaacccagggttttctcacccactgcctctgctctggctgtggcctgccagacctctcctctgattttcgctttccttcctgccagtgcctttgtttatccgaggcgccaagatcccactgtgaagtctgaaaggaagaccagtggttctcgcttttcctctagatgctgtgtctcccaatgtcatcttctttcctctcaaagacaattggacgttgttacagattttcttggaatgagtaaatacctagcagtgggattgctggatcatatgaaaatgccagactatatttcatcagcaacatcggagagttccagttgctctacaccctcactagcacttaatattgttgatcgctgcctggattcacagaaggacaaattacaatgcattttgaaagactcgtctacagtcaactaaaataccagttatcacagacttcactggccttaatgaggaggctgagagggatttaattactgggacatgcaacgcttacaccaaactctgttcgattcacgacttggaaaagcaaatgtggatacagatgagtgtggacatggcttcagtaggaaatgtcgagtttgttcatcactctgaagtttcttcagctgcaacggaaactgcaccctccctcccgacttgttggttatcttgctgtgctcccaagaaggtattttctgctgacctgatagatcagacctttgtcattttgattgaaaagatgtttacctgttggtccccagcctcactcttctgaacctcagatccactgagtgtgtatccagaggtaagtatgtggtaagtatgcttgtcatttacattatctgtcagcatgagtattggtttcctagaaacctaatattgaaaacacttagcattgctaaaagcattaaatgaaataaagactcaatatagctgcactaatctgtgctttctaaatttactgatggacgtgaagaaagtaggttggcatggagtttatacaatttatggatcacactgatctgaattcagacagtgtgtgctcagataaaaatattgtttcctcccatgaggtttccaattttgcagagaagaatacctctgtttagctcattacttaacacaatgggtagctgggtggccttgcattctggaagtgaaatgacacaagaatgtctccactgcattctccagaggtaaagattctctggcacaaaatcacaaccaaggtggggttccaaaactatagaacaaatggcagcagccatgcagccagccttggttcgggtgggctgtaaaagcagaggttgtcctcgtgttatcagcactgacttcctgttgtggccacactgacagagatgagatggcagaaagcaggaaagagaccagagctgcaattgacagatggctggccaaagttgaagggtcagagactacaccaaagacttctcagaaaatacttgcctaggaggctctcacttggaaagatattcagggttgttaaacatatcctgttattaggaaaacgagagttttatctttctcttactcagaaagaaaaaacaaaaagaaaattagtgctcttaagaaaagctattttaatgttatccattataaaattagaaaaccttgaaaggcaaatgtttcttctgaccatttacactgagcttctttcattatctcatatgcaaccttgtggattgaaggtggagagtccttaggattacccaggaacatccctgtctgctccccctgctaggcaggaggagatttgaaaccacatgtgtctacttcatttctgtcacgggtaggacagtgtcatatactttgtaggtaactcaaagatattataggtaactcatagatattgattgaattaatgtttaataaaatgagaacacc

SEQ ID NO: 2081 - DNA, 3590 bp, Homo sapiens
cgttgttagaaaccacacaggtgtattccccactctgagatatgtcaatattaaataattccagttctgccacagtgtcttcaaaatagatgttgcaccggtctcctttcactagttctctggcacctctgaaccagttgactttgaatggaggggttcctctaataacgcttgtgaaggttacatttttgcctggtagtacttccaaaggttcaggttctttcacaaaagagggtggttctatatagacatggagaacaattaaaagatcctgtaagcttcagatggagttgcaattttgaataaaacattagagcactttcaaatgtttgtcaacatagatgtgcacctgaagaggaatttgtaagaaattccttacaagtttgactgtctactgaccttgtacagttagcactgcacgacattcatcagacccagcgacattagcagccacgcatgtgtaattgcccatatctgaggaatccagagaattcaactgcaatgtgcagacattatctgaaaatgtggtttggtactttgctccactgacaatcttggttttctcatgaaaccaggcaactgaaataggtgatgatccagctactttgcattccaagatgcaagaagcacctaacaccccaccagtatttttcagtcttcgtgtgaaagagggaggaactgctcggtctgtgtgaggaaaggtaagagactcatcatgatttgaaagaatagaagagacttgaaagaaggaaacttgtaaaaggaatttgcataagcaaccagaagaaaacagcagaactaacctgaaacatcaaccacagctgtgcagctgcttttcccaacattattttgaacctggaaagtgtatgtgcctgcatcttgcctttcaactgagagaatccttaaggaagagattttgttgtagaagctaaatttgtgtttttggctgctggtcaacagctttccatccttgtaccattcaacagagagttccggagtgccagccaccttacactccagagtgcacgtttctcctacagtcaccgtcatcggtcctgccttctcaacaatgactgcgggctctgaaataaaacgtgatatccatctgtcaaagtctgggatctttactctgtctctactatcacattcactaagattgtttctcccagtgagatggttatgttagggtgctctctctctcgactttaaagtgtgattccataattacatgcagtcatagaattatagctattttttattttaatattttttcttttcagttttttctttattttttgtttttcccaccactcttgctgtcgtcttatgtagcaattattcttaagaaatatatgttcgtgcatgactcaacttcaaaacaatttaaacaatgtgcattagatagtatatattgatttccacttgaccctctgtagatcaaagtctacaggttattgtgaattacttggtatttttgctctaccttaaggtgctaaagacaattctttgaaagttgttattcaaacaattgtttaattgtcattaattttatgtggaagctttgctatcaaatgccaacctttggagttcttgttagttttaacaattactcttgtagcacatgctgggctctgtattctttcatgcttaatcaaagagagtcatgattgtatctgctaattgatatagacaggtagttattaaacaataaaacagatgtctaatttttgttagaatcacagaaacagaaaagagtgtttgaaagatcaactatgtctttcctctagacctttcaaatagatgaggataaatatagttctagaagaaactcagaaaaagaatctgccagtaactcttagtaattcattccagcatttggcaccagtttctatcgtgggctattgtaccaacctaagaccatcagtgtggccatgttctccctcattccaccatcattcttgatttggcagatatactttccagcattagctggctctgcttttgcaaactgtagagttgcaacattttccacaaatgtaatcctgatgttttcactttctctaatcacttcttccttctctttaagccactggacaaaaataggctgggcgccttctatggatgcttgtaattcagcaggctctccggctacaacagtgaggctgttcagtttggagacaaatcttggtggttctgaacaggaaaagatggatggaaattgttgaaaagattgtccagatcatgcgagagtgaaaaaagtaggattttgcacatttatgacatttctgccatgtggatgaactatatttacctttcaattttacagtacaaacacaagtatcacttcccacttcattctgtgctttgcagtggtattcaccgatgtctgaagtgtccacattgagaatgtgaatacttgtgtggaagtttttggatgcaatcttgtatttcttgctgcttctgagttgccgcttgtctttgtaccataccacctcaaacggtggtgttcccgaaagttcacattcaagactgacttcagcatttttaagggtttctactataggagggaagctgctaaaaacaggtggctctgcaaaaaacaagaatttctcatgaattgggctactgaatttcacaaaatgaaaattttttatttgtctttaaattggaagaaaggtttaagatattctaatgggtaagtagagtccagcactaacactctcatgggataacagcctcagaagccatttgccttcacaagataaccagctagatgggcagagaacccagatagatcctagatgtcgttactgaacagttcaacattctatctactacaccttactgatgtatcttaggctacaaagattgatacaaaaattgcaaacaagcaagtatagcaataaataatgatttgcatgaagtatggaattctaatttcaaggatgattttttttgtatatgttctataacagacacttggaagtcatcacaacatccgtgatctaagtcttccatttcagcaaatgattactgcaataattgtcttaaaacaagacaaacttggcctttgtgacaaaaaaaaaaagcactggaaaattgcagcaaaaaaacacagatactatttgtaccaaggtatagtcatataatttttaaaggataggaagtgatccttgagagagaaggaaaaaatattattgtcctgttttaaacataagtttaaaacctgtattgctttcactttgcatagatatagtaaaagtgcttgttattaatgatatagattatagtgagaatgatatatctgtaagttgattgaaagcaaaagactaattttaaaatgcctacttcatttttttgtgcagttttgaaacatcacgtttgatgtttggcaaatgtgttgaggtaatcagaattatgacactggaataacaaaaatatttcataatgactagttacatgtaagcaaaattcaagaaggaaaccatctaaaaagggaaataatactagctcagaaaaatattctatgatctcaaatggaaactaaaatgatagtaaatgaataaagagctataatacccaggggagaa

SEQ ID NO: 2082 - DNA, 1095 bp, Homo sapiens
attgacgacgtggcaaatgagcagcaaattgatcaatacgaatgatcacgccccatgtgcatctcctcagcagccacaagagagacgaggtcactggaggataaacatccgtgactgcacctcatgatccatcacgcacgacggccgcagcatctcctgccagctgccggcacagacaagagcacgggatggacgaccgcggtagcaacgtggggctcatctgcctctctctgagcaggaagcccgctcacacggggagccaccaggctggactgggtgcagcttacggacgtggcgcgtgctgtgggcgtcgggccgcggctcctccatgcagtacttacactgctgtctgcagatcgcacccaatcaggagggaatggtccaggcaggtgggcaaggccacggtttggccaggtaaggctgggagggcccaggatgattgtgcgttgagccaggcagatctggagaggcggagggatggggacggagcgccatgcagaggccgctcggtcctcaggagctgagcatcaccctgggagtctcaaggagggtgtcccctggccttagcgggcagccagggccagcatgtggtctgtggcagccggtctcagaggtggcctggttcgcagtcttgctggatggagatccccagctcctagggcaagggcaggtggggtggggccgcctcggtcagctgataggaactgaactgagaaggctgtgagccgctgagtcgccctaactgcagggtggtcctgcgggcagtactgagcccgccctgctgggcaccccacagcccctgtggctctccagctgccactgaggccggacgcctcatgaggaggctcccatctgtgggtggcagaatgacggccccgaagaccccccgcttcctcacccgaagaccccccgcttcctcacccgaagaccccccgcttcctcacccgaagaccccccgcttcctcacccaaagaccccccgcttccttgccccgaagaccccgcttcctcaccctgggacctgtgagttcacacagcagcggggacctgcgactgtggacggcacatcagctccctcaacagggaggctgccctg

SEQ ID NO: 2083 - DNA, 584 bp, Homo sapiens
gtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgaggacttcgcaggtgagcagtaacggaaatcagccccgtttattcctcccagcacctgccttatccaactccccacgctgtggctgagtcccagcctgctatggaagcatcactggactcccattgaactctgtgcagattcgctgttcgtagacatggtacctgatggacaccaagctacgtacagcttcaaggccccttctttctttgctaataaaaaataaaaaataaaa

SEQ ID NO: 2084 - DNA, 1326 bp, Homo sapiens
aagagtgaacacacactttgtgccggctttaaagaacccagcacaaagccagtctgcatggcctacagacatattttgctggacaatgattacttgcttttctttttgtttttcttgtatatgcctgtttgattggttcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacattactgtgtttgtagggggaggtctgatttacagagtaaccacatagtaattataattattagaatgtccagttttcaaaaaacgttacaaggcatacaaagaatgggaaagtgtggctcattcaaaggaacaaaataaagtgacagaaaatatccctaaggaaacccagacatcaaacttaccagacaaagactttaaaacaactctcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttcttttcacctttcttccttcttccttccccctcctcctttttacttttcttcctcttcctttctcttcttctttctcgccttcattatccctttcgctgtttctctttctccctttctcttttttcttttctttcaattttctcaattactaagagatgtttaagtacccttagcatgttagtagatatggttatttctccctttagttctcttttgagatttatagtcactcaaataaagagataacccaaacataagcgtcacaaacaggctttcataccattcttaatttggtcctgtaattcttcattgctgtattaattttctgatgcttttaaggatgttttataacaaattgtgtagctttttccaatggaatgtttattctgaattatctaattcatattgtaagtatagagggagtttaatataaaattattaaactaatatttgt

SEQ ID NO: 2085 - DNA, 454 bp, Homo sapiens
ctgaggctgcgtcttgggtgcgcagctccggcccagcctcacccaggggaacgcctcgcaggtgctcacggacgatggagaggtccgcgcccagggtgggagtccgcgcttccgggtgtgtctgcagctcggggcgctggagggtgggatgtgaccccgagacggcggcggcctggcacgtgatgtatgtgtgtccttgtctgatgtgtcggtgtccccgatggaccgggttccagtcccagctttgccactccccggcttgtgtgccttggggcaggtgactaccccgcgctgtgcctcagttgcctcatctgtacaatgggcatgattaaaaaatacctgtctcagagggcggttgtgaggattgagaggtaattctgtacgtgtaaaacgctgcggacgatacctggcacagactaaatactcataagaataaatacattaaataaactat

SEQ ID NO: 2086 - DNA, 522 bp, Homo sapiens
gggttgattctattatctgatgttttattaatctctgtgaaataattgtgtaaattaatatagagactagttgagaaatggtggataacatgaagaagatacccatttttgcatagattagatgtgatcaacctcacactatcatatgaaagttggctgcattggagagacaggaattaatattaaaaatgttttcagttcagattgatatcttacatttccaaatattattttcttttgaatatgtgtgagccactgtgcctggccccacattttttaaaacaatgactttagggtttcagcttttcctgtcttttaaaacaaattagccattttttattctaagaaagggttgtattataaagctgacctactactagcttatcagaaaaaacacgtgggtctcatatctgattctcctatgtagccaaaagtgccatttgtaagtctactaaatgacggatattttctgaagatcttttgcctggaaaacaaatagtgcattaaaaagcttttttggta

SEQ ID NO: 2087 - DNA, 815 bp, Homo sapiens
tgtttgctaagtcaccgcgcaggaggagacagaatcagaggtgacgaatgtaagtccacccattggcttaagatccagtatcctgagtgagttgcacagatcctctccttcagtcctctcaggaactctagaggtccctgcagttatgaagaactaattaaaggcatgaaatgttcctctgcaagtttcattgaccatattgggcctacagtccatttccaaataaatatctaaggtagcaaccttggcagtgggagcccagcaggtcccgtctttgtccctgtgctgatacagagagactctccgtgctgtggacgcctccatctgggcacatgtttcagttgttttctaaataccaagagcacagattgctcagtaataatagctctcctgcaaatctggaatcacttaggcagctgcagtgcctctaagcctccttgcatccaaggctgtgatcaaggaggactggtgtctgagtgggcttgagaagggcccggagaacagcgggtttcctgatcacaaatcagcctgtcattcagcatgtgttcccttggtgactcagggcgatatctgcccttctccggaggtcaagggctcatcgtgtcaattgtggtcttgagtttgttttttttttcctcttgaaatcattgtaattaagctaaaagtatagtgttggtatccagcacatgtttgcaaagtatttaacaatgagcaaaaactttaagaataaattaaagcatctagtttactttttgccaacagccaggttcctgctagaaatgattttgaaataaatgttgtcttggaaatagaaa

SEQ ID NO: 2088 - DNA, 327 bp, Homo sapiens
gtgactgccaggtaatgctaaccccgaatccttggtgcctgtgttatgcaccatatgctgaatttcggttccagctgtgtgctaggctgggtctgatctggcaaagaggaactggctccacagctctgggcagaatccactgctgctcccacacagagaagaccaggggaaccgcagtcccactctgatagtgagagcaaaggaaagtggcaacaatgaaggaataaaacccagctcgtccccctgttcctcatgcccaacccttgccaagacttcaggtaacagaaggaagagaacacatggatgggcacatgctgggcccggaag

SEQ ID NO: 2089 - DNA, 93 bp, Homo sapiens
ccttccggcgtcccaggcggggcgccgcgggaccgccctcgtgtctgtggcggtgggatcccgcggccgtgttttcctggtggcccggccatg

SEQ ID NO: 2090 - DNA, 1281 bp, Homo sapiens
cgattcctctgccctggatagagagcggtgtctcataacagtttggaaactacaaaagtttccctggcaggatgaatgattgactcggcaacatgttcttgccttttggagttgccctccaatttttccaggcttgattctgtaaatcatttcatcttgtaaaaatactgggctgtgagcacggatgatctcaaagatgaggaaacagaagctgggatatgtgagtaaacatttccaaggtcctgcagctaatcaatggttgacaacttctttcctctgcctatgttgccatccatgtcatggtttgtgtcaagactctaggagaagtctaccatcagcaccacagctactgtgcacaaatccagaatgccagactgaagtcagaaggaaaggtaaaagtccaattctcagatggcaattcagacttagaaaacagaatgagaaaaagcagtggtgtccatctctcctcaacgatgaattcatgtcttaaaatgtatctgcatctatttctttctgtctaccatccatccatccatctttccttctttcttctttctctttctctttctctccctccttccttctcttccttcgttttcataagtaaaactagtactaatgcagaagtctgaaattagactttaaaaacgagtactactctttttttccccctttttgagagagctggtgattttcttccttgcttggcattaactgtcttactgtcttatgatacttatctttaatgtggcatatcagagaacctctttgaaaatgttacggcttaatgcggctcagggaaataaaagcccactttaaaaaagccaaaataaagctttctgatacggacttcacaattaatttttgagaaggtccactttcatatgcaagcaaatctgtttagaaatgttttaaattttaaagcatgcatacacatataaaactaatttatgtgtttttaaatgctgtttaaaattttaaagcatatatagagagcaagagagcaagagagggtgctcaatatgcatcataatagcatgagaactgaaaaataaaagtttacttgcaaacttaaccggctttgcaatgcaacagactaaacaagtcacattttatacaatgtatatgtttataatatgagtgcagcatgccaatgtgctatttagatcattgtcctggttgaatgaacaagctcacaggttcaccatttaatatttgttctcttaaaaacatgaaactcgttttgaaaataccggcttaaatgggcattattaagtcttt

SEQ ID NO: 2091 - DNA, 3088 bp, Homo sapiens
tcgctcaggatgtcactctctttgatgagattgtcggcaaaatctgccaagccggggtgtgggtatttcccgggagaagtgctcttggagtcctgcctgccctcagccgtggggcagccgctgctctgggtgccgctgctcaagctgccctcgtcagagtccagcaaggttcccttgccagtctcaccggtccactcgttgctggaggaattcttcaggacttttaaagacctggatgaagctacagtgagaaaaacacatttcgctgtgatacagaaacaggttacacaatgtgtaatgtttgcctcaaagcttgtgtaagatttaacattaagattttattttatgatatgacttcagttagcaactatcctggtaattaggcaaaaatgtagctactgaaaacatggacatttttgacttaggtttacagttgtaagttaggcaattcagcatttttagattaccagagctcaattatgtaaatagaactagacactagaaactactacatgggctaagattcttattttgccaaggagtaagttgaaaagttaattggtaataataaatctaggctcctttctttcactaaggtgctttgtaatttgatcatgaagatcacaccatattcctatgcatcttctcaccttgtggatttcccttgctgctcaattaaaagtagaaaatgcccctccccccccctttttttttaaagacagtgtcttgctctgccacccaggctggagtgcagtggtgtgatctctgctcactgcaacctccgcctcctgggctcaagtgatcctcccatctcagcctcctgagtagttgggactataggtgcgcatgatcacgcctggctaatttttatattttttttgtagagatggggttttgccatgttgcccaggttggtctcaaactcctgttctcaagagctcaagggatccacctgccttggcctcccaaagtgctgggattacaggcatgagccaccatgcccagcctagaaaatgctctttatctctcatatgagaactgtctctgctggaatttcaaaacaactttctgaaattttatgttataggtgtgtgtgtgtgtgtgtgtagttctgttctcttggattgaaagaaggaagggagttctcagttttggtgtttctacaaagtaataacagcatgttattttgatggccagtttattttgacaatggagaaaatagtaaatatgtggtagatctgaagaggtcacactgatttgacatgaaaaagcgaagttttacattttctaagcctaaaaacaagaaagataataacaaaatagttaatgtagaaataaggttctgaaaacttaagctgaaattttagaaacaagcagaaagaacaacgtgatttgaaatgcttacttggtgccctatcgattaagaacgagtataagaggccccttaacttagatggcattacatcccaatcaacccattgttaagttgataatatggaaagtcgagaatgcatttaatgtacctactaaccactgcggcttagcctagcctgccttcagtgtgctcagaacacttacattagcctatggttgggcagaacacaaggcctgttttataattaagtgttgagtatctcatgaaatgtattgaatgctgcactagaagcaaaaaacagaatggttgtctgggtactcgaagtacgatttctactgaatgtgtgtcactttcacaccacggtaaagtcgaaaaattgtaggttgaaccatcagaaggtggagaccctctgtgtaaggttcttgatcttcattcagcattgaccttcaggatgcctggcactgttctgagcactgggaatacagcagtgaggaaaacaaagtccctggacccatgcacatcttagtggaagaaacaaaatcgtacatttggactatgtcagcgggtaggaagacaagggactgggggttgggggtggctgtattttacagtagaacgtctgggagcaagaggcatgtttaggtttcttaaaaggagataaaggtacctcgatgacttacaaagtgaaaagtcacagctatgttacaagagcatatatccttttcagaagctcataatattttgttgaataaacacaaggctagcaaaattctcacctaatttggccgaaacaggaactcggttcttaagaggtaccaggcgatccttacacgttttctccagtggtaattcacactttatgtgacgcctgaagttctccctcagaatagaacgaatcaccttaacaatgttggttttgctttcactgtcactgggtggggggggagagaaaacagcagaagtgtccacagtgttcatcgtgcttccattccacgcccgcctgtgttcctgtgccttgcacctgctggaccaggctgccagccagccacccagcagcagtgccatgtggcctcccgtacagaaggagattttcctccatctgaactgccttcaccctctctctggagcccctctctggggaagaggagattcagtggatcctattcttcaacctcctttgcagttttgccctttccttggaaggaacaggagctggggtacttgaggtaaaagaggcctgccccaaatgtggtcattttctcgaaaacataagcacttctgacaaaagttaaacagaagcccagcaggtcactgcatgactcagcctgctggcctcttctgtcaccagatacctgtcaccaaaacaaggttactctggaaggatctctgaacattttccagagtcaaagatttttttctttttatatcacctacagtactacctaaccttaaggaattttctgctatattctaaatttgtaaaaacataaatttgtggatctttgttcttctaacacattttagggtatcaaggcagaaaggaaaatgttgaaaactattgatagggaaaataaggaaacaatgaaaggcatttggcaaagaaaaagctatccaccagcatttagtttctcccagaagtctgctaaggaacatcaaaacaacctctcttgtcctcattttccttgtctataaaataaaaggcaccaaaaatta

SEQ ID NO: 2092 - DNA, 437 bp, Homo sapiens
aggctcccagactctgtagtgaagaggcatgtaaagagacaaatgagagcatgccatgcaaactgctaaagttagcctttgcctttttcccagagactctctaggaatttttcccatctgctgactaggagcattcaaattctcagcacagaaggttcttgctgttttgctgcaccaagttcttggaaatcacatacagatccccctaaaggagattggaacagtgcaatatttggggactgcattctccacccaaggatttagcatcaaatgaaaaacaggttcatgttctgacaaggtagtcacaacatttggccattttcttgggtacaagctaagacctcagaagacattactgatcaacacatcctgtttagcagtagtgacagaacattgtgcattaaaaattcaatgatatttaactttgaaattataaa

SEQ ID NO: 2093 - DNA, 1887 bp, Homo sapiens
gcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaa

SEQ ID NO: 2094 - DNA, 19275 bp, Homo sapiens
ccttcagttcttaaagcgctgcaattcgctgctgcagccatatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaa

SEQ ID NO: 2095 - DNA, 552 bp, Homo sapiens
ttttttttttttttgcttgtgcttattaaatagcaagggtcatctgtcaggatgttgtggtggtgtgtgatcagagcagagggcctttcttttcctgtactgtgctctacttccttatgcatgcttggtttcaaagatgaccgccactttaaaagaaagatttcctcacagctctccagagaactatcatactaaggtgataggaaaggcttctcggatacaagccaacaagtcagttttctgattacagaaactcctctcacaggttatgtttggaaaggctgttctccattccacttataaattgaaagtgataagctactgtcttgtgatcttgcagggccagtggttgactcatctctgaaaggtaacttcgttcatatctatgtattttcaaacctggaagcttgtaaattggaagtttcagtattagctttattattctttcttggtgaggaatagaaatggcagcaaaaagaaagccaacaatctgaaaactccagtctcctctaacactggctttgttttaaatcaagatgggaagagatacat

SEQ ID NO: 2096 - DNA, 497 bp, Homo sapiens
agtcctgaaaatggaaaagcgtctggagttttgggtactcccaatgccccaattatccttttattaccctgatttacaacataacttcataggagacgttctgatgagcaaaatgacttgggtaacaaaatgatctggcaaaaccagcaactaaggcaaggacacaagaagatggctgtctacaagccaggaaaagattctgcaccaggaactggatcaactggcaccttgatcttggacttcccagcctccagaactatgagatgagaaataagtgtctattgtttaagcctcccagtctatggtattttgttatagcaacccaagatgacaaagacaacaagcctaaaatgaaaaatggcaaagtaaccaagatgtccttcaagagggctgtttgttgtccaaaaagcctttttccctaagcttgaaagcttaacttctcagaagcaggaagctgccttttgccaagagtaaatgggtgagaagtccaaaggtct

SEQ ID NO: 2097 - DNA, 509 bp, Homo sapiens
tttttaaactatacggtgggtacactggtgttcttttattgttactctttacacacaaagaacagataggtcctgaagggccctttgatagtctcgcagcactgatgagtgatcagctctcccctctttctctggaactcggtagcttcatgttggcacctatcacagacgctgaaggcatttaaattttattttaaatcaaccaagagcccaaaaacccaacccatatttcgaaaaaactccaaggtgtactactcttgtttggttctgccatcctgccaccttacagtccttttgtttttcctattcttgcaggcaagtgcaaaacagtggtttttggaaggcaattcataattactctgaagctatttcggcatattttttactgatttttttttttttttgagacagggtcttgctctgttgtccaggctttattttgaatttctgttccagatgcctctccacagcattcatcacaccttccttcacacttgaagggaaaagtc

SEQ ID NO: 2098 - DNA, 463 bp, Homo sapiens
ccttctttcagaataatgtgaaatttcttttaaggacaagaaactttagtgtctagttggtaaatgacataggtttgaatctctttctaagagttgtaattgatgataagaatattctgtggttctttacagggataaattgtttagtttaatcagagtggtggctctcactatccataagtccatgggcaaaagtgttgactaatacgatcatacagtgtacaccagccaccttacaccatgcattgttgagagttcttgctctatatttgataacacttttcaaatatgccattttccgtgattataaaattgcttaaatatctatataatctttcaaaataattttcctacaaatgtctaaatttctctagaagtacaacatatacaatcagatttacttggaatggtcttccttagtcagtcatgttttcctgcaaattaaaatggtttggacaacaca

SEQ ID NO: 2099 - DNA, 1282 bp, Homo sapiens
gacccaggtggctggggtggcagctgatcatgtcaggaggactcctctgcacaacatcacaagcacaggagagaatgctaaacttgattgggagctcacagaagacccctggaacccagagcaataagggaaatttggacccagagatacattcagagagaagatgatgtgaaggcacaggaaggatgccctgtgaacatcaggaccaatgcctgcaaacctaggagagaggtctacaacagatccttccctcgcagccctcagatcgaactgaccctgcaagtaccttgattttggacttctggcttccagaactgagcaacaataactttctgttgaagccgtccagttttgaagccacccagtctgtggtgcttggttaccgcggccctagcaaacttgcctgaggctttccaaatcacagccccgttttgtcacaggggaagaattctaagaagttctttatttggccaagtgagggatagaagaataatgagcatttccctcatcacagctctgacaactgcctcagccacacacggcttaggagattggccacttcctccgccttcagcttgcagggggcttcagtaataaatgtgtagaagtgtttggtcttctcaatgctgggaatccagggagtatggcctggcatacatggaaaccagtcccctaaagacctcattgacacaggcctcatttgggggtctcctcaggcacttcccccttggctcctgaggccagaacccgaccctgctgtgtctctcttccatgcatctttttgccatctctgctctctggaatctgcaacaatatgagggtgctcaggactttgatgttgctactgacctcagcatgccccagtccaaacctaccttcttcctcctgggcccacatccgcttctgctccccacttccccagtgtcttcattcttttcatcacatgctgaccaaagactcatctttaggcactctctatgtcccttctgctacatccactctgttgccacatctcctgaattcttctgtctgatttcttctcactcttcctttccaccctggatcagtccattggggccgcatgtcaggacaccggatgacactgtttggacacctggaaggatcgggtaaaagatacagagaagtctaaggagggatagggtgagtctgggatgggctgtggattaggcaccaggtaaagctaattggggggtgggtgaggaatggggtgagggtatctattgcatctattttatggtaataaaaggaagttgaaagttca

SEQ ID NO: 2100 - DNA, 4216 bp, Homo sapiens
tatatgtgaagtgggcggttgtaaagttagctttctcttcatttagctgtcactggacagaaaaatatgagctgtgggcagatgcccctggatgagagccagtagccagtctctggcctctctgtgccctcccctaggagcccccgaccccgccatgggtcccctcctggcctctgccagcctctcccactcttgcttcattgacctctggctcacctttattttttctcctgtctcttcccacttctggtttctttgtttgggtttatcacagatcctttcctcttccctcctttcatatttctaagccctctcaagagagaagaatcatatttttcctcaaccatcgctctatctctggcacccagcacattgccaggctgagttggcactcaaaaatgtttgtagaacaaactactctctctatacatctttctgacttggtggggaagaaggtccaaaactttgctgatgactccttggatgaagaaacttctcatacagtggtgtgagccctggagtcagaatggttggcttgagccccaatttcattactgcctggccaggtgaaggagattctgttcatcagtggcagccagggatgtctctccttcctaccctgactctcctctttctgctgggtcccctcccggatacagggctcacacctgtggacctcagagccagcgtcaagaccaagaggaaagaaatcaccaaaagccagacccttgtatagagggaaggggaaggaagggagggaagacagactcctctggggatacatgcgactgtcttggctgggaaatctgatctggtgggggactcaccccctcctctcgaatcagctcagccctgatgtgtctttgtgggcttgggtttctctgtgcctgaaagatgaggcgtggggtgggggtggccgggctgctggttgaggctgaattcttctgagcaatgtggttgtgtttactgggagggtgggagggccagacctttttcctgccttccaggcttcggagataaggcagaaagtgaggatgaaggatagaatgggtaatactctgaaaccacaagaaagagttctggcttttgtctctgccccacagctcagacatttcctggggcatctggaaggaagctgacccactcccaccaccctggggtcccagcccatggggagcacagaacctcagtgggcacccctttcttccattctacctcctttccattgtcagtttagccacaaaattattttagcttttttactgccagtcccaccctcagttttccctgccacatgagcccagccctagagctgagcttttctccctgcctcccagcacagccaaagccacagagaccctaggcaggtgacagagcccagcctggcatgcatcggccttgagggctctgctgcaggaccaccttccccttccttgctggcctctcaggggtcgtggccagcctgcatcctggacacagaccagccccaaagcaaccagtgccaagccctggggatagacagtcacctggtataaaaaacaccaccacctttattagaatgctgggcagccttttttttctctctctctccttttttttttttttaaacaaaaaaaacacaaaagtgtctgtacaaaaatggggatcaggatctcagtctgtagaaatctgttttattcttaccaacatccaatatcatttccatggcatagctctgggctggtcccgtggaagagattccaaatatgtggtgatttctggtggaatttctgcccccttggaggggaagatgactgcatggcatgctgggagtgcaggcacatggcaggagtgagggtggctggagctgaggagccagtgtgcctcagtctatgctgaccttggcctttacaccctccttagtgtcagacaccagtgcgccccctgctggtggggaggggaagcagggctgactccaccccatcatgggagactcccttttggtttccatctcatcatgaagagcttcagtccacgcggcgttctcctcccattttcctgggttccctgaacgatgagccaagtaagctgtcttagctggagagatgacaatggacttggacaaagtctggaggaagcagggcagtgtctccctgcctccagcccagagttcaggtgaggggactcagtttgtggtaggaagagtcctggctgcttcgaagccccttctcctaggcagccccaccttgttctaagagaaaagaccctgtaacgtgttccctgctgggggctgacagtgccagctgctctcgcagcctccagaaccatctggggcttggaggcagaggtgggctgggagcgactgggaatggaaaaagaggtgggcagctcattctgcaggtccatgcaaccgatcacgtggtccagttcagaaggccgggtggctccttgggctttaccctgagcgagacgaggcttggagacttatagtcaccatctgaggaaggctcaaagctgtggccccccagggtggggggaaagccatggatggagtagatgccagggtgagccgcagaaggggctggcacccccatgaagccagccacactcccatgggggtgggaatatggagacatgcatggggaggggatgccctctggagacacaaggcaggggcctccagggctcccagatcctggactggcccacagggagttctgcagctgaaaagagagggaaagaaggcccatgagcctgtagcctcaggagctgacttccctacccaggggctttctctttgtccttggggccccagaaactttccaggaaacctccacttggctcagatctaccccctctcacccccaacactggcagtggcatctcaggaggcccctgccactgttctcaaaacgaaattttcttctgtgattcctttgtgttccgcatgcgtcattcatgagacaggcaagagccccggtttgcagagaaagaagtgaagtggtgtacccactgtcatacagaacgctgacgctctccaggtttcttcaggccagacctcatattctttttggtgaccctgccaggtcctggttcaggtagggctggggtcttacctgagggtggctgtcagtacggggcagcacagagatgtcataggcagccgtgaaggggttccgcccctcctggatcttcccataacgctcgcgcttccgccacttggctctgcggttctggaaccagacctgggggcaggttgtgggggtttgagggggtgatagggcagccctgaggaaaggagcctgctagggagagctgatggttgtgtcctcttgtgggatggggagcaggctccaggatggaggatctcaactgttaatccacactgttctccaggccagggaagcctgggaggaagcctgggagaggcccaagcccacagtgggtaattggccccatgggcctccagctgtcactccccaggttgaatcactgtggtcctccagcctggctgtgtctagtaagggtgttgtgggggcatctgtgggcctcaggggccctaggtacttcctgggtatactgtgtacatgtgttgggtttctagtctccctgcctcatctccttttccaggctacccacctcatagcatccgaggaatcttagacatttctgttcaggtcatggtcctgtttaaaccctcagtgactccctggagaccttggtccagagcatagcttcttaacaaggcccctgcctctctgcacagcctcatatcctgccaggcaaacacatttattcttctggttgcctcccaagctcccgcccagctcttctgaaacactgctatcttgctccttccatcttttgcttaggttttctcttcctgggctactcatcccctcaacacatacatccacactgggcatcctccacaggacttccaaaataccctggacctctctttgtactcaccccattccattaccatgatctgttttggaatctgtttctcccatttatttgtgagcccttggcagataggggtggcacatctgtgtgttgtgcacatctgtgtacatatctgtgatgaattcgttgtttggtatatgtgctgtgactgttacatttaactgtattggtatatatgttttgtatttctatcatttaatcaacatttatgtgtcagcctctaagctaaatttaacaatgtcaaaataaaaccaaccaaacaaaacaa

SEQ ID NO: 2101 - DNA, 282 bp, Homo sapiens
aacaatgaaggcagagaagccagtggctgctttgacatgaggcttcccgtgtgggaggtgaaccagaagccaagcctggacggagactgtgccatcaagaggctctgtcacgagatgccaagatgagcacgcgtctccaaaacaacacaatctcaacatgcaaaatgatcaccaagcaagaggaaacagagtgagccctagaggtgaggaagttgcctgaattccatctgtgtgcccacatacacaaagctctgttacacaaaggagctactccagcgacta

SEQ ID NO: 2102 - DNA, 675 bp, Homo sapiens
aagaggagagagagagagagagaaagaaaaacagaaagaaacagagagaaaggcacagacaaagccctcctaccagacagcagacagctctccttcccctatccagcaaaatgcaactcgtctaatgcagcaacaggttcagtattgccagactaacagagtgaaaaaggagaagacgtatttggtttctaccagcaggaatcaaaaggaatataaaggaccatgaaggctcttttctaaaaaacaacctgagagctaaatttaaaaggaaaacaaatcttttggcttaagtgaaaaatgagaccgggcacagtggctcacaccgtaatcccagcactttgggaggccgaggcaggcagatcacaaggtcaggagttcgagaccagactggccaacatagggaaaccccctctactaaaaatacaaaaattagctgggggtggtggtgcatgcctctagtcccagctgctcaggaggctgaggcaggagaatcgcttgaacccaggaggtggaggctgcagtgaaccaagatcacaccactgcactctagccttggcaacagagcaagactccatctcaaattaaaaaaaaaaaaggtgaagaagaagaagaagaatgtacaacatctcaaaacttttcccatatctgtacattttactagattcaaagcacaat

SEQ ID NO: 2103 - DNA, 1144 bp, Homo sapiens
tgtggatctgaaaagaattttctcatctaaaccagagcttcagtctcccaggatcgtgaatgtctgagaataagcagatgcagcccttttcacagaagggcaaggtccgcagctcctcggcatcatggcattatttattcatcatgagagccgcgagtgaacatgtaccctgcagaaaaatcaaatcagtgttcggtttctcgagcagctgcgtttggcagagaaaaagcatttggatctaactttggtaactggacaattataggcgttattaaattggagatgcaaatgagtaaccatgttttcttccgagtttgttctatttcacttgtagtgcttaaattaaaaccagctcagcatttgtaaaagctgattcctgaaagcttagaaaagttctgtgcttgtctatataccagtagtttcactaaaaacatttacatattagttaaccccaaaggaccaaatttgcatttattcatgtttacaggtttcaatggttttagccctgaagtcattgtgtccttagatacctaacactgaagatttgctcacaggtggagattcagatagaaaaaaacacacaagcttagaaatgttaataagtatctctatgcattataaaaatacctacagataatttaaagcctgagtaatttgtttatatatttcccgatttgtggaatagactaatattacatcatagtccgagaactttttataaattgcctagtttttaatttcaattcttccatttacaaactctgggaccttgaacaaattattttacctcagtctcctcactataaaatggagacaataatagtggtacctcttaagttgttgaaagcgttaaacaaatcagtacatgttaaataaattaatatacatgcttaggataatgcctgacagtaattgcaattctgtagatgtgtgtgcatatgtatagattgaatgtagttttatcaaacagtaaattggcatataataataatccctcattatctgtctacctttccctccatatttcagttcaatagaattattgttttattcactttgtagtccacaacgcttatcgatttgtgttgctgcaacatgctagtgtacattttataataaatattgtggcttttagactgttcaa

SEQ ID NO: 2104 - DNA, 593 bp, Homo sapiens
ctggtgcaaacaaccttgaagcgggacgcagccaaagaacacgagatgccatttctcagcccaattggaaagaggccgggagcaccagttccctgaccccctcagccccaccgcctgccgccccctggtactgaccagctccttcttcctcttctcctctttcacgtcggtcttcttgatctctgccttgaaggcctccgcctcgccattctggtcgtccttggccagcaggtccatgagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgc

SEQ ID NO: 2105 - DNA, 3108 bp, Homo sapiens
gcccagcgcagccccggccgctgggcgcacccgtcccgttcgtccccggacgttgctctctaccccgggaacgtcgagactggagcgcccgaactgagccaccttcgcggaccccgagagcggcggcgcgactcaccgcggaggcgcccggacgcgtcaagtgcgtactttcaaccgtaaatgggtgctgagcgtttaggggtgcggggcaactccctaactcgtggggccctggccggccctgccgcggcgtccgagaccttctgatccctcgctgcgcgcggcgcggggttggcgacttgggctcaggggcggcggggcggggaggtgccttgacctagggacccagaggccgggagcaagtctcctttcgccttggactgcagtgtcccccagggcaaggcctgaaccaggtcgcgagggtctgtctcccgtctggggagctgaactgcccgagacactgtcgcagtcgcggggacttgtctggagcggcggggtctgagcccaagtcggaagccgccgccgccgccagcgtcccgtgcgcctgccgccccgggaccagccgcgaaacttcttctcgggacggagacagcgctcgccgcccgggccgaggtaggagctggctgggctcggtagagcgcgggcgaatcgctttcggcagcgaaggaacgtgtcgggagaagccaactgcaggaccagggccccagcgggcgcgcagagacgcctgccttgggcggaggtccccccctccggttttcgtggctctggtagggccctctgtcccgtgagctcctcactggacctgaggctacaggcttcagcaggtcaagcgcccgagtgtgcctggaggattggcggcggggtggcatgagaaggtggcccctcttctccatctcccagtcaggcgatttctctgctgtctggggcaggggcgcacaccccaggaacttactacgtagagggaagccagcctggtctctcccccttgcgtcagtgctcctaagctgcccctcaccactctgggtaggggtctttcaggtgggctagggaattctccttggaagtccccttgtttgctcccctccatcagggcacctctgagttagccaatcatcctcttttctggcctcttttttgcggggaggagagtagagagagaagcctcctactcggcaggtctctgagaggaggtttgggggggcttctgaggttgctcctcctgggcagagtcaaggggtgttgagggttccaacttttactggacaatctctcaagctctgattccctgatttctgggaggtgtcagtgtagggcttgtgtcctgccccacccacacagcatttggtgcaggcacatgggatggttccccaagcccttttcccacagttagtttcagaaaatgcataagccacctaaggctgggagagcctttctgtgctggctgagatctggtggcatgtgcatgcatatgtgtgcaagtgtgtgtgtgtgtgtgcaagtgtgtgtgcgcatgtgcatgtgtgtggaaagtatggtctgggtggctgtaagactggcccctcttgtcccctctgcaggcccagcccaataggaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggtgaggacagacccaaggtccaggcaatgctggcctttggaacacagaacctggctcactgactcccactccagttgtcttttccctctgcctctggagcaaccctctctcctccagagcaacccctgtccctccttcctacctctctctagggctgcacccccagctcaccttagacctggcccttcctacctgttgcccctactgtcttgtcccatcccagtggtcaggagggagagtactggccaaaggcccagctccacctgtgacttaggggagtgccaggcatcacccagaggtcccggccctcgggggcctggcaggctctgctgtgggggaagcagagttagaactggggctgcttctcctgtcccccagcctggctgggcctcccccacctccctttctgcctgccctcttacaactccagcagggggcgggcaggggaaagaaaaggagggacaagttggatggggtccatttggtgtccaggaacaacttggagagaggcggggaggggacaggcagcagggccctggcagagccaggggagggctggcctttggatggccttctgatcccaagcccatcctcctggggcagtcttcccttgaaagggagggtttggtgaaccctggtgcggacccccccgccggacctcactgccccagtgcggggcgtggtaggcgggtttgcaatgggtacagcctctctctccattccagtagagcagctcccagggcccagagaggctgtcactgagacttccctctggggtggggtgggttctggtggccctgtgttcccctgcaggaggacctcctgaggcttcgggcaggagctggtgcacacctggaggagagtgctggtgaatggcaggtgtgtgcctcagtgtccttgctgccagggtgtcagccctgcttcaccactggccgtttgtctctgtcccctccactggcctcttgaagcacagagaccctccgggtactttccttcctctgggcttccactcatgctattccctgctccctttttctacctggagacccccattcctcctcctcctctgctgccctcacctccacctgggccctcccagctcccgggagatggctgaaccccactccccacccgctagtcatcctcttcagcggtcctcccagagctgtcctcagcatggcagcctccacagcccctgggtgtcacccccggtttcgtgtctgcctcggactccagacctgcccctcccaggctggcccagatggatcctctacagtgactaacccaaaccagcaccaggcagggacccaataaacctttgtgaatgga

SEQ ID NO: 2106 - DNA, 594 bp, Homo sapiens
gcacatgttgatgtggttgatgtgtaaaaaagccaactcatacaaggttctggcttcatctttataaaatagtccggaaatttcagagaaagatgaatctgattttccaagagaggacagctgtggactatctggcactggagactaacaggacaaaataaagaaaacagactcttcagcagtataaagttttcatcaagtcaaatatattcactttaaagtgactgtgctttattctgataccatgtccttcctaatttggggggcacagctggagaaaattcactggcaatggaatatttaaaattagagcttgcttagtgtgctgcttctgatcactacttgatcccacttcgtgctttcatgttaattggcccaattggactctacagttggaaggtgaaaacttactatttcaacttgagtcacgtatgtattcttatcatatacttcttaaaggtactattttttttcttctgatagtcaccacaccaagcacttccagccaccctgccacagacttcctttgtaatcactgttgaaggacatgatgtttttatgacttcccgaaatgaaaaccctatcttgttttta

SEQ ID NO: 2107 - DNA, 1419 bp, Homo sapiens
ccgccctcctcccgaaaccggccggggcgagtggctgcaagaagctgcggtttggcccgcgggagaggggggcttccccgctggggttgtctgacgcgaacgccttcctggccccagccaggcgccctgagagagctaatgctggcagctgttgggatgtcctcttccaggaatggtgatgagtttccctggatccagccctggcttggctgagatgatgaaggtttaagaagcagcatcatcagcgaactgtgttttgaagatttgagggaagggctgacctcaggattttatactaggtatttgatgcaatgcagactggaatcctccccacaaggatgccctggcctgagtggcacagagatcaatgcagcagtcatttcctgggcggggaaagcccatccacagtggccctggaatgatgctggtcttaccttctattcctaggaaggccctatctcaagtggctctggtccatgcaaacagatggaaacgggtgtggggaagcacaggcctcctactcatgttaagagagctgctcagaggcaggaatccagaaccaggaatgtccccagtggctgcccaaggtacaagtggcaggcagcggggagaatggcatgtgaagtcatttgtaacctggccccagcttggtttccaagtctcagaggagattatggatatggtagtgcctggctcagtgcttaaaatccattctcctgctatttccctcacctacactcagccccacaagccgagatgtttgctggacatttcaggcactgccacccagttctgtctaccttacctgctaacacctgttgaccatccttcatgtgaaggcttccccaaatacttcccaatcaaaacactaaaaggcagacctgaaattaataaaaatgttaattaaatctgtacaacagaaagcataatgccagtctttttaattatgaaatgtagcattcatataaatttcattgcttttgaaaacaatctatggctagattctcctgggtttgtatgatgattactgaaaactgtagaaaatctaaaatcaagcaagttgtttataggcaattactttcagaagcaaaaattataaaagaaccatgagatttttaaagagaaaaaattacatttgatatgagataatcatgcattttaagatgtttaaaatgacatggagtggggtccccagaccaggagagctgagggcttatgaaggacctaagggagtgagacctgttatgtaataagcccccattctgggggcagcaccacagaggcgggaccccagaagtagaagaagagccctcctgcactgggtggtgaagttggtatcagcccctagtttgtgaccctggacagatttctctgctctccagccctcagagtcctcaataaaacaaaaacatatgcaaa

SEQ ID NO: 2108 - DNA, 412 bp, Homo sapiens
tgcagaccccgaagaaggactggctcctcggtgctgatggctgtccttctaaaccagaggggagtccaaaagcttcagtgcaggaggaaggcagtgagtgttagccctgacctgcgctgagccctgagaagaaagcttccttcgcccgcgtcctcccgctggctgagtcagccaggaccctgctgtgcgaggtccatatggggcaggtgcatctgccaacacggccaaactgaaggttcgctcgcaccaggaccagtcgtgggtgaactctttgcacgctcttgacgtcaggtctttgtggactcagtgggaactgagaacaattccatccgtacgacgtccagatgaaccttgctggtcggagaggaaacttctgaccaccccgagctgagctttgtgttcctcaggcccc

SEQ ID NO: 2109 - DNA, 1991 bp, Homo sapiens
ttgtcaaaatgttaccattattgctgggattctaagaaatctctacaaatgcctctgatgacatcagaaacaattggttctaatcctgtgaactctcttgtgaagaaagcatgagactccttcggtttagaagccatatctttcaggtcatccagaggtgcccaagccacaccaacagagaagatagtgattcctacaatgaaaacattttaaagtgaattgaaaatcaggtctagctaatatatggaattatgtctatatgttttccatacactgttacatagttgcagcgaaaactgcttactaatttctggacaattaaatcccctgaacaaattaagttttcacagtcattgtgacgagagtggcaaaagagtggtccaaaccagaaactctgctatatctgtaattcgccacattaacagtaaatgcggatggtgaaaattttccgtatgaggttggcctgcatcaaacagtatactggagtcagagtcacaatccattaaagcaaggaagaatggcacaagagatgggataaaacaaggaccttacctgcatcatgtgcagcagctgcagggccttggacatcatcataggactgcccatctgtgacaattactaggaagttcttgttggggctctcccttatagggccaaacacatttctaacagtgaaggaaatggcatcaccagtagctgttccaccactcatatagcggatgtttctgatgacagctaggacattctctttggtgctatagtcagtgaaactgaactccgtgcgctgatcataagtaaactgtacagcagctatcttggcaccaatgtccgagatttcaaaagtcttggctatgttggaaacaaattcaagcatgaggcggaaattgctatctccaacactgctggagccatcaattagaaaggcaatgttcactgagttataacaggtcttgctgcacatcatttgttcatgagtgcacagcttctgtaccagaggctttacgtattttgtggtgccaaaccagttgggcatgtggtaagagaagaagccattattccgacagacagcctaatgggggagacacataaaagatatccaaaaggatcaaaagttgtttcttcttaaaaactggaaaatcctgaatgtttcaagttaatctagataagaggcagtcagcactgcacttagaggtccaaaatggaatacccatcactgtaacagaagataaccctcaccactttaccttgtcaacaaatgtgacatcctgaaccatccccagttcttcagggataggcttggccacagaaactataaatacattgacaccaaactctctggccacaatgcctgcttcctcgatgtcatcagaaggccaaccatcaataaataccaccaccactttggggatcccttttcttactccagcatctaccgtgaagaatttctgagcagtatcaaagtctacttacctgtattggaattaccccctctgaaacctacttcctttatggcaaacaaaacatctttggctgatgtaaagtttttcaagtaaaattctattttgggatgttcactgagtggaagaaagaaaatgttattcagggagaattaaaaagatgagaaaattaaagccgtggggttaatttgcccaaacaacattctacaactcccgaaggacagaaaacagaaaagtgaatcccttcagaatacagcatttttatcttaattgaacctgattatttctgctccagatctgtccagtgagatttatcaagcagcggatgcatttttagaaagcactgttaatattctcaagttttacactgtcaacctaacaaagaatcagtttttactataaatgatgctaggaagagacaagctcttggcaacaagtaacaagataacataatacaacatgttaatttgtgaatttactgtcgatactaaattgagattaatgttattaaatgctatttttcaaacatgggaa

SEQ ID NO: 2110 - DNA, 2232 bp, Homo sapiens
gtgcagagcccaggcgcgtgggtcggtgtcgggtgtgtgtgtacgtctgtgtgtgtaatgaaactggacgccttccttcccggcgatcttgacttaacctgtcagcagagggcttgaggttagaccacaggttgaacctaggtggctgctggagagaaacactctgtcttcctgctttgaggacagctgaagtcttgccacttcttctggatgctctgaccatcagtaagccacctcagtctcaccctccgcagaatgcaggcccactccgttgctgaagggcctcctccttgggccagggcgcctgcttctgccagtggcatcatcaccccactcctcagccgccagtcatcagagacacggtctgactttgttaccccggctggagtgcagtggtgcaatcatggctcactgcagccttaacctcctgggctcaagtgatcctctcgccaaggctaggataagtagctaggactacagatgcgccccatcacgcccagctaattttacaacttctgtagagatggagtgttgctgggttgcccaggctggtcttgaattcctgggctcaagcgatcctcctgtgtccggaattggtgggttcttggtctcactgacttcaagaatgaagccgcggaccctcgcgagtctgtatccaccagctactcttccagattcatgaggcaaggcctgcctgctcacctggctggccccaagcacctcttcaacctgttgccaccgtcctgccttgctgcccttctcagctcatccagcagggtctccaagtcgtggaaacagaagcacatatacacacatgctcatatgtacatgcccacagtcacataagcacaccgagaaacaccatcgcagacatgttctcacaagcacatgtgcataacactcactacccctcacgcgtatacacattaatacacacactcatgcacactcagtcttacacacacagacacacagccataatcactgttgttggttgaattgtgcccccccatccccaccaaaaagataagttggagtcctaacccccagtacctggggatgtgaccgtagttggaaatagggtgtttgtagatgtaatcaaattaagatgagatcttactggattagagtgggccttaaatccagtgactggtgtccttataaggagaaaaagatttgaaaacagagacatggagacacagagcagaaggccatgtgatgatggagtcagagattggagtgatgcagctatgagccgagaaataccaaggtgctggcagcccccagaagcaaggagagaggcaaggaacaatctccatcagagcctctggaagaaacagactctgccaacaccttgatttcagacttttggcctccttcactgtgcgagaatacgtttctgttgttttaaactactgagtcaccaagtctgtggtactgtgttatggcagccccggcaacaaatccaatcacacacacacacacacacacacacacacacacacacacacacacacacacagctggctccaggctcagtgatgagctcagaggagttccccttgggagctgctctttctctgtcttccttccttagtgattggtccagtggatccacaaaagctcatggcccagagcaggagcccagtcatttttaattcctcttccctggagttcttaaccatgcgttgccctcaaaatctgctctcaagatttgggttgccatatttaggagcaccagaaaacatacaggaatgctgtgtctgcttgcatcatattaattaaaaactggaaataacctaaatgtcccagaataggtacataaactgtggcatatccacttaatggaatactactcagcaatacaaaaggaaaacctagtgttacttgagcaacatggatgaacttcacagacataatattgcacagcacgaggcagacacaaaagtgtgcatatgctatgattccatttacatgagattcaagaacaggcaaagcagatctatggggatagaagtcagaatagtggttacctctggaaggtggaattgactgggaggggcttcagggaacctcctggggtgctgaaaacattctgtgcttgcaccgggtggtggttatgtgggcattacataaaattcaccaagctgcacccttaatgatttgtacaatttgatgcacaaatctaacatctcaagaagaataaattttacaaagtacctaagaagcaaa

SEQ ID NO: 2111 - DNA, 665 bp, Homo sapiens
agctatgcgcctcgtgcctgggagccttagggccacacggaagggtagaaatcagtttcaggtcaggaggtctggaacagctttgttaaacccagtttttttcctatgaaaatggctgcagacactgggggagggagagggtggccctgatcccgatgactctgaaacatgcttggccttccccagagattcctgctcccagcccaggcccagacggcaacagaagctcatggaatggcagactctggacatgctcctagagatgggaggtcaaaatgatcaacgttcagggtcccttcatctcagagggtctcgagtcacctcatttaaagtgtggcctgggacacctcctatccagccatacgccgcccaggactggctcaacagctccaccctccactgctgttcacccatgacacgtcacttcccacccgccactgctggctcacctgtgacaccccaggcagctcagatgcccggcaggtcctgctggtgtgtgttagccggggtctccaaagaaccagagccagcaggggacacacccatctctgtatctggagaaaaagatcgatgagaaggaatctgctcctgtgatgatggaggctgacaagtcccgagagccacggttggcaccctggagacccctgagggtgataccaccactc

SEQ ID NO: 2112 - DNA, 152 bp, Homo sapiens
gcccagggtatgttcacggggcgatgctgccctcccagctggcccatgggtgaccctgggaacattaactgcctcacaacgtttgtgcctcagttacccgtagatgtagtgagggtaacaatacttactctcgttggtgataaggaacagct

SEQ ID NO: 2113 - DNA, 5444 bp, Homo sapiens
taggagatgataaaaatacatattaagtaatttgtaccctgatatgctttgtatgtagattgcttacaactaacatgaaatgagcatttcattccttaagcatgctgttgggggaaaatgggagccaggctggatgcacaaatttacaccagatgctctgtatccaggtagcagaaatgactaacagcactggtatccatcagtcccagagcaaaagcgtctccagaggaggacatctgtaaatcccaaatctgatctccttcatcatcattaggcaacagataggataagacttcatgaagagaattttggtggctttagattgttgagaaagtatatataggaaaaaactggaaattatgtccaagattttttgtctaactccttatcctgatattgttaacatttcacaactaaaataattttaacagacaattagtttttaaaaatgtattttcatgacctgagactacagaaattgccattttcttaggacgtagtttacatttgactctgcttactgtgtccagggcatccccaaattgggagagattgccaagtcagttgccattttgccttacttttaccaaggactagcctacaggttcagttttgctcttgactttggccctgaattgagaactgagtcaagagaacagagtggaagtatggagacaaagccagcagctttactcaaaaaatatatatgagtctagtattttttttgtttttgaaagacatgttactgagcccaacccagtcagggatcactgaatattgggttaaataaaacaataatgttattcatgtgtttgaaattaatgttttaaagaaccacgcacacactttaaaatgtaactggatttgctatataggccagagaaatatggctgttacgatgaaggcgtaacttctctggttcttgattatttacaccattagagaagaatgcaaatatgaatagctcagagtagtttaactttgaagtgagagtttatatgcacctttatatgtgggataactgatgtctttggaatagacttcaaatgaatgataaaaacacctgtaaagtgataggacctctactttttctcatgtccaatgttcagtttcttataaaccaggcatgaagagaaacaaaaagtaattaattctccagatcatgaagttgtcttcaacctaagcacagaggtataataattacatttctcagaagttccccctctgttttgagtctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccaggctggagtgcagtggtgtgactttggctcactgcaacctctgcctcccgggttcaagcgagtctcctgcctcagcctcccaagtagctgagtctacaggcgtgagccaccatccccggccaagcagtatctttttgctttgaaagtgacttacatgtacatttgttttccttgtgaatgtttctttttaactgcaaactaagaaacattgagcccagcattcatatatttgcaaactctgtcttacttaatttctcagtttttttcctcagaaaaaatgaaattccttttcttttttaaatttattttttctttatttttctttataaagtgaagagtaggtagcatgaattcctcttgccctttgctatttcagtctggcatcagtagcaattgttgctatgtccagttttcattcatggatttttctgggattgaagatgagttcaatgttgattatttaattgggcagtataagtaaattcattggctctccttccagtttagtgaatactaaatatcatccatgatattttatacttcttacacttctggaatctaacctgaaaatagaagttgtaagtcagggacggtggtatgtgcctctagtctcagctagttgggaggctgaggcttgagcccaggccttcaaggctgtagtgcacaatgactgtacttgtgaatagccactgcactccagcctgggcaacatagcaagactcccaccccttaagaaaaaagaagagagaaaaaaatagaagttgtggagagggaggaggatgcttgaatactttgaccgtacttggcataatagacattttgagggtttttttgttttcttaaaattcctctggatcagttttcattgtttctagtaattatatttatcgttaatgaattcatattctgctctagcccctaaagatagtttgatatgctaacttttgttttgcctttctagctgctaagatagataatggttattgcaaaatgcacgtttttaaatggtctccagtgtggattgcttctgagctgctgatggattgaatacattgagaaggaatgtgtcatttggaatccaggaccagtcagcaaggataactgcctgattttatggtcagaatgctctaactcttatggcatactgatgactttttcttccattttccaaaaaagcaagttttgtcagtctcagtgtttctctgatctagctactcacaattccattcccaaagtagtgacctagttctgtcacttgggtttcaaagggagttgaagtgtcactgagtgagtacagcaaacctgtttaatgatttataggaagcaaataaaaagaattttgtttgctaacctagaagtatatcagattttggtttcaatttataattttgcaaaatataaagacatttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttccctgtttactgtgtctgaccttcaagatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaaggtaagtgagatgtctgttttgaagaaagactcttactgggtaccttaaaacccgttgtttcctattagtaaagatgggcagcttctttattcctagcttcaaaaagccttgcccctgtttggtgtgtttctcagtattgtggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtga

SEQ ID NO: 2114 - DNA, 483 bp, Homo sapiens
ctcgctcctctgacacatcgggagctcctgtgtgcagggccctgtctcccaccttgggctgaggcttctaacggcagggcgtctcttccctccaactagggcacctgaagggctaagtgttccaagacagcagtgtcagcaaaggctgcgcagatttgaggagtgggaccggcagagctggatgaaacctgactatgctgaaggggaaatggagaccccgggaggggcagggacctgctgagtgcctcccccaggcagtagctgacctggaccgcatcccggtactcctgctgagagatcctgactaatacgccaaggcccagggctgcatgcccaggactcaggaagagtctcgaagaatcctctgcacacaagaacactgctatccgccgaagctgatgtcagctattccctgcagactggcctggtccagcagagccagctctgctaaactaccacaggcaggaagaaaatgagccacca

SEQ ID NO: 2115 - DNA, 545 bp, Homo sapiens
ccacagccatagttggcacctgcccaaggaaaaataaccacttatctgcaaaaacccaacagaccccctacctatccccgtaaccccaacctccagaggtagggagctatctctcttcctagaatgtttaatgagaaatttacaaagaatgagaaggtaaaatgctcagcaaaattccaggaaaattaaggagggaaggacagcttgagacacttaattctccaagtgaggtgtcagtgcagttcccaaagcaactccagccttgtcaccatgcctgccaatacctcagctagcagaattcgtcgaaaagcattggcaatggctgcgtcaattcccaccatgtcaaactccagtgagttttcatccatgtgtactacatccacacggaaattctagagggacaggaaaaaacatttaagtgaaatctgctctctgtgtaatatctcttcatacctcccccttagataattccctcaagtattatcctctcatccaaaaacctccctttgcccaaatgtctcttattaaatattctatctcgccca

SEQ ID NO: 2116 - DNA, 496 bp, Homo sapiens
aactccccactccttcctgctcctcagccagggaacttggagaatctagccagatgcagtgacaaggcgccatcttggaagacaacagctctcaccagacaccggacctgctggagccccggtcttggacttcccagtctccagaactgtggagaagagaagagcagcacacgcagtttcaaatagtgaatgactttcatctggaaatgaggccacaagatggagacggagcgggttgctcacccaagttcatgcagcgcccatctgacgttcccccgggaggagctgcagggccttctttcgaggaggtggcagaggggcttcctgcgtgcaaaggagggtcccaccagcccttttggaacctcagcctggtcctccagaatttcacctcaaactactggagtctaggaaaaccattaaaggaagaaattgaagcttagagaagttctgtaagatgctgaggtcacacagtaataaagagataaatgtgtgttct

SEQ ID NO: 2117 - DNA, 3472 bp, Homo sapiens
ggtagggttttgccgatgcttcccctaacctgtggaggcaagtacccctgagaactagggatgccctggggcagagtcctggagacaagtgttggaggagatggtaccgcactggctgaaaatgggaacggcagagagcaggtagtgtgacgtgatggaggagatggtaccgcactcactgaaaatgggaacagcagagagcaggtagtgtgacgtgatggaggagatggtaccgcactcactgaaaatgggaacagcagagagtggcactgggattcagtttctatttccctgagtattagtgaaatgcctgttcaaatcctttgccgatttttttcgaatgtgctttccaacatattatctttttttaaatcttaaaagtaatagtttattctgaatactaatgcttgctaaataatattaatatattttccaggctgtggtttatttgaaactttgtttaaggtgtctttcatttaaccagttattcttttttattgtgagctacgtagaacagaaaagtaccctaaatatattgacaggcctaaagtgaacacacctgctctagagagcccactgcctggaactcctcctgtcaccttcttcctgtcccagaagcaactgccagcctgacttgtgtggtcaccattttcttgcctttctcaatagttttgccacctagagtatatccctaaacagtatattttgccctctttgaatgtttatagaatcatgttggatgtcatctttcgtaacttggtttccatcactattggaagactcttcttgttgcctgtggctgttgttcactttcatggcaatgtagtgttacacagcatagaggggccaaaatttacccgtcttcggtgaacatgtattagggatgtttccagtttggggctactatggaagagggttttatgaacagcagtgcacatcaactaagatttctgtagtgtttttcaactggcccctcatctgaaccacagaacggaagtgatttgaataactgttttctcagttctttcaagaatggtgtgtaactagtgccatcctagacacatatgacagagttagcttatttcgtatgtcagatgcctcagtgcagtaggttctcaaacttgaaggcagaatcatggagagggtttgttgaaacacgtgttactaggcctcacacccagagattctgattcagtaggtctggggtggggccctggattttgcatttctgacaagttcctagatgctgctgaagctgctaggccatagggcacacttcgagaatctctgcctgaggcattagggctttaactctgcagaaccagttcagctgtgaaggaaggaagagttgaattgcaggcttctaggttctagtatcttcaacttttaataagtaaatgccaaataatttttaaatggttgtaccaatttatactcctctcagccatacatgagagtttctgttacttcatatcttcaccaaaacttgatattgtcaagctttttaatttttgccagtatggaaggttaataatggtatctcattgtggtatcagttagtatttcccaaactattaatgcgattaagcacttctccatatatttattggcatttttaatttcctcttttgtgaagttcctgttcaaatcttttgaccatttttttttctattgggttgtctatttttctttttggttagtagttctttattttggatattagttcattatatgttaaacgtgttgcaaagaacttttcccattccttctggctttttcattttggtgtcttttgatgcaccaaagttcaccattttaatttagctgactttatcggtctccctctttaaagctaggggggtgtgtgtgtgtgtgtgtgtgtgtgtgtgtgtgtgtgtgtgtgtcatgcataagaaatccttttccactgtgaggtcgtaaagacagtctcctaaagtatcttctgaaagcatttgaggcagggcatggtggcttatgcctgtaattccagcactttgggaggctgaggcgggaggattgcttgaagctaggagttcgagaccagcctgggcaacataacaagaaccccatctctatttttaaaatatttaaataaataaataaaagcattagggttgtgccttccacatttagctctttaattctcacctgaaattgatttctggggtagttttagataggaatccagtttcatttgtccccatacatattcctaattccccagcactgtttattgaaaagtccatccttgccacattgatttgcagttccactcggttgtatatcaagtctgtagtcctgaataaatctgtttctgagccttctgttctttttctttggttatttatctatctttgggccaacaccttaccttactgcctctgttacagaggcattaaaatgaagtgttgatatcaggtagggcaagtctttctgtcttgttcttgggtctggtctcatcttggctagtttttgcttttgcaattccatacaaattgtagaattatcttgttaggttctattacacttgattggaattacaatgactcttggggaagagttgacagatgtacaataacaaatcttccaaaccacggagagatggcagtttctctatctatttatatccttttaaacatctctcaaataagttttaaaattttctccgtacaactcttacatattttatgtcagctataggcctaagtattccatatatttgatgcaattatcaatggtgtcttttattttaaaaataattttctgcttgctgctgttatattcaaatacagttaatttttaaatcttgatttttgtatctagcaactttgtaattcatttacaaattcttggggattttctgtctatacaagcaggtcatctgggatgatactagaggcagcgcagtatagactggggaacagcaccggcagggtctggacctcagcgctgccacagatgagtcatgtgtctttagacacgttccatgaactgtaaaataaggtgaataatagtacctgcctcatagggttgctgtgagaattgagacagtaaatgtaaagcaggttgtaagtgttacataagtgtatgctattattgtaattacttttctttcctttccagtcatactttgtatttcttttccttactgcactggctagaacctaaaggacagaggtcaagaaagctggcatccctgacctcctgatctgaaaagaaaagctttcagtcattcatcactaagcattttgtccactgtgtgtttgtcttaagattgcctttatcagattaaggaatgtccattttattcctagtttgccgagaatttttattgtcataggatgtttaatttggccacatctttttctgcatctgttgaagtaatcaaattattttatcttataatctcttaatatgatgaattacattgggttttataatgataaaccaa

SEQ ID NO: 2118 - DNA, 1063 bp, Homo sapiens
tggcagaaccacttctggacctgtccctctgcaccccccattcctgcgccctcatttaacctccctgactctgacctgggcttggtctatcttggggcctggctgccgtcctgggacgggaaggggagcagatcagaactcagcctgcggctccaggccgctgggcgctggctgggcctcacgttctcctggaaggaccacctcccttgccctccacggggtctgcctttgctcccaaggctccgccctggacggagcgtccttcttgcctgggcgtcttcagaccttcatctgtgacaccgggggccatgtggctcaccccgaggaagagacgaggactcgctgtgttggctgttcttgagcttctgggctcaagcaatcctccctcctgagcttcccagagtgctaggattacagtgaagactaagggccaagcatgagcctttcttcctgctcttttacccttgaggcagcaggagaggatattcacctcctgacatgacagattctgacgctatctgctcctctgtgactttgggaagcggggtatgtgctgctcctgggctgatgggggaaagtgcctctcccagcaatgctggtgccacttggtgtgctacggccccccagggcagtgcggagccatctgggacagttagacaatgagagacgtgaagccatttcaaggtgcttccttgaaaatgctccagaaaaacagcagaggcggcctctctggggatccggtccagcccttgaaaagaatctgtttgtttcaccactgaactcaaataagccaacagattgaaggaagggagtttccacgcgcccctccccaccaagcagttacctgagttccagagtccagtccgatggatcccattttaccctggtttaaattgtttccttagaaaaaaataaacagaacctcttctctcactctccagtggaaagtatagaatcaaacgtaaatgaaaatgacagtttctaacatgcgcgacctggacacgcggctgaactccgagcctcagctgcagagtggggtcaatgcacctaccttgcagcgtca

SEQ ID NO: 2119 - DNA, 622 bp, Homo sapiens
agacagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaagtcagtaagaccaagaacccaccaattccggacacagtagcatttgggaataataagaattgtagctgggcatggtggtacacgcctgtagacccctagcagctgccatcatcctcaccatccgcatattattgatatattaactctttgatggcaaccatagcttatcccccttatctccctatgccctacagcagggcagtggaatggttaagaggctttgaagtctaagagtgctggcttaaaaccctaa

SEQ ID NO: 2120 - DNA, 335 bp, Homo sapiens
cgcgccctttgagtatcagttgccatctctaaattgaaccgtgtttgtatttacaccggtgaaaatgagtatactgtcattaaaatagaactctttaagaataattgtggtctcttgtggatcaaggaataaactgcttacagcaaaagagtagcaaggtcttcctggcaagatgatgcctttctggtgttcttcctaccaacagagtaacctcctgatctctagaaggaatcctgaagcatgtgccagagacgcagttcctaaagtctttttttctctatggttagagtgactggccaacatccccacaaatctattaaagcaggtttttgtgt

SEQ ID NO: 2121 - DNA, 704 bp, Homo sapiens
ggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagaatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaa

SEQ ID NO: 2122 - DNA, 754 bp, Homo sapiens
ggaagagaagattaagacacagagataccagagaggtcgttcacagaggaaagaccatgtgaagacgcagtgagaaggtggccatattcaagctgaggagagagacctcagaagaaaccaatactgccaacgccttggtcttggacttccagcctccagaactgtcctggatcagaagatgcctgacaagaggccactatcagcagcaacagcacagtggggacaaacctgagaccttgatggaccgtggacaccagcaggagagacagaggaacttgaagtctaaatgggcagacaagaccaacatacacaaagcagagagtggcacaagagccatgtctgatgcaacagtgactcaggaggatcactctgactcagaatggccaagcaaaggtattgggaggaagtgggatagaactgagctttgaagaccgtgctaaaatatttacagactccccaggttatctcaagttctctccaggaattagcttcacctctttgtgctttggctccacatcagttaaatagtggtaacgtttgatcgttaagaaccatgtagagatgaaacaattttcaaagttttttaattaagtgtactcattgccactcaaagacaaataccatataaatataataataatcatattgagaaacaaaatagcaatgatgcagatactcatgtactgtttcatgtttgtggtctttgaggggagtttttactcaaatatccctagatgaataaatacatatggtc

SEQ ID NO: 2123 - DNA, 532 bp, Homo sapiens
aagcagtcagcagtgagcaggggaggaggccagggctgctgggggtcggcgctgaggaagccaggattttccgagggccaatgccgggagccacgccaacgccaggagccacaccaactccaggagccacgccaactccaggagccaagccaactccaggagccacaccgacaccaggagccacgccaactccaggagccacgccgacaccaggaactaaccctgcaagattgagaagagctgatcattaaccaagacctgatcaaagaggacagaagcttatggaaagagggctggagcctcggccctggcatagatttgctgtgtgaccctggatcagttactttcccttgctgggcctcagcttcctcctccctaatatgaagtgtgtgcaggctcaggagttcataactttgtttttttggagacagagtctcactctatcgcccaggctggagtgcaatggcgtgatctcgactcactgcaaccaccacctcccgagttcaagtgagtctcctgcctcagcctcctg

SEQ ID NO: 2124 - DNA, 547 bp, Homo sapiens
ataaactggcatgttctgaaagaatcactctggatgctgtgtggagaaaacactgaaaagcacctgttgtttcctgactttttaatgatcgccattctaactggtgtgagatgatatctcattgtggttttgatttgcatttctctgatggccagtgatgatgagcattttttcatgtgtctgttggctgcataaatgaatagactaagatttcagtgattgagtctcatggcatgtgataaagagttagtgataaagatttaaatggcacataacatcatcccaattgaatgcatcggggggtcatgatgctgtgtgggtttgaaatggaaattacaagcgcaatattacagaagtgtggattttagttacaatgtctctatgagaaagtctaaaagttaaacataagcaaaacaacaaaaacatctaaataccagacactatcctcagaaattagatttgaaaaatgagcttcattttcgaagaacatattgaatttgttatctcgattatggagggcgacaagtcccacagtctgccatctgca

SEQ ID NO: 2125 - DNA, 829 bp, Homo sapiens
aagtcgtcgtaggtgaggcagtcggcgctggcaaagagctgctgcgcggggagccagttatcgggcacatagtcggtgccgcccctgatcagccatgtgaagaccatgattgctttcccttcagccttccacctttgtaagtttcctgaggcctccccagaagcagaatcctgcatagtctgcagaactgattttagaatgccaagctgacattttgagtttttatgagaaaccagaaaatttggtgtgaagaccctaagtggtgtgtctgacttacagcaggcccacagtacctgttattgagtgagataagcaaatggtatttcaggaccaaaacatctgtttcctgaagagttgctcctttaattgtgtatctacctacctgtctatgtaactcttggcaaatacattggagacttctcaactttctgcttctgatgatctcaacttgtggtatggcaaaaggagagcaaaatgttcacccaggggtctgagtttggttcaagagaggaactacagctgttggtgactacaaccatctgcccagatgacatcgtgatcaactcctctgaatcactctaaaggaacgagaagtcctggcagctgagtcatgatcccccaggagccattaagaagttaatcttcagtcacttccatccaaacagaagaaaacccatgaaggatgagaactatgggtcctgagaatgacaggtattgaagacaggatttatcttctctacttcttcttttagaagcagatcaagaaactggcgattgaagagtaactgaaagaaacgcaatctgatcttactagcagtgaaagagcgag

SEQ ID NO: 2126 - DNA, 1974 bp, Homo sapiens
aacttcaattttaatctggataacgccaaagcttttcctcaaattcacccctggagtcagctcatagatgctctgattttgtctaccattgctcctccttaatatctctcgcacaggtgccattgacctttagatgggctgtacggtgtggggttcggtgccatggatctgcttctccagggaccaggatcttgagatcttcaggctgggtttccatggaggcatggagctgcttttcctccttcataactgcactcaaaacagccctgttgctctagaatggagacttgggcaactccttctggcacagatttgttcacctcaggtgaaattcagatagaagcaagctgcaggcagtttcacctctaagtccatgggttctcaactggtaacgtcctcttatggatgttagcccatgaggtcaatcctgtagcaatctaaggcttgagaaaaattaatcttctggaaaattccaagaatacatcttagggaaactggctctacctttatgacttggatcacacaaggatatgcttttcatcttggactagaactgagagccaatggatgtgttatctaaaactatcccagtgtgttcactatacagaggaagattctgagattcaagactcaagactgaagaagatcattatttttattattttagtcttatgcacaaaatgatatctactgaataagcaggtttttaataggtgacttatatatgttagcaaaaataaacactttgtcttttagatctattctagtttttcagtagctgtagacttaagtgctaacttttagcccataggataagaagaaaccaagtcctaaaagtaggccagcaccagggttcaggcctctgacttcaagccaagggctcatcatcttgaattgcgcacgaatttttacacagcgccaaaggaaactgcctgtacttactgttgtaggtgctttgctggattcaggatgcagacaaggtccacgcattgtggttggaacaatgactagatctttacctggtccacagccctccccagtctggctgcaacctctcatgaggctgagctcaccatgaacccctgctctaggcgtctgcatagtgttctgtttgtccccgtgactgtccacctcttctttggcctgttggcatgcgcttatcctccagacctcagtccaaagttcagtcccggagcagacacaaccctgtttgcagagagccaacattctaattgacagtgcgtggtgggaaacagtgaaccgagggaaagagtgccagtgttagagagccacagtgcagtgaagaagagaaggcaagaggatgtgatgcaaaatcacaggacctggcttccagaccattctgcttccatgagaacatttcagttgagaaccggatggcatgaaactttattgaagtatcagagaatcattttcttaagagatggtaatggaatccatgcatttgaaataaatcaacagaaaaaaatgattcagaagagagggaactagcctaaggacaactgtgatattgtgaaatatatatatgggtcttcatcctgtgtcctggcatacctaaaacccttggaatatccaaaggcatgcttttcatgtgcaaatgattgactgatgtcttcaggatggagccaatcaccagaaatgtcaaagcataattagagtgttgggactttcagccataccccacacccctgacctttggggaggagagacgggcagaaggttaagtccatcaacaatggccagtgatgtaatcagtcatgcctatgtaatgaagcttccataaaaatcccaaaggactgggtctggagagcttctggatatctgagcacatggaggttcctggagggtggtgcctggggcagtcatggaagcatctcatcccttcccacatgccttgccctatgcatctcttcatctgtatcctttaaaatatctttgtaataaactgctaagcat

SEQ ID NO: 2127 - DNA, 404 bp, Homo sapiens
tttcaaaaaaagatgagtctcttgtcaggcaacacaagtcagggcaggggtgggtgcagaccccagagcagcttcgcagtctggatgggggtgctcccccgtcacgccacagggccagcttttccacagtgcaggctggtcagtttccaggtagggatgcggtggggcacgttttctgcccggggagttgtgcctgtcaggggagacagccccatgacactgctgtgcctccggggaggccaggagggacaaggagcggttcctttgggtgagggtctgtggtgaggcaccaggagggccattgtctgctggggggctggaggatgaccagccagttggcatagaggctggggcaggatggtgagtcctccagcagcagtgggtgggtggagcagttcacacgg

SEQ ID NO: 2128 - DNA, 3754 bp, Homo sapiens
cacaggcagtaatgaccaaacagagaccaaggtggagctcaagagaaagtaagcatcaaacagcactcagcctgaatccaggcacgttcttcagtccaaaaagcaaaggggatgtaaatacttaagttcatcttactcagatcgcaagaataaaacaccacatagggacttgggaccaacaaaatgctaaccagtgaaataagttgtagagcctctagtgtctctactcattgtgtatttcttgtatctgtctaattcaggtgtggggattcaggatccttttcatctttaatactaaagtcaaaattaacaaaattatatgactataacctattaactttctaatttgcaccacatcttctttctgattgggttaatatgggtgcttcctcagcaaccttcctgctagtctggactctattgttcatctttctcctaggtgctcctcaggttccacattttcttgcctttctgccatctctgccccatcaaagtcaattaggccactcacttctctttacttgtcttctggatgactgtaaaaagtttaaaacaatgcttattcattgtctgcaacctcaatctagacataagtgctgcacagctctctcttttcatgtccctggggacagaggaatcttcccactttcaggctaagatttattccttcatttgatgtttttaaaccactttattctgactttaacaggatgtcttaattatcctttttctttactgactttaccctttttcacaaatgtgctcaagttttcaatttcccatttgcttcatcacttctgtttctcaaaatagtaatgtatactccctattttcatgcttcttctcctccttatttcttattcttttgcaatttggcttccaataaaatttttctcattatcaatgacatctttagtagctcatcgtctctgccatagtcattgaatctctgaccaatgtggaaattaaaaggtgatgatgattcagaggactcagattaacctaaaataaaatttaatgtttttatatttttaattgatactagtatgacagagtatcactgaataatatagtatttttcaactatatagaatcgacatatatcaagaaaacgtcagctttctctctagtatagaacttccataatgtatggatatgtccttgctctatgaccacagtctccccgtaatgtttgcttgctatgtactcagatcctatagtgctcatttctttataggagtggttgtcacatatctgggcaccaacacagagcctagacattcatagatgggcaagattactttgtgatgttgtaaagttctgtgttccattctactcttggataaatgttagtgatatcacttgttcctctcaacagcagccatatatgtgtaaaatcccagtcttgctctacttctctgaattatacctaaacaaatatatctacccgaaatagagtggatcatttttgtatattttattagcttactcaatgacatttaatctggttcaccatggaatctttttgatatgcttcatttgccttcctttttcttccagatgttttttatttagtgagttcttgtttgtttctctctgacacctcctcactaacctaagactggttcctccttgtctacctctccactaaatttcatggttccctgggtttccattctcattcctctcctctaatctctctctccagatgacttcctccactcccacatcagcaactatattcctatggcgaatctcatatcttgatctctagcccaggagtcactcctcattatctgacctattggatagttgaacatggattgctcgaagaatcttaaaattcaatgttctaatactaaatccaatgcataatcccattttcaaacctgcttttccttatatgctacagatttcagatcatggtagcactgattttccactgaccttaaatcaaaatttttggagcccttttagctgttacctcttcctctgatttgtgtgtttgtttgttttttggtcaatcgattctaattcttcactactgaaactgttcacttctttttatctgcactccaacccttaaatcattacttatctattattatgcaatggcctgctcagcatgacctgcctcatccagcactctttctagccatcttgccaccagatgtattgctctgatacatgattttgatcatgtatctctcctaattaaaaaatccttaagtttagccagacaaactttacggtataagtaccacattgtatttgtgtataactccttgctctgtgttagcttttatcctgttcctaaaatgtgcttcatgcttgtgggcaaagtctcattgatcctttcagactaagcctcatttcatccttttcggtagtctttctgactcatctccattcccgagccctaccctaggaaatcagccattctatactccttgctctctaacaatttatccacaaatggatctctatatcatagctatttatttgcatgcatatctctccaccttgagtgtgagctttttgagggcatcaactccgttttattcatctttgtatactcactgtttatctatgtaggttattgctaatcagtacaaacatcagtagatatttgtaaataaataatatctgccctcctgaagctcataatgaagttaagagagagaatctacacatagatcgattagggaaaatgcaattcagagataaaattcatggttgaaaatagtgacgtctcaagaatattgcattgcagaggataaaaacttaattcctatcaccattttttttagtttatacaagagtaactattttaaaatttctattgcaaactggtgtgctgcatttgtacacacacacacacacacacacgcacaaagatttgataagacatagagaaatgagatgtccaataggacaacacgtaactagatgggcaaattaaggtaagccatccagctaaataagcctttggtaaatttatttctgggaattctgtagcaggaattatcttcagtttgctggaattaagatgagccaaaagggggttatatcttactcttttggcctaagcaatacattgttcagagaggaggatctccaggaaggatcttgcaggccttgaacaaaagttcactggagtttctgagaatatgccttacagaaatgcactcaaacagcctaaagaaatgagagttctaataacaatagaataaacctcagtgtcaggaattcacagaaaaaagggggaaaaattgtagaaagggattaagaaacacatttttatatactcaagaaagaaagctcactgatatacatgtatagaaccttaaagaccttttcctgaatagtgttatcttttaaaaaaacactggtaataaaattaactttggagatctaacaagactaaagaagtactgtgaacttttggactctgaaactaagaaaaagactgacaaaggtgatgatgtaggttactgctaatagaacatgtttaaactttggctgccatgattcattttacaccttgtttgagtaggatggtgtgactattatgactgtcctgttgaatttctaagttttcttttatcccatatcctctttgaaattcacaagccaagatataatcatgaagttttaagggtaaaaaaacctattctgccttctcagatagtcctaaatacaattcaacaaatcatcaaatttgtctaggaaataaaatttgagcatttactaa

SEQ ID NO: 2129 - DNA, 611 bp, Homo sapiens
ctagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatata

SEQ ID NO: 2130 - DNA, 2298 bp, Homo sapiens
gctagctgggttagtaagcggcgcgagcgtgcgagtttctgacgcgcccgcgtcgtcccagctccctggactaccagtattgtcgcccacgtgggcttctctttcgtccgctcaggcctcacttttctccgtaaacaccccggcacgatggagcggccccagcgttcgggagcggcccgggagcggaaagcggcagtgtcctgggagcctcgaaagccgcaggggcggcagctcgcctcggaatgacctctgacggaagaaataaaacggggcctgggacgcttgcacgaaagaacccgacaaaaaccagagcccgcactcactctcgtactggggaggtggacttcagggagggttatctggaggaggaatctctcaaagtacaacacaggagaaagacagtatcgcaatacagaaattttattttttattttattattattttcctgagaccggagtctcgctctgtcgcccaggctggagtgcagtggcgcgatctcggctcactgcaaactccgcctcccgggttcacgccattcggctgcctcaccctccacagtagctgggactacaagcgcccgccaccacgcccggctaatttgcaatacggaaattttaatagctgacgtgaaaaggggttgtctccataaaggatgcgggccttcaggggcagcattattctgcaggtctcctgcttcctgatggcacaaggactccacatcacccagtcctaccttaaatccaatcggacaccagtccacaaactggttggtgtgcttgctcttgatggtggcgacagccgcactgacatctttcaggaccacatcccctctgtacaacatgcagcaggccatgtacttgccatggtgagggtcacacttgaccatctgattggctggctcgaagcgggcactggcgatcttggccacggacagctgctcatggtaggccttcttggctgagatgaccagggcgtaggtggccagggggaggtggatgtgggggtatggcaccaagttggtttggaattctgtcaagtacacattcagggccccatcgaatcacagggaggccgtgatggaggacacgatctgcccagacgactgaggttggtgtacatgggacactcgatgtccaggttgtgctgacatgtcataggtggctttgctgtcgactatgaaggcacagtcagaatgttccagggtcgtgtaggtggtcaggatggagttgtagggctccgtcatggccatggagacctggggggctgggcaaatggcaaactccagcttggacttcttcccgtagtccaccgagagccgcttcatgagcagagacacgaacccagagccagtgccgcccccaaagctgtggaagatgaggaagccctgcagtcccatgcacagatctgcctgagagaaaccagacaacgtaagccaatgcccgtgggagccacaccaccaacctccaccaagccggggccacttctctttgcctctgagagttgatacggattcagaccatccataatgaacacgcatcacactttgaagcagagaaaagcagacaatacagatctatgcacaaatcaccacgcacacttcacagtaagacgttgcagaggtctaggaaggctggtttgaagaaatacacagaagaaaaacggatggactaaccagagcgctcagccagcctgctggactggcacccgtggctacagacactcttgtttagcaccatggagagctccctgcacagaagcaaggactcagggcattgccccctctctacctgagaactagactcagcgcccagcactggatttgataatacaggtactcaaatacatgtgctttcctctttactcagacacttctagggctggcagggtcagacagtaatcccccactttgtggggaggccctgtttttgctgaacagctcaagggcaggaagattctttcttccacacacccctgcaactgccaatacttgttctgtgtgacccttgcagccatcctatgcggtaggtgctaccattgccatggatcaagtggggacgcacagatccaagctccttcacctctcaagggagttgggccctcccacagatctcttggaggaaaaaaatggccttgctgggcctgtcgatttccagtccccacccacctccctcatgtacatgtgtctgtttgtgaaaccttcatagcaccttagcttccaggccctccatcccggctgcctctctggcacttgcccttttactgtgcgggtccaaagagacacctatgttcagtttgtc

SEQ ID NO: 2131 - DNA, 1437 bp, Homo sapiens
gggcagcccatgcctggattttttggtgaatgagtctgaaaagcagtgaccaggtgtgttgagggcctccccttgcctgcacctttttatctctgagtgactgagggctgccaaggccagacaacgcacatgtgtcctggatcctcccctggcctggggcagcagcagcagcagcagctgggcttggggtgagtaggctggcttgaggaaggggctgcccacaagcagggctcatttcctgggtcagggcctgtcagactcaaagtcagctcttcagcattctgtttagaaaatgatgatgcagttcagtgagaaagaaagctcaggataaaatatgttttctggaggggaaatactcaagtgttctaagccaggaacagagactctcaagagaggaattctctggcattctctgccttggataaatcatggattaaacatgagcatccttagaataattttatttttgtatttcactttacactgtaatgcaaacagcttttatgttttctttgacgaagaatcataattgagtcactttaggtcttttagctggaagcatttcaccctaaatgaaaagttaatgcattttttacaaggattaacatgctaactacaacttgccctttcagcagatgacaataagggattctgaaaagtttggactgtctttttctttttgtatacaaataaagcagcagatcctttctctgtgaaggttgttgcagagctcccgtaccagcttataaaatgcggctgtttaagcaggacttgggtgggcagcagaattctgcacatgacgagtggctgcagcttagaaagcaaatttcatctgattccagtactgtgattttaaggaaacggtaaaactcaaagtgccagtaatgccatcaaggctcagtaacatgccatttcctcagcagctaaagacaaaaagaattattttggtgaggggatagaaatcctttcgctttgcagtgacacccactttttcttagcttggcttgggagtaaggagattggagtgtggggggacattagaaactcatttaaggcaaactgaaatctccttcatcagcagtcttcctgctggtgtagccacagcagaactccgaggcttgcaggctgggctgtctccttgctgcctggcttgggtgtttatttgggcaatgcaagctgacattgtgaggtgttgccgatgcccaggccagctagcagggagccctcccagggctggtagaaacctatgtgtatatatattctcaaatttaaatagattgtacatagtgaaatgtaaatgacatgtaaaacagcaatctctatttttcttaactattatatagcagtatatatttgttgaacatgcttgtatactcttcattaaccattttaatattttgtacagataagttgattaaatattttattcataaaacc

SEQ ID NO: 2132 - DNA, 2773 bp, Homo sapiens
cccactgaatttcagcagggatagaagccagagttggtttgccatcaacccacttccaaaaggaaatggcaggagtccagcagcatcatgtagttacaatctcccatgccaggaagaaacatctcccaagctcaaattctacccactttgacacttgaaaagtaaaacatcttcatacgaatgaatggggagatgggtgtgattgctggcagtgcaacaatgagttgaagcttgattgtttattaactgttgtaaacaaattatgaatttgtgccagtagccaaaatagagacaactgggcataataaatattaattctcaaggagatcatctaacaaactacctaaaagatcctttgtggactccaagggtgttaattatatgagactttattctctattcattaattcattcaagattttgttgagtgaatgtcagcctgctacagtacagggctggcaaattgtttccatctctagtgctaattgtggttatagctgctcagtgggctgtattgaaaaagactgagtccaaatctgggcttcatgagaaagagtatcatgaagatactcttcatgatactctacattagaggtgtcttctgtgaaagtggaacaaaggagtgtctgaggtatttgtcattcctgcaagttggaaaaggccttatctggcatgagaaggagtagatttggggtaaatcgtttccatcttatgtgtctttatttccttaaattggtaaatcgaggaagttcatctaataatttttaaggttcttccttcctactcttatttatttatccattattttatctgtccttgcatttgaggtgatttctcaccttgtgaatgcattcctccctagcataaaaaccaaaatctcattttcctagcctcctatgtagtaagaatacagcaatgggatctaggtccatcagtcagatacatctgtcctacatttgtttagaatattatgtaggagatgagactatttcaccccaaaatatggctgtaggtggccagaatgtgtaccccaaatatgcctctttaaaataaggatcactttgagctgattatttggggagacagtagacacaggagaagctctgaaaacagagtagaagttaagcttttgtaagagaaatttgcatctataaaggaaatctccatcgtaagggtgtctcatctctgtagaagaaaaagaatgagtctaagttactaaaaactcttatcaatagagaaggcaacttaaacacaagtaaggttttttttttgtatagttacccttgtttaaggtgcttttcctccctctaactgggtaggaactttctttgtttcagagaatagtatttaagcttgaagtcaaagctatgatacttctgagatttattcaaaagctttgagatatttcctgtattatttcatttatgttgctataaaggaatacctgaggctgggtaattcataaagaaaagaggtttgtttggctcacagttctgcaggctgcacaagaagcatggcaccagcacttgcttctggtgagggtctcaggctgcttcaactcatggtggaaggggaagggaagctggcacgtgcagaaatcacatggtgagggaggaagcaatgggggtgggggaggtaccaggctctttttaacaaccagttctcgagggaactaatgagcaagaactcacttattatgacaaagatggcaccaagccattcatgagggatctaccccatgactcaaacacctcccattaatccctacctccaacattgggatcaaatttcaacatgaggtttggaggcaatacacattcaaactatagcattccccctgaaggatcccagggaatttcacaccacagtatggcattctgatatgctgattgtaaaaaattaaagtaaaatgctgggagatacttcacactgatattgacttatttaccttaagaccagccctgccaaatagaatacaatcaccttccattacccttccctgaatttgattatctatcataggtagaagactgaagaatctacatctggatgaacttcttcacaagataatatctaattttgaagacaatcatttacaagctaatttctgtcccttggttcattcattttccctaagaaacattttactactcctcaaaagaaattcctaccattttccatccctcctctcccccttatgaagaagggtgtgtaatcatctggacctcattaggtatttgggtaatcactctcctgtgattttcccttgtgcattttaaaattaaatttgtattcttttgctcctactaatctccttcttatcagttcactttcagtgaaccttcggagggcgaaggggaagctttccttctttgaccctacacctgaatatctcccatgtgtacatacatgaggtatacatgttattaaactttgtttttctctcattttgttacagcagtccattccaaccaagagctcagaaaggggagagaaaaaattaattttttcctccttacactagtgatggtgcacagagtccatctggcaaggataaaggcagagacattctgttcattaaagcagcagtgatagggccagctctggtggctgtcccaagcagggggcaatgatgacttcactgagcagctctgcagcacaggttggggcactgttcctgtctgctagcctctaatcttttgtctctgggcctcccttggagcccttcagctgtttaattctttttgaaataaactcattttactgctgaaat

SEQ ID NO: 2133 - DNA, 429 bp, Homo sapiens
acctccgaaagccaatcctttcctccatttcttctccaaggtaacaacttttaaacattcacgtgacggaccaccttccctcagccaaacaacttccctgaaaggcgcccgaaggagccttcccatccaccgcgggtgcccaggaaaggcctgtggggctctcctccccgcgctccacacgccctcgcatcccaccgaggggccagcttctgcctgcacgttgctgaaactggcctggaggttctgacaagaattagagcggcggccgttgccccggggatgacctggaagcgaaagagaccggcacgaattctagagtttcggggtttccgcgggttgagattgtacgggaaacaatgcattaaccaaacctaaaaatcaaacaaacacgtctggtagaacctaccattaaaaagcttctttcctata

SEQ ID NO: 2134 - DNA, 12400 bp, Homo sapiens
atcttccgcccggccatcgggccgcgggcgctcggaaccgacctgggagctggcgggaccgtcctcccccgccacgccctcccatcgggctttgggcgccggactctggccaccgctcggcacctgcctccgcctcgccttggggtataggagtcctgtaccgacccctggcttgcccagaggacaggttctcgcccgggccagaagcaaactgcggcgaaatcgagacaacagaactcagagtcactctgtcacccaggctggagtgcagtggcaccatcacagctccctgcagccttgacttacagggctccagtgatcctccaccctcagcctcctgagtatctgagaccacaggtgcaagccaccatgcccagttgtagcaaggaaaccaaaaggtataaacattcactgattgaaaaacaatgtcataaagtcatcccagtatctgtgaggagttggttccaggacccctgaggacaccaaaatcctcagatgctcaagtccctgataaaaaaataaaagcagtggtgccctcgggttcaaaaacctgaacggtggtcttcagttgttcccccaagctcctctatcagaggcccagacactccaagaggctgggaagaggcaagtggctttccctgactggcatcagactcctggatggctgtgtttctgcatactccaccatcaacaatcagaagggcactgctttcttcaagaaggggaccttgcaaagaactgtctcagatggactatctttgagttcatcttgttctgaatgtgagtctgagtctttgtttccagatgacacagtgctgtctgagtcctctgaatcacctgcctcagagctgcagcaaagtttctgctgcccagaaactgaatgggctgcttgtaatgcagattcttcctcctggacaagaagtgctgctgcttctagttcttccagttctaaccccaactgggcctttgtaagggagacttcctttaaggcttctgcaagagctgccaacgttttggatttgactttctgagtccacacacagtagtatgagatgtagagatcattcagtatgtatgctgggtcgttttcctgaaaaattttgtgaatatccaggagacactttaaaactgcacttttacttaattgcagtatctttatagtctccccgtaggccttcatcgccagtttgaaatggcgatagagcaggtaacacaatacccttcttccaaaagacaccatgatatcatgaacattagtccaagtctcaaaccagcatagtattggactcaagtttcgtgatattccatgcagattcaacgttcttgtctccttcagtgacacgggtttcttagcaatatgccagaaggatatcaatcgaactgtagtacacttgacgacaggctctgttgtctagcagataagatttattgacaaattcttgtagctgatatttctcttcttcagaaaaagacactaatgcagcatgattttcttgcttctgactcttttccaaaaaggccgtcattttttaatatttgtcagtccaccaaggattatacttcaaaatctgttcaactgcctcatcttcaaaaaagtcagctagataatgatcaggatcaaacttggccagctcggcggccaggtgcttttgttttcgttctgctgcagggatgaaatctggatccttaataacatcactcaattcatcctgtaactgctgaaacactcctgatcgtaagtttccaaacccatagtggcatgaggattcaaagcactttctgttacctcttcatagggtgtctgctcaatttcccaatcaaactcttcatcgtcaactacttcctcaggaatttcagaatcacctattgcttccacaagtggttttgctgtcccggattttcctggtgccagaagagcaacacatgttcagcccctcaaaatgctggccaggggtttctctgggcaggcgagtggtaaaaattcctttatctgcatcataggacccttgctcgcttccgtatccatattctacaattcttccaggaggggttaatctgagaaagtacggcttggcatagtagtctaggccgacccctcgaagtagacgttgaactcggaggccggggcatagggcacgcggatggcgatggtcaggaaatccggctcctggctgaggctgaacgccggggtcagcatcgcggcaccagacgcaggggccagcgcggctcgccctcgctgccgcggcggtcccaccaagcaactctctccaattttacctttttaaaataaaagatgtctgggccaggcgcagtggctcacgcttgtaatcccagcactttgggaagccgaggcgggtggatcctgacctgaggtcaggagttcaagatcagccccgccgacatgacgaaactccgtctctactaaaaatacaaacatcagccggacgtggtggtgggcgcctgtaatccccactactcgggaggctgaggcaggagaatcacttgaacccgggaggcagaggttgcaatgagccgagatcatgccactgtactccagcctgggtgacagagtgagactctgtctcaaaaaaaaaaaaaaaaaaaaaaaaaaaagtctgtcttccaggacacagaagcctcctatacacacattttggcacttgattatgttatgtcttttacagttctctgcatgtttcttgcaggtaagtcttgattcttcaattacatattaaatttctattgaggatatatatctagctttcatctttcagagtacctagcataggacttggcaccaagtagcccatagtaaacagttattcaaccataatgtatgattttcttttctacttttcactggtatgtttttgtttaaaaagggtaaaccaccagggatggaaatgtccttgctatgttatccttcttctctaattagcaaccacccttcacaatctgccacattacatttaaaaaggattttcaaattagacatttatgcctgggcattaaccagggactgatgaatcagtgccatcagcagaacactgccctgactggcagacatggcaccattgtcaagacttgtaatttactcctggcttttcaaatagtcagtgtgtaactccaggcaaggtttaattatctcctgttaaaatgggaataatatgacccacccccactttgcttcccatgggtatcatgagaattaattaattattgaataagaatatatgtctataaaatattttatagttcattagaggtaaacaaatgcaaacgtaagatattgttcaatgtattatgaatgttcattgttgctgtatttagtacaaagtacctgtattatatcaacagtggtagtacacaaaataatgaatacatgttgggtcagcacctcctccaattaccacttgcaaacaagtcctggatggccagaactaattggaaggttgagacaaaaattatatctcgcacactaaagaaggggagattgatacagcgcgctcacctaaatttcgtagtgccttcatgaactcttcaaaagcttcaaatctaggctaggctacaggaagaacagcagcaactgaagactggcaccttttctggaacctcagcagcaccttccttgtttcgtaagatttcgaagaagcatatcaaaattcttccacccattccttcacagtataataggagaaaacatctatcctccgttgacacctggaagaatgagattccaactcactccaggacatggccagaaaaattcaacaaaagatttgctaaatcctctgcactattatctagaccaggatttctcaacctcagctctgtggacatttgggccagataattctttgttaccagaggctgtcctgtacatcatcaggtgtttagcagcattcctggcctcaaccaaatggatgccagtagcacctcccccacccacttgtgacagccaaagatatctccagacattgccaaatgtcccctgttatggagaatcatcctcagttgagaatcactggtttaggcaatgatcaaagtggggcaactaaatcaaaaggcactgcaatcttaagttgatcaagcatccttctttgaaatcactcagcactttcatatattgcatttatatcttaggtattcatattctaacaattcagccaatgttttttgagttcgcaatggacaaggtacaagatcaagtaagtaattctgtgtatccataaaacagaaatggatatggtatgtcccagttctccacagtaggcatttatgttattcccatcccaatatttagccctgatcagggttgtcaaacattgcatgggacatacttatcctaaaaaattattcattatttatctgaaattgaaatttaactggatgtcctatgtgtgtgcatgtgtatgtttgtttgtttgtttctttttctaaatctgattaccctatcctaacagactcaaggttttttccctgttccacaaactttatgacttgacttcattaaaaataataaagaggaataactgcaaaggctttaaaaatgctgttagaatgagtagcacaactgaatttgaggatacattttctttgaaggatgtctattttcctactgaaaatagtggcaaactccttagaactcattcaaagcctgatgggattcattgcctgatttatttaaaaacacttctgatgctcacagactatttatcatttacacagcaaatgatgttcttctagtattcttgttgggtgagttagcattgtggaaggacatagaggagaatcagacacaaacttcttataacctcataaacaggaagaaagggagcagaagcatagactgactttactttcactcagcttaccttcctagttctccaggtgtggtcctcagaagaggaatatcatgtgacctgggaacttgctagaaatgcacatccttgggacccaccccggacctactgaatcagaaactctgagagtgggtcctagcaaccagtgttttcacaggccttccaggtgattcttccgcatgttcgagtttgagaacaactgctttagagccctggttcttgaccctggctacagggtaaaacacctggggagtttttaaaatactgatgcatggggtccattccaagggagtctgatataattactatggggtgcagcccaggcgtaaacattttttaaaaactcctcaaccagaataacggctctacagaaattttatcaaatgccaaagaaagagttccttattttgcaactatagtgctttctactctggccctaatcaactttcataaaggcagaatggacagacattacgtgttttaatttgaagactaccaaaaggccggccattaaactaggtatatgggctcgtcctcaaatccctaaatctactccttaggacctactatagccagtgtcatataatagaaaagtcacttattgtccaccagaccctgccctaatatttgataacctcttggggcctcattttcttgtgtctacactggggatgatattaactcttcacaggatttggggaattataaagaaagaccatgtagtaaaggcaggaagatcaataatcaataatcacatcagaacctgaagggacttcgtaccattgaagtgaggcagaggagagagaaatttagaaggacaaattcacaaatttcaatgtgtttctataataactacttaaattattttctctttgaattgcctcactgttgtgtgtgtatgtccccactcccacctgtcccattattttcctgttttcacttgtaccttggcaacccatctgtggttttggccaagctgttttaatggcattgaacctggtagtttttttaaaagagtgtggtagtagttatatatggctcgataactcctggggctacaacaaggttaatgcgacagtttttgttgtttaaaaaacatgcttgtctgacaagtcaatcattttaagccccttgttcacttcaggatggttgctaaaggcttctctgtgagctaaaagctctcgctgttaaggggctgcctgccctgactgtatgcattaaatggaacagttctctacatggtttcttactacagatgccttgggatatatggacactggcattacctgctgcaacaggtcctctcccagggtactgctgagacctaagggcttaaatgctcaccaaaccaagtgaccttggagggctggtcatggtgggcatctgggagctgggaaagagcattggagaacttcatagggaaacctagtaggcaaaaatgaaagaacccataagggccattggcatgagccatagctaaaggccactgggttagctctcaaagaaaactgcaagattgaagcataaattccttcatcatgaaccagaagtcatggagtggagccaggggcaagaaagagaaagatgaagaggtagaaccaccaggataaaggtgccaagaaaaacagtgagagcaacactcagggaaccagagacaggaacacagctgggaactaggaggagaaaccaccacagctggagcgcaaagtggccaggtcagaaaagcctcatggaatcctggttaactgaatgtttctattgactgaggccactgcttaagccctgtattcttttttatttcaatccccatggttagaaaaatagtcctaaaatgggttcataccctttcctatcctgcaagatcttaaacatcactatcttttcctgcagtagttaaaagcatgggctttggaatcagaaactgggcacaaatctgagccctgctacttattaactgtgtaacattggtcaaatgaataaacttcctggagcctcagtttccttgcctgtaaaatgtgagtaacaataccaacttattttcaggttgtgagcatttctccataataatccacataaaacacttaccagagcccttggcatactgtgtgagcatgtaataatgttagctgtcattccaagacaacatgttggaataatctactttttccatcactatatatctcattttccttctttttcttctccctcaaacctgtccccattccaacagatgttttggcctgtgttcctagcctccagtgacagcagaaagcctgttagatttcctgcctttgtttcccaaaatttgagccccaagaaactgggacaagatattttcctgagacaagatatctcaggaaggggaatgagtggagcttcttttcaccccacactagaaagccattctgtttagaaaaaggagacggaagggaaagaaaagggtgctataccagttttccagtatcaccgtcagggagaaagcaaggccggagagtatctgggcagatgtaactataagcagcctaataaaggttcccaagtccaaaccatgaatccaaacggcagagctgccagacatgaaaggccttgctgcccttccaccccacaatacttcacctctggaagccttgacaattccagggagtatttgcaaaaccctgcccccacccaaaatttttaaaatactgcatatgagtgagtaaaatgatgccgagatttttaaaaggacaagcttaccatcagataggtagaatgagtagtagtggcagcggtggtggtagtgatatagagataaaagagttaagtggagttactgaaatgtgtagttatatttctcacactctggtgtttgtggatttgtgggctgagattcttatcaaattccggaacttgcaatgtctcaaggtaattgtttaaaatattaattgttttactcacactgcaaatgttgatatagatgctggggtggaggtggggcaataggccagaataagcccaagaataccttggaatttgctgaatttctttctttttgcataatcttattcacacattaacataatatgaaccactctggctccatgagcagcacagaagagactttctgcaaatgtgattattagggcaaaagttaggagattttttgcccccagcttttctcctctcctaaaatctttttttttttttcatttctttgtcagtgtctttaatttttttagctgcatttaaaaggctttctattatttctgcatgagtaagagcatgtgtcatgtcagcctccttgtcagcttctgtttcactttcattaaatttgttgattgagtgtaaagaaggaggcactgtcatcatttccagatttcatagctgtaggttagatctctctcggagcaatgccatgattactgctgcaattttgtaatggagccctggagagacagggatgaaaccagggaaggctccttatccctttcgtgggtccagggaggcagaaagagaggggaggaggatgtttctgtttcacctctattcattcattcattcatttgcttcacaaatattgagcacctcctgagtgacagacactgatttgggtgctggaaagcataagcagccctggtgcctgtcctcacagagcctatggtctgctggtgagacggacttaatcagataaacacactaatgaatgtatagttgcaccaacagatcctcatttaattgagctggactaggacctaggcatcagtattttttttataagcttcataggtaactctgccaggcctgggaatcactgggctagaccatgcaagttctaatcatataggctctactcaagcattaagcattttgattttatctttcaagctgtggtgaaaacgttactgaagagaggtgatatagtaagatgctcacggtttttaaaattaagcttttttattttgaaataattatagactcatatgcagttgtaagaaataatacaggggaatcccatatatcctttatccagtttccccaatggtaacatcttgcaaaactatggtacaatatcacaaccaggatattgaccttggtgcagtcaagataaagcattttcaacaccacatgaatccctcctgttgtccttggatagccctccccactttactcctggtgaccactaatatgttctccatttctataatcttgtcttttcaacagttatataagtggaatcatatagtatagaacctcatgggattggctgttttctctcagcatcattttctggacattcattcaggttgtttcacgtgtcaatagtttgttcctttttagagggctgactagcggtgttccatgtataggggtgccatagtttgtttaaccattcacatgttgaaggacatctgggtctgctccaatgttcagagattttaaatagagctgctatacacatttgtgtataggtttttgtgtgaacatgaagtctttgtttctctgggatacatgcccaagtgtgcaattgctgagttatatgatagttgcatgtagaaactatcatgcataaagaaactgtcaaactatttccagagtatctgcaccattttacattctcaacagtaatgtaccagtgatccagtttctcctcattctcatcagaatttaatgttgccactgttttttatttcagccattctgataggtatgtggtaattgcttgttgtggtttgctttgagtttctctaatggccaacgatgctgaacatcttttcatgtgcttagttgccatctgtatattacctttggtgaagtgtctcttcatgtctttggcctattttctaattggattattagccttaatgttgagttttgagagtttacttttatattccaaatactagtcccttttgtcaaatatggggtttgcaatttttttcccactctccaatttgttttttatcctgtttacagggtctttcacagagcaaagttttttaattgtgatgcagtctaatttatcagcttttccttttatggaccatatttttggtgtcgagtctaagtcgtctttgctgagtcctacatcatgaagattttttcttactaaaatttgatagttttaaatgttctctatttaagtccgtgagttattttgagttaatttttgcataaggtataaatcttaggttgaggctcactttttaatcttaaggattgctcagcatcatttattgaaaaggctatcttccctccattgaatttcttttgtacctgtgtcaaaacatcagttgcatatatttgtgtgtatcaatttctgggtcttctgttctgttcagtggatctatgtgtctatttctctgccaataccatatagttttgactatagtagctgtataataagtcttgaaacccttgaaaccaggtaagactggtccctttcatattagccttccttttcaaaattgttttagctattctagttcctttgcttttctgtatacattgtagaatagtgttgtctatatctatttttaaaacttgctggaatttttttttaagagacagagtcttgcactgttggccaggttggagtacaggggtatgatcatagctcactacagcaccaaactcctgggctctagcaatcttcctgcctcagtctcccaagtaggtagaactacatgcaactgccactacaatcgtatttaaaagtaaagttaaaaaaattttttttgagagaagatctcactctgttgactagtctggtcttgaacacctagcctccagcaatcctcttgcctcccaaagcactggaattgcaagagtgagctaccaggcccaaccagtatgttatgtgtgcagttttttgtagatattatttattatgttgaggaaactcccctctattgccatttttctgatagtttttaagatcattcatgggtgttgaagtttgtcagagtctttctgtatccattgattgttatgatcaagaattttttctttagcctgttaatacgatgtattaaatagcttcattttcaactactgagccagcctgaaataaacctcgcttggtcatgatatattattacatatgctgctgaattctattttctcttttactggtcttttggctggagagagtaggcttttgttggggctttacttgtacgtgcacattgttatttctgggttgtcagcctccttctctccaagtctgggatatatgggacaaaaacataatccagggagcccaccaccttgttagactttgagtccctagatccctaggtggtctggcttctttttttcacctttgaaaatcttatgtttgttttatacataatgttgagagtttttcgttgttcttagtggcagaagtatagaaagatactccatcttctcaaaaatagaagttcagattatgttttgaaaggcactgtaggcaggccagggaaggcttgtaaaaggctactgcactggtccaggtgaggggagttagtctggtagaaggctgtttcttccaccattctcccctcacattccactgccccatttgcatggagctggggttctactaccccagtagggcagcaagagagaaggagcaggcaatatcttggagcattacaccatgataaagggacaccaataccctccagatgctagctgtttctttctagagcttttaaacattctccttcagcagaagaaataagtcactcctgaaagcatcctaacaatgtgcatttctccaaagtttccttaacacttcacatttaacatgactccaggtataagcaacattaaacaagtcatatcttatgttacaacttgagtgaaactttaatgatgctgaatttgctaatttgctctggtataatgtatttcctgtttataatcccttttggctaatagcactaatcaacagaaaacactgacagactgcacaatggcaacagtaattctggacagagatagttttattatctacagatgaatccatgtttctaaaacattatttactataatgtaaaatatgggttgggcgtggtggctcacacctgtaatctcagcactttgggaggctgaggcgggcagatcacctgaggtcagcagttcaagcctagcctggccaacatggtgaaaccccatctctactaaaaatacaaaaattagccaagtgcagtggtgcatgcttgtaatcccagctacttggggggctgaggtaggaggattgattgaacctgggaggcagaggttgcagtgagccgagatcataccactgcactccaacctgggcaacagaaggagactctatctcaaaaaataaaaataaaaataaaaataaaatgtagtagataaaggtcataatttctatgcaccaaagcttttataggaggcctgtattttagcaatcaacctgtccttattctgttcaaattcaagggcacttgaatcactttagatggtgtcacctacattgggaagcaatcacagtatagatattttttcttattatgtttgcaaaataaacttcacaaaattgtcta

SEQ ID NO: 2135 - DNA, 650 bp, Homo sapiens
ccaaagtgcgtaactaagcctgggacctcacaaataagtctcttccctaatggccacctgattttcatcagacttgccctggtttcctaagcctttgggctgataactgtgtttacagcttgttaaatatgtgcctcatttattctttcccggatccacattcattcttgggaagctctcagtggcatttgtggagaccacagcccagagccctcctggacaggatcaccgggcagactcttggccagagggcagaggacttctgtgtgtaaatgactctaattcccatgatattaatagattatattttcagggtctgtcttgagtggcccattctctgtaggggataatggtttttagaaaagaacttttctggatgtaacaatgaaggttacattgaggagaacgacaaatggctcatttataaaaatgctgctggctgtgtgaatgtatcaattctagctaatctcacagtaaagaatttgtccagggactcctgctggtggaggagttgcctgtgttgaatgctaagtgaggtctcaaaaaggagctgtgcgtgccttgtgggggtctgggcagctaccacatcattctggaattctcctgcctctgtcaaggagcctgaataaacgtggatgctatcacctcta

SEQ ID NO: 2136 - DNA, 553 bp, Homo sapiens
ttccattaccggccagctacatttaaggggccattcaacagtggcagggagggaagagccacagctctggagagcactcttttcttctggtccattattttccctgaagagacccctgacgcctaaagagacggtatcgctctgctgcccaggctgcagtgcagtggcacaatcacagctgacggcagacttgacccccccaggctcaagcgatcctcccacctcagcctccagagtagcttggactacagccctgtctcagtgtggcctgctcccagaactgtttctcctgacttctcatttcaccaagaagacatggactcagaaaaatgaagagagaaacacaaagacacaggagcagcaaccaagcccctcttctccaggcaatcatctgacttcaattggcatagaccccttaggggtgtggacactgtctgaaagtatctggagagaccaagtttcagcagccactaagctgtcaaggctctttaaaaatctgattcctggccaggcacgggggcgcacgcctgtcaccccagtactttgggaggct

SEQ ID NO: 2137 - DNA, 1433 bp, Homo sapiens
ggaagtgcgtaccggaagtgccggcggcagtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcatgta

SEQ ID NO: 2138 - DNA, 3743 bp, Homo sapiens
aggacacagttaaacaacagatccactttattccatccccttggaataacatatttaaatttcttattggtttaattcgtttttctcacatcccgagttttcaaggtaaagccaagtaatgtggaaactacctatttctactgtgtactaacatgcatttaactacagttgacctttgaacaacagggggtggaaactgtgtaggtctacttatgcatggattttcttccgcctctcctacctgagacagaagacctttgccttctcttgctccttctgctcagcctgctcaacctgacggtgatgaaaactgaagcccttgatgatgatccacttccgcttaatgaatagcactgtagaagtctcgcatatatgatcatttaaaatttcgctgaagtcatgtctgaattctgcacactgccttatggatgtgggagaggtgactaaactgagtcaacgcagtcaaccacccaggacttgcaattccagggggttgcatccacctaaccctccggggttctggcttcggatagtgtttgatcaatggaagcaacaaaagaagattggaggacatgaagacaggttactggatgatattcgacatgagctgcaatcctccatctgaggtcccaacttttccagaaggcttctgtcctgttgcgctcattggattctgcattatgggattctcttgaagtgtgtgaagaataatgagctaaataaagaggaaaaacaaaagaaaacaaaaactgcagggacttttataactatcattgattgccagcttaagcctgctggactcttcacaaaactatatatgcttcaagcttaatatttaattttgtaattggaacatttataatcatattatgcatttaataaggatgctctaattcagatttactattatcaggaaattaaatttggagttacagtaatgcatgcatatatatgtgtgggtgtgagtgtgcatatacctatatatgtatatacatatataaagtaaacgccttcttttaacgtgtgttttaagtatagcttccatgtcctagttaattcagcaccctcccttttatcctttccttgccattgtcctctctactagactacaataaaaacaaaaaactatgaaagtaagcagcttataatcataattttaatcaatgtagcctatgcaagctttaagaaacatacgtctaacatcttagaaagaaagcttatgaacacaaacagcagaatacttaaatacatttgaaacattcacattgaattgattctacaaaattttgaagagcaacagcttttgaatttagagctataatcagtaccctaaagtttttaccactgagttactacctagtaaaaatatgttatatttgcaataaaagtacacattgtaaggacataagaattgtcatcaaggtacacaaacattttagaattattaaacatttaaataaatggaaattttaaaaataaaataacaatattatcatacaagttaatgatccagtttattaatttctaattctattgataaaacaagggattatttttgaaagggtttttctatctttcatacaaaccctttccaaaaatgtatagatacagtacggattctacctgatcattcttgtgcatatggtgatgtaagaaaccaaaaaaatgtaaattattttcataacactgtgaaaaccaatatttaaaaatacagtgcacaattagtagtgagtaacatatataaatttagaaatattatatttctgtacacaaagtaacattataaatgaaagcttcaggaataatgagctacttattattccggaaattatatatcaaaaatttcaaatatagaggaaaattaaaaacccactcatgacccatgaaaattaataacccattcgatcatacacttaccatgtaactttctgttaatttggtaataaataatgtcaagagattttaaatgaaaatacttattctgaaacataaaaacaacatctgagatgagcacaaatggatcaatagatacattattgattattttgtatcataaaatactatctagtacaacattctttaaaaaattcaatatttttataatgtaagtaaaacgggaagaactgttagagaaatgggcatcagatttagattaattctgcctctaacgcaaattgtaggctgagccctatatgttcttgaccattctaagttttactacattaaaacacataaaatattctgcgaggttttctccaatgggattttgaatctcactgatgactgtgatttaggagtaatgtagagagttttgcaactaactttactttacaccgttactccttttctacttgggggttcagttcaacacgctagtaaaagaaatagtcatgagagcatcctaaggaaagtaggcaaaatgttagtgcctcattatatttacaatctttacaaaacatgtatgtcagtaaaccatattaacatctaaagcacatgatatgtagaaacaaattgtgactacaaaatgtgtcttgtttcttaaatatgctaaataggaaataaatcacatctacttcaatttttaatctgtggactttggccttagtttgtgttttattttatttttttgcttttgattttaaccactgaaatcatttaccaatactataagccaggaaatacaatgtaactggccagttgagaattaagccttctctttttattattacaatcaaggggggaaatgcttatatatcttcctgcacaaaatgtttcatttatcaaaaaaaaaagtgagaaaaataaagaaaatttgggtgagataaataatccacaactattaattcaacagatattatttaagaaattcctacctgtaatttattttctaatatttctgcatccttagtatttatcgctcaaagatatttgcagccctcatagcagtgcttggaaaagagatttgctctgaaaatttagaaataaattcctgaggtgaatacagttcaaaactaaaatatattgctgtattatattggtttttctcatttgaaattaaaatctaaaaaaccttcatattaggttgtgtgtgtcaagctgccattataaaaacactaaatgaataaaatttcgcaagcaaggcagcattatcaggctaagtacatgtagtgggcttatatatggtgatgttttacataattcagctattaattcatctatagatttacatttcttaagtgcaaaaaaaaatgtaattatttcattacatatggaattcacctcccaaatttctcagaatctaagagaaaggattgacattttctgatatttcatttttgcttaaaattaagttcttaggatgtttagattttattataaatattacaacttaaattccagagttataatgaacggtctatgttttgaaacacagagggagaatggggtaatgactgaagtactgttttttcagtttattagtaaagatcagcttataagatgtcattgtaaaggtttctattgataattaccataaacaaagattaaaactttaaatactaagttctggatttctaagcccggtgaaagtttgtgcaataccatgccttgcatttatgatttttcttttaaaatgaactataaatgaagaaatttacacagaattggaaactattcctacttttatttgcattcttccttccattcattgctaatgttcaacaataaagcattttaattctaaa

SEQ ID NO: 2139 - DNA, 594 bp, Homo sapiens
cagaagaacatggaagccatgtgaaaaaaacggatcctaaggcagttttgaacatctggaggcctgatttattggagattgcaaatgtacagtgtaacatagctgtggagagcgagaagatcaggattgtcaatgctgtcattgcttttactggaatccccagcacgaattgaaggtctcactttgccacctaggctggatgcaatgcaacggtatgttgatcttggttcactgcagcctcaacctcctgagctcatgtgatcctcccacctcagtcccccacgtcgcttggattacaggcctgtgccaccacacctggctaactttttttgtaatttttgtagagacagggtctcactatgtttcccatgctggtctttaatgcctgagctcaagccatccgcctgcctcggcctcccaaattgctgggattacaggcatgagccaccatgcccagcctaattcttctaaatcttatcctagtaattaagccagaatttttctctgccaagaccaatagatggaccaagaagtactcatccttgtaaactttctttggataaattgcttacatataataaattcagagttaag

SEQ ID NO: 2140 - DNA, 1016 bp, Homo sapiens
tggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaa

SEQ ID NO: 2141 - DNA, 2804 bp, Homo sapiens
taatcaaacattttcccaaacttaagaaaaacaccaagaaggaatataagtacaggggacattagaggataagctcataagggctggactaaatctttttttttttttttttttttgagacagaatctcggaatctcgctctgtcgcccaggctggagtgcagtggtgcaatcttggctcactgcaagctccacctcctggattcctgccattctcctgcctcagcctcccgagtagctgggactacaggcacctgccaccatggtgggccaattttttgtatttttggtagagatggggtttcaccatgttagccaggatggtctcgatctcctgacctcatgattcgcccgcctcggcctcccaacgtgctgggattacaggcgtgagccaccgcgcctggcctaaatcttttaaggagactcagtctttgtggcctgacacttggggaacagtcagcttcaggaagttgggatgccacacctttgtttcttgaaccatttagggaggtgtttcttgaaccattttgaaatcagaagtgtgagtcctccagccctgacttttttttcaagattgttttggctatttcaggtcccttgcaatcccatatgaattttttattttttattttttgagaccgactctcactctgttgcccaggctggagtgcggttgcatgatctcagctcactgcaagctccacctcccgggttcaagtgattcttgtgcctcagcctcctgagtagcttggactacagacgtgagccaccatgtccagctaattcttgtatttttagtagaggcgggctttcacgacgttggccaggctgatctcgaactcctgacctcaggggatacgcccgcctcggcctcccaaagtgctgagattttggtgtgaaccaatgcgcctggccacaatcacatatgaatttgaggatatgctttttccattgagcaaaaaagctattgggatttttatagggattgtgttgaatctgtacattgttttgggtattgtcatcttaacaatactaagtcttccagtttatgaatgtgggtaacttctaatttatttatttcttcattaatctctttcagcaatgtttttacagttttcagtgtataatatttacttctttggataaatttattcctaagtatcttatactttttgatgcgattgtaatgcagatagaattgctttatttccttttcaaatatccactgctgatgtatagacaactgatttttgtgtgttgattttataacctgcaactttgttgaattcatttattagttcaagtaggtttcttgtagattctttggtcgtagagatacagttttacttctttctttcccatttggatgctctttctttctgcttcctgtcaacttgctctggctagaattttcagtaggatgttgaatagcagttttgaaagcaggcatctgcattcctggtgatcaaactaattaaattaaaatacatgtaattatttagtttgagacaattagatttaaatggctaggttagggccttaatccaatatgattggtttctgtataagaagaagaaatatcacagtgtgcatgcacagaagtacgaccatgtgaagaggtagcaagagagcagcaatctacaagccaaggaaagaggccacagaggaaaccaaccctgccagcatcttgatcttggacttccagcttccagaactaaccagggaccccactcccatgccgacagtatgggctgctgtcttcaggaccattgcaagatgtcagagctgcagcatgatctggaggctttcctcgctttcttctgcttcccctcccttgatccttcacaggcattttcctcaatacatctcttgcctggctaatcctgtctgatgagtttccagatggacctgaattaaaatcttgttctgctgcccaggctggagtgcagtggcacaatcatggctcactgtggcctctaccttctgggctcaagtaatcctcctgcctcagcctcctcagtagctaggactacagatgcatgccaccatgcccagctagtttttaaattttttatagagtccagggtctccctatgttgcccaggctggtcttgaactcctggcctcaagcattcctcccaccttagcctccaaaagtgctggagttacaggcgtgagccaccacccagcctatgcaaataatttttaaacaataaatattaaatggttttgtttcttttggagacagggtctcactctatcactcaggctggagtgcagtggtgggatcgtggctcatggcagcttcaacctcccaggctcaagcgatcctcccacctcagcctactgagtagctgggactacaggcacaagccaccacacctggctaatttttgtattttttgcagagatggagttttgtcatgttgctcaggctggtctcaaactcctgagctcaagtgatccacccgccttgacctcccaaagtgctgggattaccggcatgagccactgcatgcagcctaaactgtatattaaaacgactgctttagaacacagtcacagaaatgggattgagtcaaatggactgtataattttagattaattcatagattagtattggcaagttactttctattcagtttccacaaatctacactgccctgaaaagcatacaccctatcagggtctaaaacagtggacattataatttttcaaatagtttgtacctttaatgttttaaaaatgtatcttgtagctttaatttgaatttttacatttattaaagaagttaatgattttct

SEQ ID NO: 2142 - DNA, 267 bp, Homo sapiens
cagccttgatctctacaaaggaattttaccacagtgattaaagttcgagatgcacaacagaaagtccacatcaactgatttcattacacctgttacatttcaatacactccagggaaatggtagtcattaatattatataccaaatatctctggttgctatccctgggggtgctttgcactggcctgtaccctttgaagttagatgtgaccatgtgactttcttgagccaatgaaacatgaataaatctgatgtgtattattacaga

SEQ ID NO: 2143 - DNA, 579 bp, Homo sapiens
aagataagctaataactttggacacaatttcactcctctgcattcaccaaatgtccaattacatatcctccctgcctggaccttcagaacaatataaaactgaatgaaggctatgaaagaagtcacaggaggatttttgcagagcttccatccagttcagaaacaaagcaattcaatacatgtcttcaagatttctaaaggcaatgacttaattctaagttccatgaaagcaggcattgtgtgaatttctcctgcatctggaactggcctagcacaccaaatggagtctcactctgtctcccacgctggagtgcctctgaatgctgttttagccatggttctggagagggtagcgacaggagctgtctaggtgggatccagaggaaagtacgaatgagcagaaggtgttgaaaagctaattcacagctccccagctgcctacttgtggggacagctttcttcggctgcaggcagtaattgctttactgctatcctaaattgccctggagaagaaagcaaagctttgcttgctttatcctgtggatttaaagcagtgcctatacttgctctgcatagaag

SEQ ID NO: 2144 - DNA, 383 bp, Homo sapiens
tgtaagacagccactccacccactgcagtctacaaggaaagcctccatagctgtgcttattaccgccaacaggatttctttagtactaagcttcaagaaaccagcaacttgcttgagatgtgtcccacttctcgttctgggcccatgaaacttggatgaaactatgcctgccatctggttcttacttcagggtcacggacttaagattgcccattcattcctctttaataagacatcttggtggactaatggctaaccagtccatgatcacacatcactgtgatggtgtcacacacttggtattttttaatttagggaatgttgtgatccaacatggctgtcacggacttgatgcaataaagcaaactgtagctgagctgaaa

SEQ ID NO: 2145 - DNA, 5578 bp, Homo sapiens
atcgcggggggcggggcgtcgcgggcacagcgtgagggccgccgttgctggagttcagcttagggaaggaggactctgaggaggccccgagcggcggagcgcttcgggggaggcgcccgcgcagacgcgaggcccatagccaggaccaccacctagctgttctacagtctggggacgacggtttaaaaatttatgccttgcatgcgatgtgcagtgggtgatggaagaacgtctacatggctttaaaattggatttaaaaggcaaatattttaaatgaaggaaaacccaagaagtttacttgattccttatcttccaggatgcgacttttgtttatttatttattttattttgatggagtctcgctgccgtcgcgcaggctggagtgcagtgacgcgatcttgacccgggaacctccacctcccgggttcaagcgattctccttcctcaaccacccgagtagctgggattacaggcgtgtgccaccatgcccggctaatttttgtgtttttagtagagaccggggaaggtatgggccctcttttgagaaaaatgcagagtgacactgaattttgtaactacatcaggaggctcttgaaccttctgcagctcactcgtggagtttgtagagatgcgtaataatccgaagtgttaaggaagaaggttctgttgagaaaaagttggagggctgaaagggatgcctttcgctatttcgacatgtgtggctgtaccccagagtgccctggctaacacgcaaaaccatgaattaggcggcttggcgaggctcagtggaggctggggccgagagtcatgtcaaagtttgtggggttaacctgcacccagtgacagtcatggcgaagtttgtgaggttaactcgcacccagtaacgctgttccaatgcaaggtgtgtatttggtgtcatccacgggaagaggaaacagcaaattttctcatggccttggcagttccacatgatggacatttcatatctgcagttttcttcgcatgagatggcttttttgcacaaaaacactggaatccagtgagcaagaatgatagaatgcaagatggatttccacatgaggaagtgtcacgaacaagcgttttgcatctctgtcagctggattcccccatgtgtacgtatgtgagaacatgccgtgtttcctgtctgtaatggtagaggcagccctgatactggattttcacctgaggatggatagatcttcagggttcaagtgggtttgcatctggactttagggtggccctgtaggccctgtgtgagaagcccccttcccagtgaactttcccttgtgtgcccgcgtggacagccaacagggggagcagtgcgagcgtgaaggcagacagtggcctggcccagtctgatggtaagtgggccagaggcagtgagtaccatttcttgatctgactactcaagacaggcgcttccctaggtactttcacacctcattgcgaggtacgtgttgttcccattttacaggtgcagaagctgagctgcagaggcgttaggtacctgcctcataagtggtagagactccagtgtcaccctgcccctcacgttcggagcccccgagggagggtctgccgggcagctcagcccagcactctgtaaggaaatcttcagtgccactgcccaggatgtcttcccggggattgggcctgaatgtcttgaccatgccgtgctggaggtaggaggggtgtcttcatatggaagaactgtacatatttctttggcagatggctgaactctgtgaccccggggcctgtttcagcctcctgctgtcagaaagcagctgtttgggaagaggctgtgattcggccttgtttgagggccgatactctgaatgggtgaggcttggaatcctccctttggaacaaagaaacataatgattttgctgaaggtagaattgggggactaggcagagtggcctcctgccctccctggggtggttctgtcttttgcaaaggtggctgcatccttaggggaaggtgaggggagaagcagggagcatggagagaagtggctttcgattttctctctccttttggggagttcctccttatgtggctggtctggtgcatagtgtgatgtattcctgtacgcaacgttgccctgacagccagtccaagctgagtctagagctggcaaggtgagctcccagtagtaagagggtgtgggcggcaagccacccaggcaccgaggcaagagacagaggacacgagctgttccagtataataaaatataaaacaagaatagttataccagatatagatcttagatatgattatatatgaatatcattaatcatgagtttgcagcaattactttttattccaatattatgataatcctcgctctataatcatagcctaggaaaaaccaggccatacagaggagctgaggggacatagtgaggtgtgaccagaagacaagagtgcgaggcttctgttatgcccggacagggccacaagagggctccttggtctagcggtgacgccagcgtctgggaagacgcccgttacccggcggatcgtggcccagtggtagcaaaaggtgtcaaggaacaacactcactacttagcagaccgggaaaggggcggggggggggtctccctttccccgggggagtttagaaaagactctgctcctccacctcttgtggagggcctgacatcagtcaggcttgcccgtagttatccggaggcctaactgtctccctgtgatgctgtgcttcagtggtcacactccttgtctgccttcatgttccatcctgtacacctggctctgccttctagatagcagtagtaaattagtgaaaatactaatagtccctgatatgcagaaataatggtataagctgtctttctctctgtctcctctccctctctgcctcggctgccaggcagggaagggccccctgtccagtggacacgtgacccacgtgaccttacctatcattggaggtgactcacattctttaccctgccccttctgtcttgtatccgataaataacagcgcagtcagacattcggggccactaccggtctccgcgcattggtggtagtggtcccccgggcccagctgccttttctcttatctctctgtcttgtgtctttatttctacactctctcatcgccacacacagggagagacccaccgaccctgtggggctggtccctacatctggcgctctgacgtggggctctccctcgctgtgtgaagttgcaccctgagtgcgggatcagcggaggagttcaacgagagattcctgaggattgcagtctataaacttggtggaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcggtaagtataccaccggtcggggcaactcaaaattatacttattgggcatatgttccttttccccttctaattcggtctgtctcctggagggactctccagtagaagtttacactaataatagtgcattcatgccgatccctaatgatgatcggtttccagctcaaccggaagaagaaggtatgcactttaatctgtcaattggctataaatatccaccattatgtattgggaagtcgcctggttgtttagcttattcttaacagaattggatgtggactgtaccgtcctttacaaatgattcttatcaagtatataatgtgttcagtactaactcttttcaacttctcactgtcaaacgtaccccacatgaggcatggagagttcctctcactaccaaaactaataaaacaaaaggactgccggactgtccaaagaaacctacaaatgggccttttatagtgacttcaattttatgggataattgtaatgctcccaaggctgttgtactccaaactctagccatgggtattgttattgattgggctccaaaaggacattattggcaagattgctccagcaaaaataccttatgctcggagtttatttattccttagattatatagagcatgggtggcagtcttacacgatgagacaacgggtgtctccttacccatttaaatggatggacacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataattatgatgcctgatgcacaaactatagaatgtcataactgtaagctgttcacttgcattgatgcaacttttaatcccactacaagtattctcttggtaagggctagggagggggtatggataccagtttctctacatcgtccatgggagtcttccccctctattcacatagtcaatgaagttcttaaagacatcctcaaaagaacaaagagatttatttttactcttattgcagtccttgcaggactacttgcggttactgcaacagcagcaactgctggagttgccatccgcagttctgttcaaactgctcactatgttgaagcatgccagaaaaattcctccagactttggaattctcaggcgcaaattgatcaaaaattagctaatcagattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcatga

SEQ ID NO: 2146 - DNA, 510 bp, Homo sapiens
tcttcagcctgaaacccatccctagagtcttgctgtgtcgccaggctggagtgcagtggcacgatctcggttcactgcaacccccgcctcccaggttcaagcgattctcctgcctcagcctcccaagtagctgggactacaggcgtgcatcaccatgcccagagtcaagaaaacttttaagctatttacaacttttaacaattgagttaagtatactcaagaacaaaattcagagcatatttgtttctctctacctgatttctacagattttggaaactatttgtgagatgctggccagtacaactttctgctctgatggaaccatgctagatctgcgcttcccactttgtagccagtggtcatgcattgctatggagcattcaaaatgtggctaagggaaaattaatagaggacaatgtggttgtgaattttagaaggtcttgaaaagtacagcccacacacgtggtgcttactcagtgctgttacacataaggcggtaaggggaattt

SEQ ID NO: 2147 - DNA, 398 bp, Homo sapiens
cagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgatctaaaaaaaataatgctgggaagtcctaaccacatcaagaatgcctcagatcagtgacccaaggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaa

SEQ ID NO: 2148 - DNA, 1763 bp, Homo sapiens
actggtatgtgtggggctccagccacttagttggaattcaccatgaactgcatctcgaggatcaagtttaggctccccagtccattgtgacatccagcaaagtggagccgggcgcccccagcatcccgtctgtctgacgctaaatggcgaggctctccaacccacttagctccaagctcaaccttctgcaaaagttcaaccttctgcaccactggggatatcgtgcagctcagagatggggtttcgtcatgttgcccaggctgatgtagaactcctggcctcaagcaatccacctgctttggcctcccaaagtgctgggattacagacgtgagccaccatgccctgctggtttaacgttatattgaagtttctccaactgaagggcatgtactgttgagcatgctcagaagccaaggttcaagccattcttcaactatagatgcttcaactcatctctctttcttcggaatattctctcccttatcaatttcaccaattataccaagtaaccccctgcttattcccctagaacagacagagctgatactagtctgtgccttatgtgatttagaaaaagactcttggaatgcagccccagaccatgatgtacagagcatgagttgggtattgccccattttattctctaattcaggtgcccttgtgcagtgaataacatggcagctgtgagactagtgatgctaaacaggtttaatttttggtgcaaattctaatgaattaataatagctgttttaaaaaaacacacagtgctaagaaagactctgaggctgttttcaggctcagtagataaattgtactgtaagctgggatgatttgccttggttgggagaatggcaccaggtgtgacaagaatttgctatctaaggactagaggcatctcacccgtcctgaagaggtaggaagcctggggtaggcagatgttgaggtagaatgtgggcccagacaagttttataatttatagaacacaactttcaaatgcccttgtaatacaaggcaacaatcctacttttccaggtctctaacaaaaagcatctagctgagctagagtgttttcatgaggcatctgctacacaaaacaatgtcttgcttaataaataacacccgtttctacttggtgtcattttactgtttaatcaaaacttattttcaccactcttaaccacaatctaaagaaggatgcttcaatctcttcctgatttagccttaaacttggtcatgtgtaccattcgactaggattgccagagtcagccaccctcccaacaaaggatgctcagttaaatattgcacagaacacacttatactaaaaattgtttgttgtttatctgaaattcaaatttaatggggcataatgtattttacttggcaatcctacctgtgatggacatatatatttccccccagctttattaaggtataattgacaaataaaagtgtaaatatttatgatataaatggaaatataaacagatgctcctcgacttttgatggggttacatcctgataaacctgtcataagttaaaaatattgtgagttgaaaattcatgtaatacacctaacttactgaatatcctagcttggcctagccaaccttaaatgtgcccagaacacttacatcagcatatttgggctgatgtaacacaaaccctattttatcataaactgtttaatatctcatgtaatttattgaatactgtattgaaaatgaaagataaaatggttgtatgggtactcaaagtac

SEQ ID NO: 2149 - DNA, 2791 bp, Homo sapiens
ggtcatcgtgacaggcatgcctcacaccaagacggactatcaagacctgagccgacctgacttacataaatgacaaacactagtgctttacaaaggtggctggagttctccatcttctaaaatcaacatccaatccccttcagtcagcatcttcagtattcccttgaggactggaaaaccaaagcagctacgtccatctgtaacgcacccgcaccggacaggcacgagatgtcacgtccacctggcaccatccaaagagggtaaattggagaaatcacacctttcaaatgttaatctgacactgtaaacagcagttgagttctcatttacatgggcaaagaaagcactttaaactattttcacaactttcctacggaagaaaaggaaacgattcagacggttaatggctaagttttaaacaaatgctctgcatcactacttggttaagaaataatacaatttttgcccttgtgtccctttttcttcttggattttgttgtcctctgaccaaactgaggggtgggaagtgcagatggtggactagaaaggtcatctgtatagtaggcaaatctctgtggccggggttgagggattggttgtccaagaaaatatccttcttcttccgagtcggaagaggaggaggaggaagaacaccaggaatcatcatcctcgccgtagagtcccagaaaccgattcattcctgggttctgcaggccataatcggaagtggcatgggcgtactgtccgtagagatcagcattctggatgtatgcttggatctcccgggcacttttattctgtataaatttctcatagttatcgggggtgtacagccgcagtctgtccttgggagagtattttctttctgtaacaagattcagggcattgtcggagcgggactttctacttctccggcggcggtggtgatgagacctggatcccctctcttcaaaattgtagacgcgtctccgagtcctttcactcatcggaggctgccggatttcaatgtcatagttcccattgtcaatgacatcatcagaaaacttgacctgctggggtctggattgagacttggaccttctgagcactggcagatgtactggcttctcttcaggcaggattttctctggacacaactctgaacttagactctttaaggactctgcactcctgtgcagcatggaagagttcaaagttcccatattgctcatcttctcacaatcttctgtttccatctcctcaaaattttgcagagaatacaatgatggccttggcttgttttctccatccaccgaagcccctagaagagaggccaaaacaagatgtgcttctcaatcatcctaatattcgacagtacttaaaaatatccagtgctcactggctcgaatatccatctcattgggctgtggctgaaagaggcttttatcaccaaacttgaggaggagctgcgtcatataatcttcatgatcagcccattcttcagggtcttctggagtttcctgctctactctgcctttccaaaattcttcactggcaaaacttgttccttgtctggagagactcagatcatccaattttcgagaaagggtgtcatcagcattgcctgagaggccaggaaacttgtagttcagagcaggcgataagaggagagactgtctacactgatctgctgaccggctgctcttgcccattcggacacttcttcgggagtctcttgatcgagctgactgaaatgcagagtcggaagaatcagaggcatggacgtcttcaccaagactgcacgtttttgagcagtaaatctgaccctgtttgggaaggaagggacatcccaacaaagaggctttacactgggcacaagaaaagcaggcttccgtggcgtgccagtgctgcccgtcataggtcatctgtgcatggtccacacctgttttgaaaaggatagaataaataacaggttatggtttaatgcctgaaacaaggtataaggaagaaacgaagaaaataaataaagattatgggtatgggggagctgtgtgggtgacacagatataattaatcctcattctttgtggattctgtatttgtgagtgtgcctactcataaaaatttattcacaactcccaaactaatattcgcaacagtttcatggtcattcgcagatgtgcagagtggtaaaaatacgaactgaaccaacatgcactgatccaggagatgctcagctttttgtttcagctctcatactgtagacaagtgtcctatttctggtctatctactgccgcgttttctgcatttttgtgctctttgttggtgagtttactgtttaaaatggcccccaagtgtaatgctgataatgctgaaatgctgtcatgttgctaagggcaagaaggctgtgatgtgccttacagagaaaagacatgtattacgtaagctcctaatcttgagtacggtaccactggctgtgagttcaatattaatgcatcaacaatgtacattcaataaggcagtggctttaagcaaaaacacacgtgaaacaaggttatgtattgatgggttgatgaaactgctgtgaccagaggctcacaggaacctaaccctgtattcccccatgagcaatggttcagtgttcactaatccagtgtttgcagtaacgtcacagaacacaactactgcaagtaacaagaatcaactctctgttcatttgtcaaagctcatcagctggaacatttaagatctgtacatttcattgtatgtaaattatatctcaactttaaaaaacagaaaaagaaaaaataa

SEQ ID NO: 2150 - DNA, 1360 bp, Homo sapiens
acaagattgacgtgcactgtggtgtagaaagtttgtttgcctttccataacccagtgtatctaagaattacctcggaacttccatttctattaatattacctactaacacttaagtctgagtgtggtggctcatgcctgtaatcccagcactttgggtaaggctggtctcgaactctcgacctcaggtgatccacctgcctcggcctcccaaagtgttgggattacaggtgtgcgcccccacgcctggcctaaatgtttttaaactctcatcctgatcagtatttaggttatagataattttttaaaactctacttagaatattgtttcagaggagtctgtaaataacaaaactctataattgcagtcatagctgatgtatctatacttggatcttttccaaatgctcttctactcttgtaatttctagtctggtcagctggaaataaaagtatccagtaactccacttgtccatctaaaaatataattatttttttaactaacccattaagtattttttatatgtatttattagccaatcatgttatttactgtgactttcctgtttgtttcttttgctcattttctcaacctgctgatttatgaatacacacacatactctagatcttgattcttctgttattttatatataatatccttttcctggagagtagctgtttaaagtgcattcatgatttttctgatactgatagttttcccacatactatcatattatatttggatgttgccattatcactctaaccataaactggtaatctatttatatttttaatagtatgtgagatttctgtgtattcagtcagattatctatgaatggaaatgaattttcttttaaaatcattattatttctttacttttattaaaataaatacgattatgtcaagtattggggtaatagccagtgtcttagttgtttaaacagtttaatggaaatcagtacaatattttaccattcaactaatatttactttgttgtatgcaagtatgctctataattagggctaacttcttatattttttcaaatcctatcacttcttttgctttgttcatatatcattctcctctgctattttaatgttataattcattctgatttcttgttttaaaccatttctgaaatataatatgcttagctgtggtatattattgttttgataagctgcttaatttatcttatgaatattttgtttgggatttttgtccaaatattcaaaattgatattaatattattagcattcatatattaacattcaaaattaagaattttttaaatttttgttattgccattatttgtttattaaaggttagataaaatttggctttaaaccca

SEQ ID NO: 2151 - DNA, 2825 bp, Homo sapiens
gaacaagaacatcaatctttgaaatgatgccaagtataagcctctgtgtgtgtgtctccccactccaatttgtccaacagactgcttccaaagaaatcttcctaaaacactgaccatcttttttttttttttttttggctgcaaaatctttcatttcctcatcccctcacataacttccaatcttcttggcctggcactaaggacctactacagactggcactgaaatatcttccctaccttatcattccttgtgcttctccacaagcccactcttccccttcatcatacatgtgccgacctttcctgtctcttttactttgcagcaccaaatgctttctactttgtggtctaggaggaacacatgtcacttttgtaagctgctcgaaagcaggggccacaccttcatccttgttttccacacaacaccaagcacttagtagacacccaataaatcattgctgaatgaatgtattcagcctggaattgcactaggattttttggccaacacattgtattcttaactgataccagacttccaatcaaataaaatccttaagcctttttcatagtctttaattaaactacttctcttccattatttccctttgcctacttttgaactgatattcagaacttttctgttaatgtttaattttcatccattattcttgtctgtacagatctttttgatttttgactctcttatctagttttttttttttttttttggcttcccgttgtgttatccacaggcacaatgggtatattgactatcgttcattgaagttgttgatacaaatgttgaacaggagaaaaaccagtagcttgccaacttggcacctcattctctagcttgacagtaatctcttatctagtagtttttagatatggttatttaatcaaatatcactagcttctaattttgttataattcattcatgtatacagacaatgaagaatcatctttcttcattcaacacatttattgggaaccaatcattgtccaaggcaatatgctaggcattgtgtaatagaaagcgattaagcttttacccctgtcctctttggcctgcaaagagcaggtaagattcatgcacagacaaatgtagtaccaggtaaatagtgaggccaaacacaagaggcaggtcaaagggctttggattcagaggatggagaagctctttctaggctggtgaaatatttgcagaatgagtaggctcataagtggaggtgaggtacaggctaagctgctgtaagaaagagtccaaaatgcaaaggatttaccacaatgcagttaatttttctcacaacggtcgaggtaggcaggtggtccaagtccagttaatcagccctcctcaacacaaggcttccccttgtaagctcaggatgaccgctccagttctcatcatctcccaggcagaaaaacgggagaaagagaactagacgtaccacccagtcattttaaggacatagccaggccaggtgcagtgactcacatctgtaatccaagcactttgggaggtcgaggctggaggatagcttgaagccaggagtttgagaccagcttggataagaaagcaagaccttgtctctacaaaaaatttaaaaattaaccatgtgtggtggtgtgcacctatagtcccagctactcaggaggctgaggtggaaggatcacttgagcacaggagttggaggatacagtgagccatgatcacaccacctcactccagcctgggcaacatagtgagaccccatctctttaaaaaacaaaacaaaaaaacatcaccaggaagttgcttacatgtcttctattcctataacatcggcctgagcttagtcacatggccacacccagcagaaagaactctaggaaatatggtcttatgctaggtaaccccaaacccagctaaaactgttgcttttgaagaagggtgaaacagacaatgtggaggagaattaccagtctgccacaaagagaaagaattctatgtgaggaaaacgctctagaagagggagctgattaattagttatatctcagccgagaggatgttatgagaaacacagatttgggtttaatagaaaaacttagaacccttcaagaaggaatgggcggacttgagagtgtcctccgcttctgaaaatgatcaagaaaaatggtaagaatgtacacctcaagggtggatggtaaaggtcagcctttaagcctcaatggcggtgtggttgtaggtggggtgggggtggaggccccgaagacaggcagactaccacagtagccccgatggaagcagtgagaatgaactggaaggagcggctgtgggagcgacaacgtgatgagaataaacccggcttggctctgccctgtgcacacacaggtgagctgtgtgctcccggatgtgtcagctggtatatgcgtctgtcagaaggcagctggggagcactgttagctcagagactaagaggcagacccaggaagcccttctttgcattggtcagggtttgctgcattttcccaagcccaggaaatggaacccagttcttcttctttctgtgtaaaataataagcatcacaataggctgtgctcatgagaacgcattttgtttccacagaaatgttttttctcactctgtcctgattttgatttctgttaaactcagtaaacacattaccaaattttaaaataaggtgacttgttttccccaactcacagttcaccaaaggtatttcatctgtttgttctgaaaatgcagctgctgtctagatttatgtgtgctctgacaagaaatgttttgtgtaacaataaaaatcatttcctttgatgaa

SEQ ID NO: 2152 - DNA, 2079 bp, Homo sapiens
gggatggcagcctaccctgtggcaacgcgggagtcgcgttgccgcagggggcgcattggggtccagccgtccccagaacgcagatcagaggtagtcggacctttcccgctggcgcgcagcctcagctagggcacacagagtgaacagaaaaagaggatacctctgcgatcccgggtcatctccagatgctagggttatggtttattctagtgggcccaacctctgagaccatccttgaacatcagtagactgtgagttgtacatgggcgagagcagcttcgccaacccctgcaaagtgactctgaagaagatgacaatacctgcttcagtcacacccggaagctgactggtccacgcatggccaaagcatgagaaaactcattgcgggactcattttccttaaaatttggacttataccatagggacttcaactgaccttcctcagactgaagactattcccagtatatacgtcaagtcactgaggtaggaaaaaagttgctacagtcctattattttatggttattataagtataccaggactctaaaaagaacttgtttgtataatgctattctatacaaggtatgtagcccaggaaatgaccaacctgatgtgtgttatgacccatctgagcctcccatgaccacagtttttaagattaaggactgaaacctggtgggggctcataaacgatatgagtaaagtgttagccaaaacaaaagaaaaaggggtgcccaaacaagtcaccttgaagtttgatgcctgtgttgtcattaatagtaataagttaggaataggatgtggttctcttaattaggaaaaaggctatatggcaaaaaaaaaaaaaaagtacatttgtcataaattaggactgtatggaaatgaacgtgcatactggtcttgtgtcatttcggctacttggataaaaaatgaaaaggatcccgtccaccttcagaaagggaaaagtggcccttcctgtacaagtggtcagtgtaaccccttagaactagtaataaccaacccccttgatcctcactggaaaaaaggggagcgtgtaaccctaggaattgagggggctggactggatcctcgagtaaatatcatggcttgaggagaagtttataaacgctctcctgagccagtatctcaacccttctacgattaactgaatgtgtcagtaccagaaattccaggaaaaacaagaaatttgtttttacaattagctgagcatgtagcctagtctctcagtttcacttcatgttatgtatgtggaggaactataatgggagatcaatggccatgggaagcctgagaattagtacctacagacccagttcctgatgaatccccagttcaaaagaatcaccctgataacttctgggtcctaaaagcctcaattattagacaatactgtatagcaagagtggggaaggacttcaaccttcctgtgggaagactcaactgccttgagcaaaaactgtataatattactacaaaaacagccacctagtggagttcaaaccacactaagaaaaatccatttagtaaattcccaaagttgcaaaccatgtgaacccacccagagtcccactgggactgggcagcccccactggattatactggatatgtgggcatagagcttacaccaaattaccctaccagtgggcagatagttgtgttattggcactattaaaccatctttcttcctactgcccataaagacaggcaaactcctgggcttccctgtctatgcttcccacaaaaagagaagcatagctataggaaattggaaagataatgaatggccccctgagagaatcatataatattatgggcccgctacttgggcacaagatggctcgcggtgatatgggacccccatttacatgctgaactgaatcatacggttacaagctgtcttagaaataatcactaataagatcggcagagccttgactattctgacccagcaagaaactcagatgagaaatgctgtctatcaaaatagattggctctcgactacttgctagcagctgaaggaggggtctgtgggaaatttaaccttactaattgct

SEQ ID NO: 2153 - DNA, 1071 bp, Homo sapiens
gaagggtgttattttttcagatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacata

SEQ ID NO: 2154 - DNA, 1435 bp, Homo sapiens
ctttttatttagatgatattaaaactcagaagaattaattttgacattttgtatttacagtttatcagttaattttctctgttcaagtagtacagtaggcacagattaacatttaaatttttcacatatggtatatttcagaaatttgaagttaagcaaaaattttaatgagtagagaaagtaagtagccttcaggaaatcttcatagaggaccaggcccttttggaattgtgaataggtttattgccttacatcctggtacacatgtccaaggtcaggtcctgggtggtaaaggtaaatacaaattggaagggcactgtgtgagccaaaatgagtcagattagtcatgattcatttccagtttgggttttgggtggtcttggagaatgttgtaagcactgcttcattgataggttgattgagccagactttactcagcagcctggaaaaggagagatgggctctgggttctacctttgctcactggtaagttgctaagatttcagctttgccctcaaaccctgaagtagtccttcattcacacagtgggatcactcgaaaatgtcagatggggaagtccataggttgttactttaaagaaaatagaaaaaatgctggaaaaggtttcttcaattttaatacccatgaaggcccatgttttagctttcctccgatgggcaaaccatacactaacttgggccttgtaatcaacaagcaaggctaaaagctctctaagtgcttgctgtttaaactattttgtgttggaagaagagttggaaaagaggcagtgtggaggtgagggagaagttccctccctccaatcatttccaataaatggaaatttaaggagaaatttgtgtttatccttaatatctaagataatcactgtgcagtgccattggtacttttcatgagagtagaaacatcaaacttccttggatgggcccaacccaggtgacttaactctggaccaaatgtatgctttttgttttatccactgtggacagctgcatagataattggtctttgttctaaactgcacataaaaacatgggagaaaatgacatttgttgccttttgatgtgccaaagaagagtgggaatgttctaagaattctttttggcttaatctttgttgaattgaaaatatgtataactcttctgctgaaagtgtagcaagtacagtcatgaaattttgtggtcttcctgacatgttcttccagcataacgttgccaccttcagttggaaacgtatccttatctaataattaagccctggagaaaaattaatttatatattttattaattacataaggacattgttattagctaagcagagtaagtaaatcgaaataaaactttaaaaatgcctttatggagagaatgactatctctgaaagcttgtttttaatgatgataaaattcatgatcagaa

SEQ ID NO: 2155 - DNA, 630 bp, Homo sapiens
acagggtgaaaactgaggtttagagagggtaaataacttgcccaaaatctggaaaagtttgccaacccctggtcttactcctcattaaggtttcccttcctctccaccattcccaaatctgagtattccagaagagctactgtttttttaatgatatggtaaattaatttctaaagggattaaaatgaatacctacctgttgtaatgaaaataaatgtataacataaagcaatctgcaaaataactgttttgcaggcctaagacttatgcagaggtggcgcccgcccgtaatcccagcacttcgggaggccgagacgggcggatcgcttgagaccagccaggataacatggcgaaaccacatctctacaacaaatacaaaaattagctgggcgcggtggcacacgactgtggttccagttactcggcaggcggaggtggaaggatcccttgagcctctggaggtggaggttgcagtgagctgtgattgcgccactgcactccagcctgggcgacagagtgagaccctgtcagaaaacaaaacaaaacaaaagaattctgtaagaacttctaacaggtacattcctgtaagcattacccaccactggactaggcactgggtagcctgtaaa

SEQ ID NO: 2156 - DNA, 496 bp, Homo sapiens
gattcacaggccaagacgctgccttggcgcagcactccccgtgttgacgtggaaggtggtgatggcagtgagcaaaaaagtgatccatgcacagatgcatttgtgaacgccggatgaaacaaagttaaaataggacccagcggatgaagtggactgaaacactgaatctgaaacattgatgatcactacagcaaagggaagagctcggtaaattgtgcatatcgttcttagatcttccacccaaaagtaacacttccacttacatgtattggccacgagacaggattgtgccatgttgcccaggctggtctggaactcctggactcaagtgatccacccacctcgaacctcaacttcctaaagtgctgggattacaggcgcgaaccactgtgtctggcctccgggtggttttaagtgggaacttttatttctcacacattcttctgtatattctatattttctacaagaaatatatattacttttctaatcaggaa

SEQ ID NO: 2157 - DNA, 647 bp, Homo sapiens
gtgtggggacttcattttgattttcagtctgatctgttggggtctaggcaggagcttggtcccaaacaacacacccatgtgtgctgaggacacgctccaggggattcttacgcccgcctgcatcagagaacccaggtcttgtgggcgaggcagcgtggagagggagcgcagctctggagacggcccccagggcttgcgggcgggcgggcgaggcagcgtggagagcggagagcgaagctctggagacgacccccagaggagattggccaagtgcggatgtgcgagtcctccctgcccgaggcgcaaactgtctcactccaaagggcgtccggagggttctgcggggcggctgtgcactgacacctgccccccacgtgggagtccgccggctcctggcccttgccggttggtgttgcgcgtctgagatgacgcccctgcggtaggagcggggtttccctgatcaccgcttcttttgaccatcttttctggcagggccttgtatttttaaaatgtgtaaaggttaagctttctgagatcagaaaaataatatttagtgaaccatgtgatttaagtcactgtgtatgtgacatgaaatatttatacctaacccactagcaaatggctcgttaaacatatttgagatttaa

SEQ ID NO: 2158 - DNA, 471 bp, Homo sapiens
ctcttgttgccggggctgcagtgcaatggtgcaatctcggttcactgcgacctccgcctctcggatgagaaaatttaaagaagacgtgtaatttctccaaagtcgcccagctcagaaatgccctggcggagaatgtgaagatgaggccagagggaacattgagaagaaggatctcagagaagaaggaaaattcagcagaacctaggaagtgcaactgctattgcctgggcctttgttcctggaatggactctgagagtgcatgatgcagcttggaggacgtctcctctgggatccctccccactgcccccaccgcttcctggggtgaatgagtcctctgtagccatcaggattcgctgtatcaggagtgttcctctgctgtcacctctgatgactattttcctcaattcagaatccccagcacctgcaaaaggcctggataaagaaggggctgagcaggaacagaggattg

SEQ ID NO: 2159 - DNA, 3222 bp, Homo sapiens
atggaataggccaatgatgcagcaagagaattgaaggttagactacaggcaggacttcctagagatcaggtttattccactggctgtgcactcccattccaggcccactgtttatcccccatcttccctgccctctcagcatctgccttcatacctgtccctgcactttcctaagcctgagatgatgggaaatttcctacttttcccagatcctcccacctccctgccatcataacccccatctcccccactgtgtctggatatcattccctagggtcagagttgggagaggagtggcacaaccagatgcttagggcctctctctgacctttcagagggaggaggttcttgatggggccagattagaggtgcggagaccagctccaggcattggggtgcttgggaggactgttctggggctggagtggggaccattgggcaggagcagccagtgcccaccgggtgctgggaagactgtttgccatgcatctgagctgtgccagggcctgggcctggcccccttctggtgccctccctcccttctctctgggctggagctggagctgctcacagacctggctcccatctctctgacgggcagcccagagacccatatagttggagtcattttggggccaacaccctggaccaccctttcacctctgtctgacagtgggagagtgagggaagagggcctaaggccaatgaggacctaactgctctggaacatggagggcaacctacccttgaccccaaaaatgggagtcactgaccagtgaggccaagagggtagccccgtgcagttctgagagagctctgtctctccagtctcgggcctcagcctcccaattgcagctaggagccctgaggaaactcagacttccccacatccggtaccagcctcagaacccaggggtccagggttctgtggccttctctatcccacacaccactcatctccacttcctcttctcttcctccagagcaggccacacctctccaactctaaccctgagagctcagcagtcatgcggtccgttcccttgacgccacaacatccccctctctgtttcagctccagcgtctgtatctctgcccttgttttgaatttcttgagctgttcaggaaactttcctcttgtcacatcatttctgtctgacccgggatgtccatctccctcacagtcttcatagacccaacccagagagttaagaccaggtctctctctctctctctctctctctctctctctgtgtgtgtgtgtgtgtgtgtgtgtgtaggcatgcacgtgtgtacacacatctaacaacacccaccacctccatgctgaatgcccatcagccggcagccaaggtctgtcccataggaactgagctccagcactcagcagggtcagcagggaggcacaagaagccagagctttggctatagcaggagggaagctctctgctacccccttaacggcttcatgaggagcaacatgagcctacacaatataagcagggccttagggcctgtagaagtaattgcaatcatcatataaatagtcctttttattggaagcaaaactaataatactattagcaatgacaccagccgagcagttgcagatccctctcgtatagaatctgaaatgtggatgatgctgttataaatagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaataggtgggggaatacctgacaggatatggaaatacctgggagagggaattcccaggcccctggcagtgctaggaaggaatgcaatagtggtaaccgaattccagctaatagttactgatgtctacctgagccagttctcctaaatgcttcctgtggataacctcaactgtgagaaaaagattgtttatgttttgctcattacaccgatgaggaacccgaggttcagagaagtcaactaactaccccaaggtcacagagcaaggagccgagttgggattccagccgaaatgggcactccgaccaccccctagagcggctctgatcggctgtcctgccggactacagtaaggtgtccccagaagggttgctggccgctgctcctggagctgcctgtgcgtgggggcacggaggcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactc

SEQ ID NO: 2160 - DNA, 549 bp, Homo sapiens
agaacctgcctaaattgttatggtggcacatgtgactgatggatcttttggatttgaatgcctatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 2161 - DNA, 3685 bp, Homo sapiens
atagttggctgtatttctgggttctctattctgttccattggtctatgtgtctacttttataccagtaccacgggtacactaaaatctcagacttcaccactatacaattcatccatgtaaccaaaaaccacttttaccccaaaagttactgaaataagtatttttaaagattttaaaaaatagagaggaaagaggaggctatgaaattccataatggagttacagatgcttgacataatttagtggatattggatttagaagcttacatgaatgaggcaaacctgagatctgtgatatttgtaaatgaagataggagtgaacttactgcccttaggagtggagggagggaaggaagggagaaaatgagagatgccataaaatctattacttcaatggatttgaagtaatcctttgaagcaggcagtgagacttacttcataaatccatacctttttaatgtggattggagagaagttgttgcgctgtaatacctctgttgctactgtgagagtcattgccagccactattctcatgtcaagctgcccttgaggaggtttctcttgacccaatttagaaacaacccaaaacaaggtttgtaacttagaggaattctttgattctgtgacaaggggtctgtgaccctcttaaagggatcaagtacacaggagatagtacaagtagtactaaatagccagcttaaaaaattggataggtgagatgagacaggaacagtggacagaatggctctaggcatccccaaacaccacatctgggataaggaaatagtacaatggaaagtctatccttggacctactatttgtcattccccatggcatgatggaatatctaaaataaaaagagttgctttggagaaggattgcaaaatattatttcatagaagagatttagaagaggggaaactcccaattacataaggtgggcattatagcttctcaaaacattggttccctatatgggtcatgaagattgatcccagtatcagcctatggcttactaggccagtttaactgaaagatttaatgagcttggaaggatgctgccacctgcactctcactttggcgggtgtttatcaccagtgagtgcggtccctaaaggagcaaaaggacaataagcacccagtggacaacagtgtggcattttgagtgaagatagcaactgaaaaggtcatcggcttggctagattgggctgggcttgttttttaaaaataaaaaaaaagttttccttcatgataaaagtaacaggtgatcattgttaaaaaataaagtatgaattaaaaagtaaataatatgtataattttataagccagaaaactaatttgtaatattcaggtgtatgtcctttcattctttttaaaaattatgtatataacacagttttataacaaaattgacatcatattgtatatatcattttattatctaattttttcatttgaaaattcacaagcatatttccatgttattgttctttgaaaaatacaatattaagtgctccataatatcttatggatttaacaaagtttatttagatgatgtcatgttattggacattttgattattaccaagtttgcgtataaaatttaaatgtaatgaacatcattgtacattaacctttatgcacatctggaattatttctttagaataaggttccagaattaaaattatttagtttggatgatgagagcatttattagagcatctgacaggtgatgctgaattttcctcaatacagttgtgcaaattgcattcccaccagtagtgtataaatgtgaatatccctccatatattcatcaaaacatggcctttctaattttgtaaatctctgctaatttaataggtaaaaatatacctttgttgctttaaaatttttatttctaatttacacacagtaaaattcactctttttagtatatggttctatgggttttgacaaatgcacagtcatgtatcttctacactagtaccatacagagaagttctgtcactttaataatttctcttggtggctctttttgtattcaaccccttaccccatactcaatctctggaaaccatcaatttattcttcatccctatggttttgccttttccagaaggtcatataagtggaatcaagcaatatgtagcccttttggtctggcttctttcacttagtaaaacgcagtcaagattctcccatgttttgtggataattatttcattcctttttatcactgagtagtacttcattgtgtggatgtaccacagttttattatccattcactaactgatgaacttgtaagatgtttctagttttggtgaatatgaacaaatttgctataaactttcaggtataagttttgtgtgataaatgctcatttttatagggtaaatgctttggagtgggaatgagtgccagactgttttctaaagtttccctagcattttgcattccaattacaaatatgtgagagttccagtagctttgtatctttaccagtatttagtaattttgtattatacatatatatgtatgtaaatatatatatatattcatttaaattttaatcattgttagaatttgtaattccccaatgatatatggtattatcttttatttgtttataattgacacataattatttatgggatacattgtgatgtttcagtacatgtgtacattgtataatgatcaaatcaggatatcacctcaaaccttatgatgatcttacagttaaagatgatatattcttgcaaagtgtctgttcagatcttttgctcccctttttattggattattccttttcttactgtttttatatgttttttaatatattgatacaaatcctttgtcagatacattatttggaaatagattttcctagtctgtgacttgtcttttcattctttgaacactgacttttttagagcaaaaattttaattttgatacaattcactttatcaatttttttacttttgatgtgcaatgtaagaacacttgtctaacccaatgtcatgaagattatatattattttcatccaggaattttatagttttaagttttacatttatatctatgatactttttgaataaaggtttgtataaagtttagctatgggtcaaggttcagtttttaaaatatggctatctaattgttctagtaccatttgttgaaaagattgtttcttttttattgcattgcttttgcacttctgtcaaaaaatcaattgattatatttgtttgggtctaattctgggctgcctattctgttccattgttatccattcacaaataccacactttcctaatcataggaagtcttaaaattagatagtgtgtacaacttcgtccgtctcaaaaatcgtgttgattactactttgcttttccagaaattttagaattgttgctttctataaaaaattctgctagtatatctgttgagttagaactatagatgaatttgaagaaaatttacatcctcacaatattttgtctttaggccacaaacatgatatagctgtatatttattttggtcttgcttttttttccactttcagcatacagatcctggacatattttatatttataccaaatattttatatattttctactgttgtcaatggtagtggtttttaaattttcaaacattcattactagtatatagaa

SEQ ID NO: 2162 - DNA, 832 bp, Homo sapiens
ctcaactgcaccagaaggcctgacagttaagagaacccagtgaagaaaccttttgcagagagagaaaagaacccttttgaatgtgatcaatcacgctgatttatttggatgatttctcttctggatttccttaaaccagggaaaacccagagacagaggtcttgctatgttgcccaggctggtctcaagctcctggcctcaagcgattctccttcctcagcctccaaaagtgctgggattacaggtgcaacagtgacccgtgacgcagtagggagggctgttttccatgcccagtgaggcctgctcagctcccattaggcctttatggatggcctgcctcccagctggtacctggtcccgtcacagtcccaggactctagacctcgaggcagccaggtgggtgctacagatggtgacctctcggtggcacagcctggcgctgcagcagaatgcagggttgggggcggggtgaagaatggagtctggattgtgccaaaacaggagtttctatgtctggtcctgccaccgactgcacctgcattgctgcgtgaccttgacagctactccttccacacctgaacgtcctcatctggaaactggacttgcctcctagggttcctgcaaatataaaatgagctaatgcctttgaggtgtttgctattgtcctggcacttggcaaacacatgataaatattagcaatcacttgcgagggggtgtggggttcgggggagctttgcccctcctccccctctccagggctgagcagcagtgaagagctttctgcataagagagagcaagagagataaataaacccacatcttcctctgaaa

SEQ ID NO: 2163 - DNA, 637 bp, Homo sapiens
aaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccgggccgtttccgggctgttcgctcctgcttggcaatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacaactgcctcccgggctcaagcgagtctcccgcctaagccctcccgagtagccggggcttaaaggcgcaca

SEQ ID NO: 2164 - DNA, 587 bp, Homo sapiens
aatctgctgagctggtggccacctaaatacaatcgtcctgttcccctcattggtctctccggtctcctgattccagccacattttggtgagccagccaggagtgaagacgacaggtttgctgtctcctttgcctgtgggtctggggccccagcctgggggagacccgtgactccaggcatgctatcaggacaacttcaacccgaggggagatcagctctcccgcaacctggtgccgctctctgacagcacaacagaacctaaggggctacaggatgattcaaggaacagtgtgctacaggacctcgcaagaagaccctcaccagatgcagcccctctatgttggacttcccagcctccggaagttagaaatgtgctacaaccactcaaggtctgcaaacagattcctatttagatgttgttgagaggtaagtacaactagttctcattaatatttcatgtcctatgtgccatacttacactgccattttgtagtcatttgtcctacagctaaagattaatttataatcagatacgtgaaatctgatatgtgcattaagcttgattatacctgactgtgtcttcacga

SEQ ID NO: 2165 - DNA, 1976 bp, Homo sapiens
cacagttcatggtaaagcccaagactgtacctgcccatccactgccttttccatgtatcctggaactgagcatagacctcttcccaggcagagctgacagcaagtaaaggagatcataatcaggggaccaaacaactttgtctaaagtgtgaatgtcacctaaggagaagctgtgagatcagaagggtggggcagaggagcagacaccatgagggagagtccttgggggtacatctgccagactgacactgtctggcctgggcagtggaggggctagcaggaaccacaggtactggtggtgtggctactaccgttacaactgcctgtgcttggacatggaccctctgcaatatgcggcagtttcattcattgccccctacattctacaccaagtagaaatggaaggcaattggatacttcacagacaagatctaagtggagaaggaatgcgtcctgtggctgcagagatccttggagcttggaggggagagcttgagccccactgatgatgacctcccacagctcgccaactcagccctccctaagtccccatcgggggccaattctcactctggggttggggggactccaccatagctcatccatcatagggatgttggtatctactgtgggttgggtagggccgatgtgctgaggatggctcccccacaagcaagagatgtggatttggggagcttcccatcttgtgttgaaggaacataactcagaataataagagccaactataacaaacccacagccaacatcatactgaatgggcaaaagctgcaggcattccccttgaaaagtggcacaggataaggaagccctttctcaccactcctattcaatatagtgttgaaagtcctgatcacagcagtcaggcaacagaaataataaagggcatccaaataggaagagaggaagtcaaactatccttgtttgcagacagtatgattctatatctagaaaaccccatagcctcagcccaaaaggtccttcatctgataatttcagcaaagtttcaggagacaaaatcagtgtacaaaaatcactaacattcctatacacagtcgccaagccaagagccaaatcaggagcacaatcccattcataattgccacaaaaaagaataaaatacccaggaatgcagctaaccaaggaagtaaaggatctctacaatgagaatcacaaacgctgctcaaagaaatcagagatgacacaaacaaatggaaaaactttccatgctcatggctaggaagaatcaatatcattaaagtggccatactacccaaagcaatttatagattcaatgctattcctatcaaactatcaattacatttttcacagaactagaaaaaacttaaaattcatatggaaccaaaaagcctgagtagtcaaggcaatcctaaacaaaaagaacaaaggtggaggcatcacattacctaacttcaaactacagggctaccatgaccaaaacagcatggtactggtacaaaagcagacacacagaccagtgggacagaatagagagcccaaaaataaggccacaaacctacagccatctgatcttcaacaaagttgacaaaaacaagcaatggggaaaggtctccctattcaataaatggtgctgggataactggctggccatatgcagaagatcgtaactggaccccttttactatgtacaaaaattaagatggtttaaagagttaaaacccaaaattataaaaatcctgaagataacttaggcaataccattctggacataggaactggcaaatatttcatgatgaagacaccaaaagcaattgtaacaaaagcaaaaatggacaaattggatttaagagctttttcatagcaaaataaacaacagggcagacaatctaccaaatgacagaaaatttttgcaaactatgcatctgacaaggggctaatatctagcatctataaggaatttaaacacagttacagg

SEQ ID NO: 2166 - DNA, 433 bp, Homo sapiens
caaagcagacgctctgcccatctgtcactaggagccgccgctggcctccaactacccttccctaaaacctcagcttggagtaaacaccagatgtcaagaacacaaagcctctgatgcttgaggcagcacggcctctggaaggagatggggctggatgccctctgcctctttcgagacaccaaaggattcttgcagggttggaactgcagttttcagcctacagctttgctctgatgtttacacacactgaaagtgtgaaacatacggcaagagagagaaagaacgtgggggaagaggtcactgcagcttctctacaaagcactgactcaagtgattcagagtaaaactagtaccttggaaccaaataattaaaagccttccaaaaacaaagaccctgattaaacctgataagtaaagtttggtcatgaaaatc

SEQ ID NO: 2167 - DNA, 1871 bp, Homo sapiens
ctagcctggtggggcagacgatgcagcatgagcccagcgggcagcccagagctcaacccaccagggtgatcatggactccgtgatcacccccatctccacaccccgtcctggcctctgggggacctggcagggcaggctcgggcctggcgttcccaagcggggtgtgggtggcaatagttaccggatgaggtccaacagggcatcggctgagctcatgatgggcttcccactctgctccgtggtctccttctgggccgcgctgcctgggtggatgatggagaccatgaagatgcccacgatgacagccatgaaggtggtccacaggtagtacgccacggtgaggacgcccaggcggctagaggtcttggcatccagggaggcaagtccggacatcaagctgggagggcgagggggtcaggggctgtggtggggaggccagggcctggctggcactcagcgctcactcagcccctcctggccatgtccagctgcctcacagtgctccagggaaccccattcttccaacaatccagtcctgtgctccttccagcctctctttctgctctgccctctcccccacgccccggggcgcaggccacacacatctgtgccttgagacctctgcactgctaggcagagagcccaggccagggtggctgtgggatggtggggacactgttgggggagtgagagattaattaaggaaatgcgtgtgctttactttgttgcctcaagtttcccatgcttggtgtcctctcagaagcttccttcactctcctgacccctgcccagccaggcaggaccaagcttggtctacctctgagatctacctgcctctcccccagagtgaggagcccattctaggacccccacagcccctggctgctccatcaggacgctgcctgtctgtttgtgagaggagggatgagtctgacttccctgtgggtcccgagaggacggcaccgcaggcggttcctgcgggctcctggacgagctaatgaggagtgagtgagagcgctgggctgggggctggtgacccaggtcctagtcccagctctgccaactggctgtgtggcctcaggcaagcaagtcacttccccatctttgggcctcaggatctccatctgtaaaatggggacatcttgggtttgtgcctgggcccaggctccttgtcacagggggctgtgttgagagggctgtgggtctctctcctctcggctcctccccacccctagccaccctggcctgggctttctgcctaccagtgcaggtcagccccagagtactggcgtcctggagccctggagccctggagccctagagcaacgcttcttgcagccattgtggggggtgtgggacggtggggggtgtggggtgaagtgagattaattaaggaaatgcttgtgctttgctttgttgacaaaaggatttttccccaaagccctttcattctttcagataaagaagtatttgtctggttttaatcatgtaaacaagagcagataatccccagccacgctcctcttatcattagattccatgcagcagcatccagccccaggctgagcgtgaacaccggccccctcccccagcgggagccaccgcctgtgagggccctgccctgcctgctcgctggcgcaatggcttactcttctgattgagcccgtcttcttgtgtgatggagatgacacctcctggaggacccagcagcctcagaagccatcatctctctgggactttactgttccccagacacctgaacacccagcccagtggatccttaaccttctgagtgaagcactgtggagttccactgcgagccacatttgtaatttagaattttctagtggtcacattaaaaagtaaaaag

SEQ ID NO: 2168 - DNA, 657 bp, Homo sapiens
aaaacttactgtggaaaatgtatttacatactcaagttgtttgaaacataactcactgttttccaataactgaagtatccacttttacatgtattaaaattaaataaaattagaaattcagttctgcagttgcactagccacattttaagtgtttaatagccacacgtggttagtggcatctatattggacagggcagatctagagagaatcctgtatctaacaattttaatttttttccctttatgctgttattccttacctagagaaacaatttccctccaaagttcctttgaggggtctgtttaggccaggccaacacaagtgacctatgtggattttagcatcctttttttgaaatttgaggttttatgaagcttgagtttttctggatatttttagtaatttgctggtgtgtacttagctcaaatacttgattgcaactgtgttgggtcaactatttctaatgggacttttccatttgcatgtacagtcactggaaactgctgggcagagaaactctaaaaggtagttggggcacactttttccacctgtcagattggtgaagaattggtgaggctgtggggaaaatggcattctcccacttttgatggatatgtatccaaataaaagtcattcccatgctttctttcatcc

SEQ ID NO: 2169 - DNA, 976 bp, Homo sapiens
attgggaggcgccgaaggtggagaggtcggctcggaaggaaaagatcactcactcttgggggcatccagcagccatgttgtgaggacactcaagcagctgtgaagaggtgcacctggagaggaactgaggcctcccaccaaaaccaagcactgacatgccactcatggagcaacttccagtcctgcaagctccattcatgcaatcacaggaatatataaaacatgagcagaaagaggcctttggagaaatctggaccagcattctcattttacggatgagggaccacggcccatggaggtttccatagatgattggaaaaacccaagagttggtcctctgttccagaccccacacagacacaaacctacaagccaagggagccagtatttggccattcgtccatccatctgcatgtcccagggatgcacgaacagggaacacttcagcctttcggctgccttcaaagaagcaatgagagagagagagagggttactttgatgagtgagcagataccaggtactgttttggggaaactgcttttctctgagtctatattggtctgcacaaataaactaaaatgctttttaagttgttttatgatctatatagaagagatattgacaaacttctcctgcttagaaaataaaagggacacttggaattaacaaagggggttggtagatttaccattgaggttgatgaacttaatatatcatctggtaaaacaagcgtcaggaaatatccatcattcaaatgttttggctgacagcaaaatgctcaaggactaatcccacagctgaaatgtaggggaaaatttcccctacatttggctccttctggctcctacttggtctacacttttggaaggactgctgagattgtatccttggagtcagggcgagagtgccccctccttttccccacttggaaaccagagtttgtggaaagtgaagaagtgatgtgctggagccaga

SEQ ID NO: 2170 - DNA, 1542 bp, Homo sapiens
tctattattgatttcttatttaattttggtatagccagagaacaccatttatgtggatgatctcggctcaccacaacctctgcctcctgggttcaagcggttctcctgcctcagcctcccgagtagctgggattacaggcatgtgccaccatgcacggctagttttgtatttttagtggagatggggtttcaccatgttggtcaggctggtcttgaactcccgacctgaggtgatccactgcctcagcctcctaaagtgctgggattacaagtgtgagccaccacgcccggccttgtgtggttttaatttattaaaaattgttaaagtttactttatgacccagaatatgatctatctgggtatatgttctgtgggcacttggaaagaatatgtattctgttgctcttgagtagagtgttttataaatgtccgttatattaaaccagttgataatgttatccaggttttatatatcctttttgatttccatctatttgtttatcagttattgagaacagagttattgaagtctcccagttatgactgtggatttttccatgtctcttttagttctatcaatttttgcttcatttattttggatctttgttagttgcatactatatttcagtgtttatcttcttggtgaattgacccttttatcattatgtaacttccctatatttatatctttatatttaaaatagatttccttaaaccataagacatttgagaagtaaaaataaaataaaatagctttcttgctgatagcatatagtcgggtcttgtttttttctttttccaatccgataatctttgtcttttttttttttttggaaatggaatcttgctctaccacctggactggaatgcaatgacgtgatctcagctcactgcagcctccacctcccaggttcaagcaattctcctgcctcagcctcccgagtagctgggattataggcacccgccacgatgcccagctaatttttgtattgttagtagagacggggtttcaccatgttggttaggctgggggagttttctattatttatttcttgtttaattttggtatagccagagaacatgctttatgtggttttattaaaaattgttagtttattttatgacccagaatatgatctatctgggtatatgttctgtgggcacttggaaagaatatgtattctgttgttcttgggtagagtgttttttgtaaatgtccattatattaaaccagttgataacgttatccaggtttgatatatcctttttgatttccatctatttgtttatcagtcattgagaatggacttattgagtctcccagttatgactgtggatttttccatatctcttttagttctatcaatttttgcttcatttattttggatctttgttagttgcatattatatttcagtgtttatcttcttggtgaattgacccttttatcattatgtaatttccctatatttatatctttatatttaaaataggtttccttaacatttgagaagtaaaaataaaataaaatgtaatagc

SEQ ID NO: 2171 - DNA, 502 bp, Homo sapiens
accggaagtcccgcctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaacta

SEQ ID NO: 2172 - DNA, 2450 bp, Homo sapiens
caaaacaatttttttaagagcaaagttggaggatttatagaacctgattccaaaactgtcagtaaaactacaataattacaaagtatcagccaggtgccgtggctcacatctgtaataccagctctctgggaggctgaggcgggtggatcacttgaagtcgggagtttaagaccagcctggccaacttggtgaaaccttgtctctactagaaatacaaaaaattagccaggcatgatggcacacacctgtaatctcagttactcaggaggctgaagcagaatagcttgaacccaagagagtccagctcaaaaacaacaacaagaacaaaagtatcacattggcataagaatagacatgtaaatcaaataacaaaatagagaattcaggtataaatcttcatatttatggctgattgactttgaacaaaggtgacgaggcaagtcagtatagcagcatattcttttcaacaaatggtgctggcagaagaaaaaaaaagtacttggatccttacctcacaccatgcacaaaaattagctcaacgtggactatatcagggtttctcaacatcagcagtgttggcgtttgctggggtggataattctttcctgtggagagctgtcctgtgcactgtagaatgtttagctgcatcctggcctctgcctattagatgccagtggcatccctcccctgacacacacctagttttgacaatctctgtctccagatattcccaaatgtgccctggagagcaaaactgtttccagttgagaaccattgacctaatgtaaaaaataaaatgtacagaagaaagcatagcaggaaatcattctgacctcaggttaggcaaagctttcttagatatgacactaaaggcataattcattaaaaaaataagttgggctttgtcaaaattttaagttttgctcttctgaagaaaccattaaaaaaaaatgaaaagacaagccacagactatgaaaaaatacttgcaaatcatatatctgataaaggacttgtacccagaccatgtaaagaactcataactcattaataaaaggataaagaaaaagctgaagacaattcatgcaagaagatatacaaatattaagcacattaaaatgctcaatattattagtcactagggaaatacaaattaaaggcccaatgaaatacctattacacacccattagaatgactgtaaacaacaagactgataattccaacatctgaccaagatatggagaaactagaactctcctacattgctggcatgagtgcaaaatgatacagccactttgaaacaccatttggcagttgcttaaaaaattgaacattcaactaccatatgacccagcaatttcactctcaggtatataaccaaaatacatgaaaacatggatctgcacaaggtcttgtatacaaatgttcatagcaacattattcataataaccaaaaattagcccatcaactgaaaagtagataaacaaaatgtatatccacaccatggaacgctactcagcaaacttctaaaaagcaacaaactactaaacacgtgcaacaacatgaatgagcctcagaaacataagtgaaagaggtcagacacaaaagactacaaattgtaagattccatttagataccatttctacaaaccgcaaaactgtagaggcacgaaacagattcatggtctgctgcagctggggatgggagtgggaacagagagcaaacattttgggatgatggaaacattctaaaactggattgtgattttggttacacaactgtatacatttactaaaatcaatgaacagaacacttttaatgggtaagccttaaggcatgtgaattatacaccaataaagctattttttttaaaaaaaagagagagagagaacgagagctacatggcagccccagggcaatagctctcagatctcccttagagaaagaactttctcttccacagcaatgagtgcaggtagctaacactgaccaacctgcatctggtagttcatttaaggtcggccttggctttcaagttaaggccatggtctttctctgcagtccccagccaatacgtgggcacagaaaggcacagggcatggctgattcagcccaacatgaggctccacaccctagaactccctgtggagttggccgatactgcctgtgacctgcaatgtggtctaagctgtcagacctccacagtggccagaaggttttccatacctgagcctgcttctacccacttttatttttcccaggagtcacgcttagtcatctcttgctctttgaactccatgtctgtatcagctacccagaggacccatcagacagaaagtaatatgcagataacagcccaggggaatctgggcagcactgtgaaaccaacatttcttcagtgaaacctagaacaaaagtggaataaataaaaactaactgtctcatttc

SEQ ID NO: 2173 - DNA, 2038 bp, Homo sapiens
gcgcagccccagcccatcccgtgcggaccctacgccgagtccagcccggggctgctgggccagcgggagcgggaaccggacggcgctcgcgttctgccagagcggagaacgactcggggacggtgcggaggaccaggggaggagatccgcgcccgcacgcaccatcagccgagaggacggcccgcatcgcgccagtgacctaggagcgactcggggacggcttcgggctcccaggccctcctgggccaccgggcactgaggagagcggcggctggaaactgtgggacccgaagggcgggagcccagggcccgcccccgccggagcgcccccgccatggccacgcccccgccacggggatgggcagggcaagcaccggaagtgcgtcacgcgggagcgtctgcgtcgcctaccctgcgtggcgcagctaggttccgagcggcttagcctccgggcgcctgcgcagtggcggtcctagagacgcactcggttgccatagagacgggggcttgggagcgacgtcgcgctcgctggcactggcggcacttgccgcgccgcagccacctctttccgactccaccagtgcgggccctatccggggttttgagtcacgcagacctggacacagcgagaaacggcagtccgggcccgtcctcccgccccgggttctgcaccccagagttggacgcttgcttctcgctttctcctgagagaagtctccgcgtttctgaacaatgcactgctagtttctcatttctttctttctttctttttttttttttggagacggagcctcgccctgtcgcccaggctggagtgcaatggcgcgatctcggctcattgcaacctccgcctccagggcttaaactattctcttgcttcagcctcccgagcagctgggactacaggcatgcgctaccacgcacagctaatttttgcatttttagtcaagacggggtttcaccattttggccaggctgatttcgaactcctgacctcgtgatctgccctcctagggctcccaacgtgctgggattataggcgtgagccaccgcgcccggcctctcatttcttaattgtagacattgcgtacttccggagaaggtccctgagaacctggctgatcttccccgctgcacccctcacgtggtcctgttagctcccaaactgtcaacctgaaaggaaacccagaggcaggctctccaggacaagtgagttaatctgggaatcgcagggggttgcagcctaggctgttcgtgccatgacagatcataggcctatctgagagggccgggcgaaggggaaaatacagatgagctcacaaaagttgttttgtaacaaaaaccactggctgtgggcgcttgctgcaggagtgggcgttagcttgttgttggagagagccttaccaggccgacgtccttgtgcaagctgcttatctagaatactgcagtcctgaggaatttccctgcagtaagtccggttacaggcaaacgtgcaggacgtgcaggagcgtcttgtgaggaggcctgctgcaggtattcctgcatgagagctcccccttcgtggcctcccgactccatttgtttagggattggtggaagtagttccattttggtacctgcaactttcacagctgtcgtgatgaaatcaggcttagctcttcatgattgagtacctgctgttcactgctacagtataaaaccatgccacaattcctgtacaatctttttttttcttttgagttaataattacctaatattttcacatatctagctttttactaacccatggccagcctttttttcaagtaccccaacgttttcgccacatgcctaacgataccgttttccaaaggctcaaacacatccgttgtgtctaactgattctcctgttccgacctagaccgatcacttcctgacccggctgcacagctcttatctcgagcttttctctgctctcatccttgagactcactttgtctgtctcctttcttggattccctgtgtaaacgaaaaataaaatcctaagctctctaccaa

SEQ ID NO: 2174 - DNA, 519 bp, Homo sapiens
ctgtactggctataaggaatgctgggcaggcctcgctgccacaccacctcctgagagaagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgct

SEQ ID NO: 2175 - DNA, 476 bp, Homo sapiens
aataaatggatcaatcagtttaaaaacttagaacagtgcgtggcaaatagtgctcaagaagagtaggcttgtgaaacattcacatgcattgttttaacaaacaatgcttccccagacctccccacagagttgacgctctggaaagaaaagccaggcttttctctgaggttttgcatctccttggccaatgtgctcatgccagagaagagcagtgcatggccagtttgaggagcacggccatgtgaccttggacagcccctgcctctctctaggactcactcccggtccctaacctcagctctctgatctgtaccacaaggagctgccactaacacctgtgtcagaactactgtaaggaccctttcctcctgcgagaggagaacagtgctaaacctgtctgaacgtgatagacatgctacaaactgccaaccctttaggctataaactgctcacacatgggccaagtgtcactctca

SEQ ID NO: 2176 - DNA, 881 bp, Homo sapiens
tgcgtcctggtgaggacactgcgtttctttcagactttgaagatctgtcgttttagaaaagtggctgcctctgtcaccagccccatggttactgtcctgtagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaaaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcacctggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaatagtcatagcacgaatgtcatgaatccttgtgaagattttatgattagcacacgagttacaaggagacacgataactgttacgtacgtactcattcgttcggaaatacaacagacagcttagtatctccacccgggtccctctgccctgtgggaatccataaagaattgattctcatcccccagaagtgagatccc

SEQ ID NO: 2177 - DNA, 652 bp, Homo sapiens
gaaagcttctgtttgtatgtataaggcaatgtgcatgccagcatgtcagttacagcaggagagagggaacaagccatgtgggaactgatggagccatgtcacatccagtgtcctctgcagccgctatggagtgccaggaggaatgaggggcaaatggtaagatctttatgacgtgagagaagccaggtgcggagcagggaacagtcaggtttaattggtgtgaagaacaggatcactgaaaaatattttctcatagataaaactctttttgtataaaagtctacagaattgcgataggaaacccataatcatggtttcaagtgggcagagaactaggctctggcgtcaggggaggaaggggaactgttcactgtcaacaccttttaggacgtttccattgggatcgaagggtggctcactctgccactttgacataagaatcacttctacctaaggcacttgaaaaatggcacaggcaagagcatcatcggatctctccttttcttcctgaagacaggagataaaaacgctcaggtgaaagatgccttccctgtaccgggcgaagaaagattcctctacagggaagcacgtcatagccaacagaattctgtacagacattaaagtaattaaagtaattcctgtcgttcttaa

SEQ ID NO: 2178 - DNA, 141 bp, Homo sapiens
atggctcttcctcagggtctattgacattcagggatgtggccatagaattctctcaggaggagtggaaatgcctggaccctgctcagaggactctatacagagacgtgatgctggagaattataggaacctggtctccctg

SEQ ID NO: 2179 - DNA, 2432 bp, Homo sapiens
aacgagcagcagagccgcccagcagcaaccacattaggaaggaatcggaaaccaacgctccgctggctgtcaccccttacccacttgctgtcagaccacagcctgaggcagccaaacccatttccttggggatccagcgcaaaccagagagtgtggacaggccgatggaagaatgttggaccagctttaagaatgggctgttctaagtcatgaatattgtaggaagcagctctaaggaccacagggctggagggtgcacaggaaggggccagtgcatacaggtgtccaaacagtgtcatccggtgtcctgacatgcggccccaatggactgatccagggtggaaaggaagagtgagaagaaatcagacagaagaattcaggagatgtggcaacagagtggatgtagcagaagggacatagagagtgcctaaagatgagtctttggtcagcatgtgatgaaaagaatgaagacactggggaagtggggagcagaagcggatgtgggcccaggaggaagaagattccagagagcagagatggcaaaaagatgcatggaagagagacacagcagggtcgggttctggcctcaggagccaagggggaagtgcctgaggagacccccaaatgaggcctgtgtcaatgaggtctttaggggactggtttccatgtatgccaggccatactccctggattcccagcattgagaagaccaaacacttctacacatttattactgaagccccctgcaagctgaaggcggaggaagtggccaatctcctaagccgtgtgtggctgaggcagttgtcagagctgtgatgagggaaatgctcattattcttctatccctcacttggccaaataaagaacttcttagaattcttcccctgtgacaaaacggggctgtgatttggaaagcctcaggcaagtttgctagggccgcggtaaccaagcaccacagactgggtggcttcaaaactggacggcttcaacagaaagttattgttgctcagttctggaagccagaagtccaaaatcaaggtacttgcagggtcagttcgatctgagggctgcgagggaaggatctgttgtagacctctctcctaggtttgcaggcattggtcctgatgttcacagggcatccttcctgtgccttcacatcatcttctctctgaatgtatctctgggtccaaatttccctattttaaaataaggaaatcagtcctattgggttagcaccccgcccctcactttaacttgattacctctgtaaagaccctacctccaaataagatcacattctgcgtactgagggctaggacctcaacatctgaattcagggtgggtggatgcacaattcattccataacattaagaaggaagggataagtgcccaaggaatcacatgctcgcttggggagagttccaagcgtgcagagctggtggtcatagcctagcctcaggccttcggaaatcccctgaatctggttttcccagttctcataatctcatttcaccaaaatacggcatctcaatacattccatgcatttctggtgacaagctcattctggtgcacgctaagcaatgtgctaactacgtcttaactagggtggtttaactggtttggttaacatagatctctgagtcatttcacgcattccttaagcctaaacaaatctcatccaggtgtttaagacattgcacaatattagaccatctgaagctccatctccttggggcaatgatgatgatggtgatgaaagtggctggtgactgttctcagtctcatcgccataatggaaccctacgttgtgttcctccacactggtgtgagggacactactaagtgcggcagagtttgcactcaggatagagaaatatggactcacgcacagattccagctgagtccctccgatgtgctaggtactatgtccagccccccaggattcacctgtaagcaggacagtcttttggatgacagagggaattctcatatatccacaggcagatggaatttacaagtggaaagacctagaagttcagagacagggggactgaactttttgctttcagtcagaatctttgcttacggttgtgcaaatgcttgcattggtgggtttccatgccatataacgtgctacatatttttacgttacccttgcacataagcatactgttgggagggaaaatgaagagggtggaggtggtaacaaactcaagctaaggaaatggaatttggatgggtacaaagtccagagaattagcttgaggaaaatgaaccaggattcacacaggagttttcaaacatctcaatatcaggacccctttaccctcttaaaacttacttcgtgaggaccttaaagagcttttgtttgtgtgacttatatgtattaatatttactatattagaaattaaaagtaaggaatggttgt

SEQ ID NO: 2180 - DNA, 304 bp, Homo sapiens
aagatattctaggccccttgttgcttcagccatcagtctataaataacacaacactaattttccatcaagtaacagcttaaaacagaacactgtcaagattttgatttactaatttataatcttatttccaagcaaaacaagtcaatttcatgttacaacttttttcttgtttctttttatcttgtttggcctgagggttgggggatttgggggagttgtcagctgcacaatctttgaagtgtaagttaatttttatgtgatatttcagtatatattttattgattaaatttattggaaaactt

SEQ ID NO: 2181 - DNA, 557 bp, Homo sapiens
agtcaagtatgactgccacagagaaatggtcccatccaggaaatcagatattgagtcctacctgagtttccagcaagaaggtacggacttgctgttaggatgggaattatggatcaggaattgccctgagatggggtcctggtaacagatagactctaggataggattccctcctggggattgcggcagagtgtacttgcaagtggagccttgaaggtgtctttgctcagttcaaaagccacagaagaagttctggacgatgtgggccttcaatcttctaagatgggaatagaaagaagaggatctacccagaccaggaccctgctgcccaatctcagctctggctttctggatctgtgcttctctggtagaggaaccctgaggactgatctactcttgcagttctaaaaccatggcccatgacatgacttttctaagccagatgtaattacatcattggagcaaggaaaagagccctggatgattgtaagggaagaaaaaggaagatggtgtacaggcctcgctattccctgggacacaacaatattgaacgtagg

SEQ ID NO: 2182 - DNA, 510 bp, Homo sapiens
gcaacgtgttggaccttccggagcttctcagaagacagagggttttcttttgagatccctcccgtagctgtcatacagagtgcgatttatgacttgtaagttgtgctatggagcttgacaagtaagtttgatttcatttaatattttctttaaaccatcttagatcttctctttgacaagtatttcatctgttagtgttctcaaaatgtaaaatgggtaacttaatgagaacaaaaattgtaccctaagacatatttgcactatctacatatttgcaattaaatcttaacagatttaattgtaatagaatctaatggttttcctcttgaatttttttagacaccagaaattttcattactaataaataatgtttagcttcctagtcacaaaccaaacagaaagcaaatttcatcagagtttagaatggttaaaaccaacatagctgcaatatttttagttttgctttaaaattttttgaatcaatcagtaaatcaatcagagttgaccat

SEQ ID NO: 2183 - DNA, 520 bp, Homo sapiens
taaaggtgagccacagacatgcagcaccaccagagacaacaacaccccgtggcaagaagaccatgttctggactgtctccgtactgccacgggcacagaagaagaagaaaaccacaggagtcccatgaaggtgcagaggtctacacaggagttcaggatagacaccttgctggcaggacatggccacagactcctctaacttattccccaaagtgcaagagcaggtcttcttcagtccatccttctaacctgtccagagcagctgtatgcttactgccagatcgctctacccttctggggcaacaggactcgagccctgaggactctgcaaagctaggcccctgatggtctactatgcttagagaccattatgcatggggctctttgggcttctaaagggctccctgggagaaactgccttccaaatctgactactaagatgatactatgggaacagattgtgaggacagaaagaaaaaaataaataaaaattaaaaacgtagaaaaaagaaaaaaaaaa

SEQ ID NO: 2184 - DNA, 951 bp, Homo sapiens
gctgtcccacgcgccgggtcccgttggcgccggggcctcctgggacggcctggccgcggcctgcgggtatgcgctctttccagaaaggcagcacacgcatgtctctgccgtggccccagatcctccccgcgccgccgttttgagcgttcacactcattacccaggtccgtctgggagacccgccgggctcccgccctcccggcccgcagcctcctggccaaaatcctcccgggacaccccacctggactgctgcgaacgggcctccacccgcctccccggacccgcagcgccccccgctccctcagggttctggggtgaaggggtctgaatagcaccaggggaggcggcagggcgggcctgtcctacctgcgcccgagcactgctgagacgacatcccttccagcgccgccacgtagtccagccccagccagccgcggtcctggaagcaccgcaggcagacgacctgctcctcactgggctcaggcagggtcacccgcccagtgccgctagctgcaaattgctttacatacagtgacccaaagagcaagtcatttcagggccccaccactctgattggaagtcataagcttgacaactgattggcctctgtcacccaagcgggtgtggggacactaggcccgcaggtgccactggaagaggcgttcagaagcactgcggtgctccagctcctggatgcagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggacatctggagaacatgca

SEQ ID NO: 2185 - DNA, 3255 bp, Homo sapiens
atattttcagcatcacattttaagaataatatgtgaaatacaatatgttttattagtcacctttggaaaatacagtcttccacaatctggaaccacctctttggttcaaaatgtgccattcttctgtaatgtgtgtgataaacttaaaaaaaatctgtatcctttatcctaatcatcttacttgaacatcatcctgaaacaaatgacaaaaacattcacagttttatatacaaagttattggtaacaatgttcttaatagaattcaattagaaaacatataaaggcaaaggtagagttatttgatgttatggtttgaaaggattcccacactctcatgaatattctttattatgccagagggaccctaattcccctgcctttgagtgtgggatggcattgatgagttacttgtaccacatataataagcaggaagtgatggcacgtgacattggaaacaacttcgtaaaagtcaccgagactcactccttgctttctcctatgtctcccacctggcaggaagccatttgccatcatgtaaggcgagttcttcttagtgaggcattgacatctccagccagcagtgccgtgagggaggtgggcagctcaagcctcagtcaaaccctgagatgaccatggtcccactcaacatctcagctgtgaccatgtgggagaatccaagcctgagccaatcagcctagctgctcccagagtcctgactctcagaaaccatgccagattatacatatctgcagctttaagcttctgagattttggaatgactgatgacagagcaataaataactaatacatttcaccacatatcacttagcagaatgccatggagctattaaacacaatattttatgaagattagtctatgatatggagatatactcacaatgttattagcaacacaactagaccaactgagtataggtagtataatctcaatttgttctaaaaatataaatctgtacaaagatagaaagaccagaagaaaaaaaccatttaatacttgatagataattacaatggtaaagaatttagccttgatcacttgatttgagatggaatctaacttgctagctgtatacccatagttgtggatgtgtaaccaatgatttgtaaactaattctcagtttactcgtctatataaaagagctagtaatattacctatttcatgcggcttgggagaaatgaatcaataatatatagaagggcttagttctcatattgtggcaagtacttcacaaatgataatttttactattacaatttttataaggctttctgtaattcacaaattttctaatatctattttatgacttttgaaataattcttacaatatcccttttagtaacctttattacaaaatctattgtaatctcttaaaataatattcctttttgtttttctccgagatagtctatctaatgatgttacaatagagttaccaacaaatgccatatttcattcctgagcgtctatattcttgagttcctagcaacagagaacaaagtagcaaccatttcttaagaaaatgctgagatggacaccagagtttcaagcaattttcatccagaaggtcacatgttaggagtaaaagctatatggaatcttgaacaagcatagcatctaatagccttatttgattaaaaaaatgaatacacacaaaaattttttgaagactaactaccccttagaaatgttcgttaacttggtcagtaatataagcctacctcccatttattcaatagatcaggtaactcccctctttgttatgagcctagttttctagaggtggaccagattccatcatatgtacatcactcagctagttgagctctctaaatgaaaacttcagccgtagccactggatagaagaatacaagaaggaatgccgacttgaggagcaagttgtgttgagttcaggcattgctttggagaatctgcttcttcacctgctggcttaaagggttggatgacctgaggcagcagcagaagtttagacaattatggttggatgattcttaactgtcctaatcccaagtcctcaatttataagtgaggaactggaaaatcattcacacagctagctgcaagcaatgacagccttggagagaaatcaacctgtgtacagctcagtcccatctgagttctttggagaacaaactccagcagctacttctagaaaatatagacagcatattcagccaatctcctgagctggtgggacatttttacatgaacaaggcctccctccacatgaattgcaaagattcagtggactttgcatgattattcttctaatcttacattaagctttattttggattttaaaaaaatctgccacgtgtaagggcaccaatgtccaccaatattgttatataaaataacattattaatccttcctgtttatcttttaatcagaactaagagggatggtggatgatgaatgcatgagtcatacttacttcatgattctataaatcctaattttcactttttttaaataaaaattgcacgcaaaccaaaaagaagctgcctaaaacagacgtggagatactctacttaggtttcccagggaaagacaattttaaaaaacaattttagcaacaaaaatacatgggcagggaatacacgcatttattatcatttttcctcttaaagcagctatgatgagacacgtccaaaacacctgctcttgtgtactgcccagtttcacgtgagttctgtgggataacactgaatccactcttcagctacagtgaggaagtgatagaactgcttctggcacaccaaagaacagcacagaggtccaaatacatcttccttaggtgcccatgaatttaaatttatttctgctttatcctttaaaaaaaaatctaatgatttcaaatgccttgctgaaatcaacaccctctgcaacagccctctcaggatagttcatcctagtaggtctgtcaaaactgaaacaccaacatgtgagttcctcctctgggttttaaatgttagtactgtgactacttctttgtttgttttcacttttaattgacaaataataactgtatatgttatacagtaaatctgacattttgatataaaatgataactagtgactatttattgctgtgatgttgtccccgcttgtttattggctctgatggaacttttcaggggaatggttataactgaaaaatctgtaatgctaggaatttaacttttctacataaaatgcattttttctta

SEQ ID NO: 2186 - DNA, 304 bp, Homo sapiens
ctaggttggaatgcaatggcacaatctcagctcactgcaacctccacctcccaggttcaagcaattctcctgcctcagcctcccaagtagctgggattacaggcacgcaccactgcacccagggtacttggaagagctgtccaataagggttataaagcatgcagtagtccttggttgtgccatttccagacgcatgcaagattgcttcctgagcggctgtctaggagacaaacaataactttcaaacttgcaatgttatggcttgccaacaactaaggattttaataaagctatttatatgca

SEQ ID NO: 2187 - DNA, 2927 bp, Homo sapiens
gctgctgctgttgctgctgcgacgccgaggacgagccggcggtcaggccgtccagcaccttcctgatgttgaatttcctcatggtctcggaggggctcccccgcagcccgggaggggaggcacagggggtccccgggcgggggagaccacccggggccgaaggcagcttcgaccgcggaaacggaggagtgggagtgtgaggagaaatatgcaatgatgacatttccaagaagtgatggcatctggcgctaaggacaaagaatgggattttgccacagggatcttattctcccacatgttctgtctgaaggagaaagttatctgaggccttatatgatgcaaaactttggactcaaagaaattaaatcacttgcccaaggttacatagctgccacccaggagcttacaatttatgtgaggaaacagattgtatacatatacagataattaaaaatatatatgcccctggcaaacaccattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgaggtggtgaccagatggatataaacgggctgtggaaaaagagaatgcatggccaaaaatggtggtgctctctgtccaaaaactgaggccctatgaccatgaatgaagccagagggcaggtaggaatagatcatttgctccagaagaagctggttgccatgtcttgaggacagtaaaccctctggggaggttcctgtggtaaggaacaagggctcctggcaatagcctctgagtgagccaccttgaaaatggattgtccagccccagtcaagctttcagatgactgtagctcctgccaatgtcttcaccacaacctcatgagatcccaagctacaaccactcagttaagttatgccaaaattcctgattcacagaaattgacatacaggagaggtcacagttaagatcttgatgttctatcttgacccataatataggaacttcatcttttgggaagcaccagggagagctgcctgtgcctggcagaagctgcccatgccccactgataccccacagtacttcctgttctgcttagtactcctgcttctttctacaaacaactgtgattctctacctgggagcttcctctggccacaggagcctgctcacctgattgggacaccctagcagtactggctcatagatggaagggacttgccttgtcgctgatgagactttcgacttggacttttgagtcaatgctggaatgagttaagactttggggaactgttggaagggtgtgattgtgttttgaattgtgaggacatgagattttgaagaggctaatggcagcgtccccacctaaatctcttcttgaattgtagttcccataatccccacgtgtcgtggggtggagccggtggagataattgaatcatgggaacactttcccccatgctgttattgtgattgtgaattctcacgagatctgatggttgtataaacgccttccctcttcgctgggcactcatttttctccttcctgccaccatgtgaagaaggatatgcttgcttcttgtgccatgattgtaagtttcctgaggcctccccagccatgctgaactgtgagtcaattgaacctctttcctttataaattacctagtcttggatatgtttttattagcagtgtgagacaggactaatacacaaaggatttgaaatcacaaaggagctgttttctgctccaccatggaagtctcacatgcatcacatctattcatatccatttgccacaactagacaaaaagtcctttttaaaatctgcctagagatcaggaagtattatctctggatgcctaggcaggagaggtgaatcagatattggtgggcactagtgtgttctatgatacatagcttaataaaaataagtttcagataaatctaaatatacattagaatactgtaaccacagtagaaaaaaatattggctcctttttgtgataaactaatgatggtaaatgcaccctatttaagcaagaaaagaaactgatctgccataaagaaaacaatgacatatttaactacaaaatatgttacaaaatattaatatccctaatggacaaatgagttccaataaatggataacaaaaaaccaataagtctgtagaaaaatggagaaaatatatttgcagaatatttatacaggtggtaatgaaattgacaatgatgtttatcatcagcagtaaacagtaaaaagtttcacccaccaggactatagaaatttttcaaatggataattttcagaatcagcaaagttatagaaaagtaggtaccagttgcacataccattggaggaaatgtaaaatatagttaccttgtggaaagtaatctgatgtaatatattaaaattttatccatgtatgtcctataattcagcaattccatgttggggaatccatacaaagaaatacttatacacatgcagaaggagctaagtttaagaaagcacacatttcagcgggttgtggtgtctcacccctgtaatcccagcacattgggaggccgaggttggtggatcacctgaggtcaggagtttgagaccagcctggccaacatggtgaaaccctgtctctactaaaaatacaaaaaattagctggtgtggcagtgggtgcctgcagctactcaggaggctgaggcaggagaatcgcttgaacctgggaggtggaggttgcagtgagctgagatcacaccactgcactccagcctgggtgacaagagcgaaattccatctc

SEQ ID NO: 2188 - DNA, 644 bp, Homo sapiens
acattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccaattcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcaggatgacgttgc

SEQ ID NO: 2189 - DNA, 3838 bp, Homo sapiens
attgcagctgcctctcccgccgagttggagacggatgggctgggacgggttttgggggggtgtccccaattctgactgggagtggaggaacccctcctgagatctcttgtgggggtgccccctccccagggcactccccagtccctgagccagccgagaggaaggaggccagcgatgcgactggggcggctcctttctcctgcaccccaaatgtgagggatgcaccctaaattttgctcttttcaaaataggggaccaggatctcaggggagagtagctgaggtaagtggggagggaagtgtcctctgttttcaggagagacgtggcggttgggggggaggtttggaggtgcgtgctggggtggggttggctttgtcagtcttggaattggggggatgattggagaggctttctcttatacccctaaactgcagccccccagacggaaaccaaaggctgagaccagagagccccccaacatccccagccgttaggatagtgtttaatttctctttcaccccccacaaaggctctgccgaggtaggagctgggggcaactgttagtttgggggctatggagggtggtggaggagcaggaggccttggcaagatttgatggagggcagataggggtgtccgggaggggtctggcatcttcgggggcctaaaaagactgcttacatacaccaccttggatctttcagattgctaagagttttggggggtgtgtcggaagagggggtggtaaaagatgcgatgggatataggaagataacttctggattttagggggtcatattttgatttgcaaaaggagttttggcccttggattttgctttctgaggggtgtttttaaaaaatcaagtcctggacaggagaaaagggctgagggaaggcctggagttgggggtggggagaggcatgtttgtctcagcttaaacgtggctctctggggtgggcccgcctgccctggcctggtggatgggctgatggaggttgctgtgggggccggctcgggtcctcaggggccctggggagtgggaacagcactgggggttgaatacctggccccccaggtccagatggccctcttcctgggctctgctgctccccttccccctggtctccatttcctgcctttggcctccatcttgtggcaggcccagggcccagggcgacttccggcccccctctcccaaccatgttccggccccaccacctctggactgccaactcccaaccctgctggccttggccctctgtctctccttgcttttctcttgggttctgacccagggagaggaaggacggacacaggaagccttgggtccctgcccttgctgagacaggaggcagtgtgttggcccctccagtcattccctatttcttctgcctctgaccccaccctagggatcccctgagctgagttcctacagagggaagatggtccaatcttactacactgtgagctcatccccatggtccgtcgccttccagttgcctgctcagcccgtccctggttcctcccaaacgtttttgggggccatgtttgccttttaaggcttctctatccccccgctcctggaggtggtgctggggtcttcccagcactgctatgtgctctcttcctttcaacccaccccggtcctgctcccgccccagcagcacactgtggtttgtacggcactgtggccacgtccaaaccacactgtggtgttagagcgagggtgggggaggcaccgccgaggcttggccctgggaggccatcctggagaagtgacacaaaaaacatctggggccttgtgacaaacttcttgccaggtgggcaaggagagggtggggtatgtaagcacccctctaaaatctccagggcagtttcaagaatactgatggccagagaccctgggagtaagttctgcctcaagagaacaaagtggagtctttgttgcccacacccagcttccctggctctagcagcacagaaatattggcacagggaagcgagtctgccaatattggctgtgctgctccaggcagggtggtgaaaactaccgaggaggggctgagcccccatgggccgaggagagaagagggaacaggcctctcctgctaataatgttaagcagacagcacgaagctgagagggaaatctttattgttttctgtataaaaatgtccatcagatgaaggtcaaaggggttgggggcagatgcttatgcgggaatagcgaggtggcagccccagcagcctttcagccctctctcgtgcaggccttgctcggagtcccaggagatccacaggtccggcatgaacagtgagaggtcagaggtggaaggctcagcaggagaggagaggaggatcagcagaggtcatgagaaggccagaatccagggtcaggctgtctggaacaggaagtaaaatgggccgagatggagcgagcccccagtgtgcttccaaggccactcccacctccctgaaacaccctgctacgtactgatccaatgccctgcgctgtgtatgagagcaccttctcttctgaaacccctatacaagggaggggcccctgcggagaccgtgccctgccatccaggtgagccctttctccccaaccccgtcagctgtgtgggaggaggaggactcctaccctggtcgaagttgagtttcttagctggaggagtttctcctagcccttcaatatccaccacgtcactgttggcatcggagtcgttcagagcactgagtgtcacatctgggaagggggcataagctaggttctaggttcccctgacagcctctcccccagccccaagcttcccaaagctttgtgcctcctctcccctcccctctgcccctctctgggaacctccacagggacaggaagagagactgacccttctttgacccaggcccaattctctcactaaacctcagatgggacctttaacccctaggcagcaactccacagccctcaccagccttctgtttctttatggggggacccccggcctcagggacactggagctgctgggaggaggggcagctggaggaggtgacaagacaccagatgccaccttcttgggccctttcttgggtgactcagctggaagggggatgccagaatcttcatataccttgcgtttcacagtggcctttatctgggccctgaagaaaagagagaagaggttaggaaaggagtcatcagagagactaacagaagaggggacgggaggggaaggggttctgggagtcccttcataagaatccaggtcggggccccaacccattggtagggttctcactttctcgaagttttacactcactcaggatggatggagtgtggagagtggagtccctgaactgagtagtgggaaaggcccatctcctaattctcttctgggagagacatcaggtagagcttggtgatttacaggtggattgagatttactgatcaactagttcagggtcaccatatccctggaaacactgcagtggggtcctcaaacatttatataaataaccaggggacttccatcatcaaatacaataacagcatctcaggcaacctaaattcacattcttggaaggattaccacagcattttaggaacttctgaccaactgtgacaattctattctttcagtcctcaaggggattctaaaaaactagtgacaaagtagggaagcagctgagctggaaaggagttctgaggacgatggaaccttgggtaaggaggaagaaggctgcccacccgcccttttctggcagccaccctccctcacactgtccgttccttgatgacacagctgatgtgattaagatcgtccccaaatcgc

SEQ ID NO: 2190 - DNA, 667 bp, Homo sapiens
ggcatctagaacactgagaaatccaggatggacacttaacactaccaaagattgatctattttggagttagttctttagatcagaggtccccaaccccaggactgcggactgccactggtctttggcctgtcaggcacccggccacacagctggagtgtgaaaaaaaaggaaaaaactgaaaatctcaagaggattccaggaaatcaaaacaatgaattattgaatcaagaatttgaaagagaaaatagatgcatactgaaaaaagaattttgtttagtgagatagatgtaataatgaaggcatgttgataacgggggagctatgtatatatgaggggagggatatattggaaatctctgtatcttcctctcaatcttgctgtgatcctaaaactgctctaaaaaatattttgagaaggaataatgatgtggtaaacatgttctgttatttaaaaagagagacttttcatagccgcctccctccccctctacacacacacagagtcctgtccgtcttcattcccttactcaataatttgtacagacacagccactgggctccagtaatcctaaagtttctagaaaatcaagcacagaaaaaggttaaaaccctgagggaataaaagaattcctttgcatccattgcatttctcaggaagtgaactaa

SEQ ID NO: 2191 - DNA, 3571 bp, Homo sapiens
ctgagagaaggccggctcctgtgctctgcactctggcccagggctgctgttccgctggctgacgccctgtccccaccccagcatgtcctgcttccaggctgcttgacccggctgggctgggtgcctcttccccacccccgccccagtctcccgggccccatcccagcctggcccgtcataactgccgatccccagaactgtccctggtgtgcagcaggcatgcagggtgggcctgcagagcgaggtcccagcaccggcggcatctggcgctgaacacaggaagatgggacgtttgctgaatgaatgcacgtccctgatgaggcctggacttcgacggatgaaggggctggtggggtggagtcagggttccccgaaagccctgggtggagagggtccccaaagtggggtcagacagcctgtgaggctcacagtcctgccctgcagccctttggtttggaccaggtgccacctccccatctccctggccccagccctcagctaaccagcccatgccaccgcctggaaatgggccagagggcagtggcgacctgcccaagtccacacgcaggccacaggccacactctgaaccccggggcaggctcagacgggctttgctcagcctgccttagggcatagagggagactgagtcagggccctcccaggaaggatgggtgtgcggccttccacgctcgggactttgggccacgatgtccaccccagggtcttcgcagagcagcgggaaaggaccctgctggcaggcacagtgcccgtctctgcccccggctctgctccaaccgcccccagcccaagggcggcacgccgcagggggtctgtgatccccccacgtccccggctcctttcacccacacaccacactgggaggcggcagcccgagggcaggtttattgacaacctcacgggacacaagcaggctggggacaggacggcgacaggctccggcggcggcggcggcggcgctacctgcggtaccagatctgcagcctccgctcccgcttgatcttcctctgcagctgcaggatgccgtagagcagggcctcggccgtaggtgggcagcctgcagggaccttgcctcagtctcgcttcccgcagccggagcccgcgtgaccgcgtgcacagcgcagccggctcggctttggaagggtttcccgggccggcctctgaaggtggaggctgacagccctgggtgggcgcagtgccagggactgggagccggcgcaggggaggtccctgcaggaagagtggggtcctcccctgggcaaggccccactgccctccacccgtggctcatcccgggctgtcacagggacctctcggacaagacgctgacctcactaacccggcccccggccccagccctcaggactcaatgggggccagcgctcagcagacacacttagcagtggggagcagggcccggggctgccctggacggagatggaggcagggaggctgggcggagggaggggaggtggcccagagcccgggcatcccacgaggacccgatgaccctctttctgagccccaagccagagctctttgctggggatcccccagtcccggctgccacgcaggttcagaacaaagggcttgagcaagaggacgaagcccagggcccaacggggacagcaggagtggaaacaggggaagacgccaggggcatgggcagagctcctgaccccaggatggacctctctgtgctgtcaagtcacagggaggcccaggctgccctctccactgcccccggggtgacctgaaccgtgcagaacgctgaacaaatcaacgccctttccagggaagcggaatccaaagtcagagcctgttcctccacttttgagaggcaccaggatgtgcctctcgcttgcccaaacccccagactcgggactcagggctgggctctctgcgcatgagctaatgccgcacgcagcacagggtggccaagaacaggactctgtcccctgtcccacatgagcgccacctccaagcctgcctaccgtggaccactgtcaaggtgaacgcccggggggatggccctcgtgggaccacgtgaggtgcaagagtcccacgggatcaccagatataaagaatgttcccggtgcgatgtgaatttcaggtaggaccatatgaaactgctgtaaaccaggcgtgtgtcaggaattccactcagcttcccctgctccctctgatccctctgatgcctgaatacatcgccgacttctcacaggggacaggctccactaagaggcagcgctccgagtcggcccatccataggatgggggagcccgccgtctgctgggggtgtgggactccctcacaggggccgccgggctccgtgtggcgctggccctgtctccagctccctcgtgggcggtgcggtcccggccctacctgggatgtagatgtccacgggcacgatgcggtcgcagcccctcaccaccgagtaggaatagtggtagtagcctcctccgttggcgcagctgttggggaggcaccgtgaggggagtgtgccgaagacccgcctgcccaccctccctccacgaggcctcgccccatccccacccgccttcaactgcaggccaggcacctacgaggctggaacttgtcacggagaagcaatgagcaaacacgcacaggctcccagagcctctgtgggaccagtggggcgcaagctcacacgtggctgataactcggggaaaagtgctcccctcccgagggggctcctgaccaccgattcccggggctgggatgtgtcagatcacatgtgtcaacaaaaagccacttcagacagccacagtgccaacacccagcccctgtctatggggcggctgagcctcaccctcgcctgattccggctctgtcagtgaggcgctggggtccacccggggcagggagctggaaaccccaggagaccacacagactccactcccagcactgcttcccacagccgtaaaaatggacataccctgaatgcccagcagtgggagacggttatgaaaactctggaatattctaattaactgtttagaattagattagtaatatgtccacacagtgggatattattcagccaagaaaaggcacgaggctcggacacaggccacagcacggatgcaccttgaggacgtcgcgctcagtgagagacgccggacacagaaggccatgcggcgtgtgatcctgtttctgtgaaatgtccaggacgggcccatccacagagacagggaggggaggtgtgggcaccggggctcggaaggggatgcagagtgactgctgatggggacagcatttcatttgggggtgatgagaatgttctggaattagaggtggtggcctaaaaaccactgaactgctcgctttaaaagggtaaacttatcaagacctgatctctacagaaattttaaaaagtaggcacagtggagtacatctgtaatcccagcactctgagaggctaaggttgggggaccgcttgagcccaggaggtcaaggctgcagtgagctatgactgcaccactgcactccagcctgggcaactcagtgagactctgtctct

SEQ ID NO: 2192 - DNA, 936 bp, Homo sapiens
gaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 2193 - DNA, 622 bp, Homo sapiens
aaatgaagcagttggaagcaaagaagctgctgctttgggatccgcaaatcagaggatcaggaaatgtgaaacaactttcctgacagcttcagggagtgacatccaggcaggaactcggcggcttggcagagctggaggaggatagcagcctgcattcactggatgcctggtgtgaggaaagaactggcacatgtcctgattcagccatctgtgcttcctctccccaccaaagtgaaaatgcattcaaactaaattattttgaaaacacattctctccattcaagttctacttcaagacctcacaatagagggcacctccacgatctcattcctggcagcacttgaatgggggctgctgaacaatacactctcagtacttgctcagaaagaaagacaagacttgggacgaaaacaggtgaaagctcttccgagatttagagagacaggacccggtgccgaattgctttccaggcggtcaagccgcattgctcattacgtggagtgaatgggatgattccaaaccagccctggacgaggtggcaagtgaacatgtgctttaattgctgcttattcaatgtttaaattatacgtttttatatttaagccagtgttaatttatttt

SEQ ID NO: 2194 - DNA, 4625 bp, Homo sapiens
cctgtctcccggacgaggacctcaaccccttcccccgctcggggaccccggccacccgcagcccggccgcgctgcgcccagaaacccatgagtcttcctcagcagctgtcgaaacttgccggcggttgcttgctcacctttgctgtctccccttcagaaaaggctggaggggagggcgaggaaggcttggcgtggggacgcccgtcgagtctctcagtgaggaatgagaggccagcttctcctgcggggtatgaaggaggaactgtatctcctatatatattaagtttcatttataaagacatcagagagcacctgagaatgtttcaaggtcaccaaaagctttctgaaaatgcctttctgcaaagaaggtttccagagatagaagataactcaggaagcttagaagaggtcaacctgggaagacaggattctttctccccacccgtggctctgcaggaagcaataccctcccctctgggcaaggtcgaccctccaagtccagatgagaagagttccctctgtctgctctttcctctgcctgatgacccagaggctttgcagctgtgatcctggcagcccctggccacctcagggagctgcagaattcaaaccctggaaatggagctctgcttgcagctgcacctggggcctgacctgcttaggacaggcctgtctggacctaagagaaccccactgccacccactcagctactccctaacagactgcagagaccaagtctttttcatttctttatatccattgatttctcgagttattgaaactcaatatttactgagcacctacaatgtgccaggcactgtgataggcactgaagaaagggcaaaggacgagcagataaatttcctacttgcagggaacaccgtggtagtgagtaaaatgagacattgcaaataaacacataaatatataatatgtcaactggcaataattgatgcgaagaatgattaagcaaaacaaggaaatgcagagacagggaaggagcatctatctggtatgaagtagtcagagaaggcctctctggtcagatgacatttgggcagaacctggggcctgtctcagcaccacctgttccttcctcggccacttgctccctgcagccaccaaaggcccctgtggttttcccgcctgaggctcaccagccacaggcctagaatatctggcttctctccccacgtccaaactcagctgaaatgccaaactgcaggaccttgtttcctgagcaactgccaatggggctgaatgatgcaactcggaaaggaagaggatttcattccccctgaatggactttgcaccagtgggagacaggaaacaggagattggaggatactgggcagctgaactgcctcaccctttccccctgccccgtctggtgcacaatttctccacacagcctgctgtgtgtggccaagcctgtgcgccgactgagtgttatgggttgaactatgttcctcagaaagatatgtcgaagtcctaacccccagtaactgtgaatgtggctttatagtatttggaaacagggtctttgctgatgcaatcaagttaagatgaagtcattaagggggtaggggcctaatccaatctcttgtccttagaaggagaaagacagagacacatcaggggaagatggtgaggtgacaatggaggcagagattggagcaatttatctaaatgctaggcaacgccacagagagctgcaaacaccaaggctagaagaggcagggaaggagcctcccctacaggtttcagagggagcatggcctcaccatacctttacttcagacttctagcatccagaactgtgacacaacacatttctgttgttctgagtgacaacagtgtgtggtgtgttattacagctgctctagaaactaacatatcgagcagccagctgtgtgggattgtacctcccaagtaaccctctaagacttaacctttgcccagggctctgtctctagagaactgtgacaatgataggtagacctgaataaagcgaaggatgatatctgcagggatatttgaggacagggagtgctgacaagggaggagccagtgcaaaggccccgaggtggcagtatgcttggtgtgttggaggagcaggaaggtgaccagggtgtttggggagtgaataaggggaagagtgctcagaggagaagtcagaggaggggccaaagacatgttctctagggccagaaaggcctttggatcttttcgacattatcttcttgacatgtaatttatatagtagtaaaatgaacaaaatgggtgactattttgtgaattttttagatacataaaaccacgtgatcactatccagatcaaatgttgaacatttccatcaccccagagagttcactcctgctaccttccagtcaatacaacttaccaatcctgaggcaaccagtactctctcttttatcatcataaatttgttttaacctgttccttaatggcatataaatgaaactacatagcatgcttttgctcaaaatagtgcttgtgaggttcatccaggttgctgtatgtatacttcaattattattattgctgagtagtattccattgcctggatatatcacaaattatttatccattcttctgctgaatatttgagttatttgcagtttaggcctataataaatgaagccgctaggaacatttatgtgttcctcttattttggttgcatgcaatcatttctcttggtataaacctagcagtgtattttctgggtcaactggcttaggtttaggttaactgtattcgtttacaccattttatactcccgtcagcaatatatgagttccaggtattctgcatcctcaccaacacttggagcctttctggtaggtgtgtagtggcattgcattgtgctttcaatatgcatttttctgctgactaatgcactcctttttatatgcctattattcacatatctccttttatgaagtaggtattcaagtcttttattcacattttatgttttgttatggccacatctcacttccagaatctgtattggttatctatcgcgcattaaaaaagtactctaaagcttgacagctaaaaacaacaaacattcattctctcacacagtctctgcaggtcaggaacctgggtgcagcttcatggggtggttctggctcagggtctcaggttgcatttgagctgctgtctgaggttacagccctacctatcaaagctgaaccagagccagactccatgtctaaactcacttatgtgagcttcagtgtgagaaatgtatgaattttgtttgatgaaatattgaaaagcttaacaacttcctcctactctcattggcctcttggtgcccagtatctgagtctgaaaaatctcatctataggaatcaatggcagcaaagacagaaccaaggtcccacggctattggggaggttggcagatgagtgaggaaaaaggggtgtcagcaatctaaaaatattcaggctcacagaaatataactgtttgaaatgactcacttttattaagatcctgccatctcacttaccagcttaaaaaaaaatagatcacagcagaatgtttcaaattctccataaatggccatttgatccagcaacctacctgtggaaatttatgccaagattagaatctacaaaatacatacagagatgcacattgaagtattatttattaggaatctaaattgtggaatcattaaagagaatacatattccctcaaaagaataccatggtgttattaaaagtagtcattatgagtggttaggatataatataatattacaggaaattcttaggatataccatcaagtagaaaaacttttcttcccagcttttcaatgtgaaaatgtttaaacctacaggaaagttgtaaggccagaacaataaatgcttgtatagccttcatctagattctccaacagtgaccacagttgccacatctctttaagtgtaatgctcatcctttgagagtaagtgcagacattttgataccatgctctaagtactacaacacctatctaaaattgtagaaggaaactcttctatgattttcacactcaagacatttaacactgatataaagtttatattcaaatttctccaaaagatttaaaactatctctttggcttgtgttatccaggactcaatggaggattgagcattgcatttagttgttgtgcctctttagttttttttgatctaaaacaatccctcaaccatttttaaaaattctttcatgacattgacatttttaaaagactctggaacagtcattttacagaatatccttcaatttggatgtgtctgtttcctcaagattagaaattacatgaacttcttggctaacttctccattttattttgtgttcaaaatatattactctttcccatgtcctgtgaaaataaaaaatctctaatgtgtttgtgaaaaagattaagctaagattttgtttggatgcagtgtgatttggacttaggtgtgtgtatctgaacttcatcctttgtcatcaaaagaatagtataataactaagaacatgtagcttaagaaatccaggcacttgagagccactgtaagtaaactctaattcccacagcagaaagaa

SEQ ID NO: 2195 - DNA, 471 bp, Homo sapiens
aaactctgcctgcttttagatggctcctcttagaactatgcatctctcctgatacttggatgcttttcctctgactgatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacagccatgtgaagtgctcactccccctttgccttctgccatgattgtgtgtttcctgaggcctccccagaagctgagaagatgcttcctgtacagcctgcagaactgtttgaatgagagaggcagaagcacatttccaatcactgggggaacctgagaccattctttccaacccattttgccaaatggatgtcctgaggaaggtgttccaagagaggcgatgtcaggatagtg

SEQ ID NO: 2196 - DNA, 1114 bp, Homo sapiens
agacggaagcagcagcattccgcttgcaggtttttgaaaaaacaaatggggcaagagaggccaggaccacgcctgactcaggcgatcggacgggcagggaggctgcaaggcatggcatgagcaggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtcactggaggcctggccggaagtgcagggttatctcagtacttgatttaaggctcctgcagctgaaaagctgccccacacggcggaccgggtggaggaagtcagctgtgctgcttaaccgtggagtctccgtcccggtcctgctcaccagctctgcaaaggccttgtcctccctgcctgattctcggcaccatttttaacacgcctatggagaggccacgttgagtccagaggtccgtgcgcctcatggccacatcacggcacccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccaggtgaggctcctacacccaccagtggccaccggggagtcacagctccttctgcatcatccgcctgacctgtttcctcatctgggatgacaaccagatccagctctgaggtccgtgccctgagtagaaaagttcacacagcaaagtttccggagccttccctgacgcgccacgtgtccgtccataactggtcatcctccacatcctgtgaggcacgtctcagcacctcttcgtgcaagcgcccgcactagacgtttgagaaacagatgtgagcaggcgtggtcctgacctccatcccgaggttggg

SEQ ID NO: 2197 - DNA, 523 bp, Homo sapiens
tttctctcttcgcctgctgccgtccatgtaagatgggacttgctcctccttgccttccaccatgattgtgaggcttcctcagccacgtggaactatgccctgaccttccgggaaaccctcggtgagaggcccacagcctcgcttctagggtcaccactgcttcttccagtctagccaaacagctcctagtacagctcagagcaccctgcaaggagggcacgtgttaaatcgaggagcacacatgctccacgaggaattctttgctttgaggccatgcacagaggtgggttcactatgaagcttgtgaaataagcttcagggcccgcatttgcatgggccacagagagtctgggagctgcagaaggttcaagggaagaggagccatcacaagcagaatattctagaaggcatttctggcaaatggcccaaagaggcctcaggagaaaagaacttgagtcttcaaggtaacctgcgacttttttgtctcattttaaatatcaactttcatgcctaatttttataa

SEQ ID NO: 2198 - DNA, 603 bp, Homo sapiens
atcttgcccaccctctaatgacacgttggactgcgcactgaacatagatcctgtcgagggtgtttagaattgcgccttcgggtgacctggggtctgcttccagaaggtgacattttaaataaggtgccatggggcagctgaggagctgggattaggctttggcctaacgcccctcagtttcttcagatgtgatctgttagtgctgcgggcctggtaccttgaagaggtagctaactggatccaatccccacttcccctgtagtttcctcagttggagcaaaaatggcgatggtagaggtcagacgtcatcctctatcaggacttcctccggactgacacctgggagagagtcacacttcggtttacagcccttccccgctccctttgcgcaaaaggaaacagttatcacctcaactgtcaccattagcaagacttgttcttccagtccagtgtcgaaaactattgtgccttcttttcccggactaataaaaaactgtaaacttaaaatacacaaagtgacacattactgacatactgtattttcttctctcaacctttggtctacagaagaaattcacttattaaattctactagtttcaaga

SEQ ID NO: 2199 - DNA, 445 bp, Homo sapiens
agtcttgaatattggcgagaaaagatgaagaagagaggatccattgtgtcgatcttcaagccctgttcttctaaaatgattgaagctgagatctccacctagtggatatataggattttgcagatctttatgggaacagccaactatccctggaaatccttaatttttttctcttagagaaataacaagttttaaagacttctacttaaatctgggatgattgtcaacaggacaattgcaaatgtatgaaacataccaatatgcatatcagttacactacagttaacaaagctgaatttttattttcatactataattaggaaaacagatcaaacacaaatatgaatatataattatccatgtagaaagcaatattgtaataccactaattgagatatgtataataatttacatgaaataaacatcaaatgtaaatctgctcaaa

SEQ ID NO: 2200 - DNA, 2043 bp, Homo sapiens
ggaagaagtgtattcagcattctaccttcttcctgattctgtgagcttagacctgcttccactttcaatctctctcattgcaggctgaagaggactggcctttcagtggccctcgtggaacggtaggaagctgagctggactctctgccacatcgttcggttcccacaacagcctgatgaagcagcagcagaaaaaatggaagccattttggttaacgggtcacatcttagcagttggcagcgtaagaagcggaaggatccactggtcagaaatggagattgaggagaagctgagagcacggagggcttcaggggagagcctgtcctttggaaaagcgggcaatttgcactcgtggtagatgagtggggaggccgctcagtctctctgcccctttgcacatgctgcacccgtttagtttgacgtcgtggagagctcctccaggcacgggctgtgtgaaagggtttaaaagtttgggggcatggctgggggtccccgcatgaggggtgctgtgtaggctcccatcttttctgccggtcatgctgggagccaacagcaccggctcctgacgtggggacttgccctgtgccatgacgtggggactcgccctgtgccctgcgccccggttcctgctggttctgtgccttctggactcatttcctttccagggtccgcaaccgcttccgacacaatcactattttggctgcggccacggcttcattcgcttcagctgcgagcttttctcagcgcagagagcacagggaagctgggaggagtccgcctagatggaatcttccagaagcaacatgactcttttaggcctttgctgccagctaagaaggtgaagaaaagtcaccactgcaataaaaagagggcactttgtcttacttggcaataaaccaccaccagcagcagcagcaatagcagcacccccacccccaccaaacccaaaacaaacaagaaaagcaaaaggaaaccttcgttttcagtgagaggattggcatgaagaatccttgggacacaggaatcaatcaagacctttggatgcccctgcctgctctgtctctagaagcctcaagcccagcatccccatgccgacgtgctcatctctagcaaaacaccagcctctcagccctctctccataaaggccactagaaagtactgtgatgccaggctgctccacatccaggcagcctgggtgaccactgccctttatgagaatcagaaaaagctgtctcccgagtagttggaattacaggtgcatgccaccatgcctggctaatttttgtatttttagtagagatggagtttcactatgttggccaggctgctcttgaactcctgacctcaaatgatccacccgactcggcctcccaaagagctggaattacaggagaagctaaacgttttaaaataagtatattatttctgaattactataacagacatggactccatttgaacaagatacttaattccatcaaaaacttgtcaaaatatacaaatttagtcacaagacactttactaccatctaccaaagctgtagtaaacacacacattttccatctttgaaatgaaataacgtataataatgttttccaaaataacaaagatgtctgcagtgaatagcactccctttgatgtggcaactgggtcaatcgtgttaacaactgtgaattcatctttttaagaaattcttttattgtttcttttcttttccgcgacagtctcactcgtgttgccccggctggagtgcagtggcgctatcttggctcactgcagcctccgcctcccgggttcaagcaattctcatgcctcagcctcctgagtagctgggattataggcacgtgccaccacacccagctaatttttttgtatttttagtagagacggggtttgaccatgttggtcagggtggtctcgaattcctgacctcagttgagccgccggcctcggcctcccaggaagtgctgggattacaggcatgagccaccaggcccggccttattgtttctatttgtaataaatctgttccccttgc

SEQ ID NO: 2201 - DNA, 2480 bp, Homo sapiens
atgaaggcggcttcagccgggcgtccggccgggctccaggtcgggtgcagaggcggaagctgtgctcttcctgctggacagagcccgagcccgagcccttcctccagctcctcacacgacgctgaacatgctaagaagctgctgctggttttaaaagcagagacacttgtcgcgataggctggcaccccaatgtttgctcacacaggcagcacaatcccacgctgtacctcagcttgtgccttgtcagctctgagctgggaggggagaggagaaaggaggaagcctcctgacctcggagcctccagtcaggactggctggctctgctccgtatgccgaaagccctgggaatttttcactgctctcgggatggcgtctggggcgtgggcaggttggtcccgctttgaacgctctgctggacttacggagctgctcttagtgctgggcagtgaacgccaagctgtcgtgtccacacggccaggggaacgccagggccaaggccagcatgcgctgagcttctgcccagcctggagtcgccttcaccaggccatgagcacgtgaggcactttctaagcactggttgcccgggaggcgcaactgctcagacgccgaggcagctcaaagggctccgacgtgcggtggctccacggggtcagcgtgcccagagtaatgggtgtcactagagcacctggcccagcacacgctttctgaggacacctggtgggcgcgccccacagcaggccccaaagtttcagaggtcctgtggagtacttgctgcctgggggaggcccttcctcagggagtgtccagcagagggaagagcagaccacgctctggaaggtccaagccgatcatgcacgagtcaacagtgctcccactgccgggccagcccctcttccccacccgaggccaccactctgctgaaatgaaggttcttgaatagcaagaaggaaggcagaagttggacactggatccttctgggttgtggatgtggatgagctagctgtgggcccctttccctctccctgtcctacttctgctgtgccagccccacagctgctcagtcccctccctggtggtgggtactgtcccgggacagccagttggtcctctccttcccgttggcaattctggctttccggcattccacaccaccggcccagcccctggggcttggcggaggcagtgttcctgctagctcttctctttgggcggaggagccccagcaccgcaggagatgggaggcagtgcagagactcgcctgagtgctgagggtggcggggcctgtctctgtcccctctcggggacctgtccctctcctggaccacggatattgatctgaggcaaacatctaattcccacttccccagaacatcccccaactgaacaaaaatcagtgacacttcaggaaagaaaaggtggtatttagtggcggtccccacactgcccctcccaggactgttttctaagcccacgtgagatctctcctgatccctttgaggtcttaatacaagagccgggcctacgggtgggagagtctggattctgtcctggccttgccatgcttcctggcttcatgaccttgttcaagtcacttaaacctctgtctggcttttacaaccatcaaaccatctaccctccaggtgctccacaaggactgactccaccccgggcactgtgtcggcactggaaacatgaaacccgagctgggagccagacaggggttcttcctgagagcctgggaagccgcctgccctcgtggaatttacggtctaaggagtgatgcacgtgaggcactttgaaagatgtgaaggactgtgtgtaaaacatgtgccaatttctcgcttcgcagaaggaatttccactgctttctcagttaagtgtcaagaacctccaaaagagatggttcaagagagctatattattgaatcagattatgttctttacacattttagcatagctcacaaaaccatatgaatgtttctgttttgaatattctcttcctaaatgttttacatcctgtggggaggggcttggattctgattctgtgtttaaatcctacaagcaggccgggtgcgtagctcacacctataatccctgcactttgggaggctgaggcgggcagatcatgaggtcaggagtttgagaccagcctgaccaacatagtgaaaccccgtctctattgaaaatacgaaaattagccgggtgtggtggtgggtgcctgtagttccagctactcgggaggctgaggcaggagaattgcttgaaccagagagttggagattgcagtgccgctgcactccagcctgggcaacagagcgagactccctctcaaacaaaataaaacaaaaaacatcctacaagtgtcaagcatggtggtgcacacctgtagtcccagctactctggaggctgaggtgggaggatcacttgagcccagttcaagaccagcctaggcaacatagtgagaccctgtctct

SEQ ID NO: 2202 - DNA, 822 bp, Homo sapiens
agtgagctccgagggcctttctgctgcttcctgtacccctgtatttcgctcagctctctgacttgactcagctccagaaatattctttcattaatattacatgcttatggaactttacctattgattaaagacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaaaatccagctcaatgttactagaaaatttgatcagaatctggtgaaataaatagtaaacttactaaaaatgccaaatatcccagaagctgcttaacatttgatcaaaagctctgtccagtcaattcctgcttctttcaaaaatactctgctgaaaagccaaaggagaaatggggctggtaccttcaatatagagaattccaagtaagattagatcccagaaggcttagtgtggctttctaggactctcactattaggcagtaacctaccattcacctctgtttcccagattcaccttgttataccttataacttaaaatataaattccaacaatgtactgcactcaaaaaaattatttctcaatttgtttgctcatactattgatttttttctagaatctaaataattgtgaattaactatgatagcagtatgcacaaacagtaagtgaaa

SEQ ID NO: 2203 - DNA, 2978 bp, Homo sapiens
tttcatatgtgggagccactaggcctcctcttttcaagggctaagagaaatttaaatctctcccgattactgaccctgaaaaccacactgcgtttctggcagatgatgttaaaaaagtgtggtggaactccctctggtacaattgagtgcagacccttgtcttaaggaaataccatttgtcaggggtgggagagaaatatggatctctgtttctatttagaaatcatggcaacaagtagaacattttctgtccacatccagagggagaagccacaggaggaaataccttgaagcttgtgggacgtgcctggtgaggatattccgttcaatgacacatctgtcatctttacatgttgaccagccaacaagaacttgctgagtacaggacggacaaggttggcattccgctggctctacaggggatcaacgggaaggatggagagaacagcttgtgtgccaggtggggagacggacatggaccaatactgaataacctacaacacaatggtttagaaagagaattcaaggtatgtggactggacttaagccatggctaagctcacaaaagacttcctggaagaagatgtacagcctatggtgaggcacaacctccctgtctgtactgcgagttcttgggtcaagacacaactcacctctacctatctgtacactgacagcaaagtccttttaatatcaaacagaaatgaatgacaatgatggtgaccacatttcccaaacccacgaacggtcaggtttctgtggcgcctctccatttgagaggctctctgaaagccagtcgtggatagcatgcttccatgtgtatgtaaataacaagacatatggaacatgttaaatcggaagactgttccatatccagaattactaatgtactaataatcctttgaatcctcaaaaaaaacaaaaaacactatacttttatgccaaagtagatggaatgggtgactagagataaagctgaagaaatttcagatttaaaatctgactggcccattcaccagcagacttaggaaagtgctaactgcgaagctggccagtattcagctcgacagtcctaaaaacaaacggaaccctttggagctggaaagtggtatcataaaagccgccgaatgcggtgcttctagagcggcccaccaggaaaatatgacagtttacatctttacgtagcctaatgtacagtgggaatataaatatctcgttcaggccccagtcactgcctggaatgggatgctttccttaacaagaagcagatgagaggcccagaagccaaacctcttattctgttggtctgaaggctgtagttttcagtcggtcagcacagagagtggcaattcagggagggaaggcactgcatgtgtttccttggtcaggacaaaagcttgtagctcttttcctgggccccctgaggctctcgtacgttgagtgtcccgcatgtggtcagcggctttacccacctttccttgggccaccagctccctctgggctgctgaggccgatttgaccagggcgcttgtggcagcagcaatggatttagcagcttccaagatctgttcctcaaagtccagggtctcatccgcttgctataaccaaaagaaaacagcatcacattcaattcatatccacaaagggctctttcttccaaactacttactgccgggtcacctggctcttcacctgcctattgttttttgttgacaaaccacacctgaaatgggatggttccttaacaagaagcagatgacaggtcccctgtgcaaactttcaggactcttaagtcagtttggttaagccaccctcgggtcacagtgtggaagatgtggctggtacctttcaggcattaagagacaatggccaggcacagcaatagttttctttgtatgtgtggtacaatatatataacacaaaatttacccttttacctaatgttaagtattaatacactgacactgttgtacaacagcaataccaggatagaaaggtcaggatgcctctccacctgcagccccttccccctaactccaaaaggaaaaagccgttagcttgacatcccacggaaatttgcagacagactcattttctggaacaaaatctttaaagatatacactcactgtgaacaaaatacactcaaatggttttagcaacatcaataactgaaaccaaaataataaaatcaaaacagtagatcatagcacttactctcttctagagcctaagcctcaaaaatggactttaaaaaaaaaaaaaggaaagatggctaccagttctgaaaagttgtctttttcctgggtaaaaatcaaagccaaacagcactggcatttctgtggctgagcactgagagagttatagaccaagcacacattgcccagtggtgaaaaagaaaccagggcaacacgacatcaaggtggagcttgttctgtcctctggacacccgaggcacgggatccaccttgggaagaacactggacaccactgtgtaggtgttatcagaccattagggttctggtctaaattcaccaccatctcctttgctgctaaaacaactcaggaagttgaaaagaagctttggagaagtggaacaagtataaagactgtggtcccaggctcatgggttggagcatcacagttttgccggggggtggtcagattagacctgtgtgacaacattccgtgactctaggtcaatttggttaagctgccctcaggtcacacagtgttgaagatgtgggtggtacctttcaggcattgagagatgatggccaggcccagcaatacttttctctgtatgtgtggtaaaatatatgtaacacaaaacttacccttttatccaattttaagtgtacaattcagtggcattacggacattcacactttgtgccaacagtagtagatttttaagagtgcctactgtgtaccaagtattttgttaggcacttctacatacaatgacttaattctcacc

SEQ ID NO: 2204 - DNA, 558 bp, Homo sapiens
cctaccttttgttataggagtgttggccatgacccttatgacggatggggaaagacatcacatccttcctctcctacttgcagaaatatgaatactcaaggttaatgtcaaggacgtttgttccacttcgcatctgaattgacaaggaatggactcttcagctctgacagcaaatctctcttcagaagtctggaaaagcagaaagagaagaatgaagaaatgtccacaaaactgctcctatcctttacaccacataggaccaaactcttacctttcatcagttttcagtttgtacattaatgtatcctggtgaagttcctcaaccacttctgcaacattcaattttaatttatatttgcccacatcatttcatttgtgatttggacacatgcaggctactgaatataatggatacaaatctctcactgattcccttgagctatttcatagttctgctttcacaggcaggagacagtgaagaaataatgattcagttatttcttaaagatttcacaattctacattcaataaagaatatgtgaattcctggaagttatg

SEQ ID NO: 2205 - DNA, 945 bp, Homo sapiens
gttccatgtccgccacatctagggtgacaggttggattatgtccctccctaagagatgttggactcataacctcaagtacctcaggatgcgaacttatttggtgataggctttatagaggtatgcgtattagtccattttcacgctgctgataaagacatacctgagactgtgtcatttataaagaaaagaggtttaattgactcacagttccacgtggctgggaaggcctcacaatcatggcgaaggcaaggaggagcaagtcacatcttacgtggtgtcagggaagagagaaatgagaaccaaacaaaaggggtttccccttataaaaccgtcagatcttgtaagacttattcactaccatgataacagtatgggggaaacggctcccatgattcaattatctcctaccaggtccctctcacaaggtggaaattatgcgagctacaattcaagatgagatttgagtgaggacacagccaaaccgtatcagcatgcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaagatgcagagtgttcatatgaggagagactttcccttgtctccgtcatctgtgatttcacttccctgacagaagacgaagcttccatctcagatgttttcttaaatgatgaaacagcatacgcctctgttcttgtcagctcagggaaaacagatctggggacctcttcatctctgcgttgggaagcataggtggtataatcccctcctgtcacgtccaacgttgcatagtcagaagcttcgcccttgtagttggtgcacacagcacg

SEQ ID NO: 2206 - DNA, 597 bp, Homo sapiens
tcacttttaaaacaatgaggttttattatttccaattacttacagcaagtaactgcatctaactaccatcaaagcattactagaaatgttagaaatctactagaaataactagaaatctgccaagctagatatatagagtacatgttagtataatcaagttttattttgttggaagggacctgtattattcaggattctttctgtttcaaataatttttaaaaactgaactcaaactggcttaaaaatgaaagggaatgtcttgacacacagaacttaaaaatccagaggttaatctggcttcagacattattagatgtatgggctaaaaaaagagccaggactcagtctccctctctccactgcttggctatagtttcctctgtattggtgtcattctcaggcaagccctacccgacttgctagcaagatagttgccagaagttctgggcctacctcttaccctttcagcaacctgtaaaggaaacgatttctttttcccaatagtttccttaaaagtcttaggactgcttcaaattttccgagcgtggaccatgtgccctttcttggccaacgagataaaagtcactgaatgtct

SEQ ID NO: 2207 - DNA, 701 bp, Homo sapiens
agagcacaggcagccccgagcacgcccggttgcaaaggaggctcctcggaaatcgcagcccaaccttaccccaggcccgggttccaggagccgcagagaaagcggggccggcaggaggaggcacgggccaggacttacctggcggcagcggccccacacctcctccaacccggactcagttgtaacaagaacctgaggccgctggagaaaaggaaaaaatgccgtcgcgggcggggcagacccacgagcctgcacgcagccccgcgccgccccgccccgtccgcgcaaacacgcgacctcctcagctcccattggtttctgccagcactagccacacccctgacagccccagatggggacacggaggggcggggcccgtcccaagtgcccctcaggatcttcccctgccgctgcctgagggagctgcccgggactcggtgacacctgatgtggcctccgatatcgactgggaggtggaagagaaatttggggaacgcatcgagaaccgtggaaaagcaaccttcgcagggggcaaccttctcacggtgcccccgtgaaccttcacagttggatggaactcaggccccaggttgagcttaaacaatctcttttctgtgctccaacttggactctaggtgagtacctggatttttggccacacaatgttttgaaatcaataaaatttggacccctttgaagta

SEQ ID NO: 2208 - DNA, 581 bp, Homo sapiens
ctagagttttgctcctgggacgggacgtccgagagcttttggttccagagggccatagtcttcatatacttcagcactccatgaaggctttcttggtactgttcaaagtaagatataacaagttgctgtgttgcatacatctttacaccttcattgcttgttctcccaggcatgctatcatacccaaggccacatggtgagatggaaagacactgcatctgaagtcaagggaccaaggtttcaaattctcaatgtcccccttgcatgatgggcaactgacatatcactccgcactttgcttgttgatttcttcattgagtgacagtaaaatggttgagtctgttcccagctgtcagactgccaggaatatctagtagtttggtttcctcttctggaaaatgacattagtagttaatgctacagtgtttactttgtgccaggccatttcctaagtactttacatatatatttactcttttaagtctcatgacaaccctatgaggtagtgtgttagtacattttgcattgctataaaggaatacctaagactgggtaatttataaagaaaagacatttatttg

SEQ ID NO: 2209 - DNA, 3803 bp, Homo sapiens
gcgcgcgggtgctccaaggagtcggaggaacgcggccgcgcgacgggccccggacgccgagggtggtgcttcctccgagcctccggtggtgaggccgctctcagaaggtcatggaagcgcaggggagagcgaggcggccgagcccaggcaaatcctcgagaaaggccgagtgcgcgacggctctgcggggaggaccgcgcctccccgaatgcggccgctgctgccgctgcaaacagtgccttgaggagaggaaagcggggaaccgtgttttcgccgcctctgtaaccactgcacacaagaaaaccagcttctgggagagggggatgattgttgggactttgcgaattacctaaacagcccagggccgaggcgccgccgctcgcgtcctggtcctcctgccgggtgtggggctcccctgcccgagatggccagcgggcgcgccgagagtatcctggagccatctagtcttgcctcggaggcggggtgggcttatttgtgcggagaagaaacggatctcttaatggggtgagatttttcctccgtacattgttcccatttccgcagtttcacttggcctcggttttctagcagagtaatcaccaaatgaaattagctggagagcgtttgatggcgcagaatcacggtctgaagatgtttacgctgtatgccggacgcgtttgatggtgttctcttcggcacaattaattttgcaaagttcagaaatgtgccagacagagcccctggcacgcagtcaggactctacagacacaccttgagtaggaaacaggcttgtttgtttcatctgtgatttatgtgatgcaccagcaccaaggccaacgtgttttttaaagacctttcgatgaaactccaaagcaatttataaattggcaaaatgaagcttgttttgtaaaataactcttccttgttgatcatgtaattaaatgggcaacaaaacacctgaaaggacatttactgaaaagtagactcccaaaacaaaaatatgtatttcacagctagatacggtcgctattagcgtcctaatggccaactccatccatgtgcgtattttgaacactaaaaacgcctcctgttacccctaagaccttgtttggataacatttttctattataagtactcgaaaccaaccccatttaagatgtttacccttattcttgagtccttgatggtttgggaaatttatcattattcatattgcacaatcctgtcactgtcttttccattaggcacagtgcctaaggtccacaatatttttagaggcccacaaaaaatattttaatttcttttcaaatcagaaggaaaaaaaatttaggtttaagaaagtattttaatatatattaatatatttgtttttgtgctaatacaatcttaaaatgtatgtatatatgtgtgtgtgtatatgtatatatattttaatggagtaaggggctcaacgaaggcaaaaaggcctagagcccaagaaaaacatgatgtggccctgttgcctggggttgaaaaatcccattccatgagaagaatttagttttaagaatattacataaaatgctcatttctgtggccttgctataatagaaagatggagattcagagtagtgataatggctaacatccacctgatacacaccatgtgtccattacctcttaatcctcacagcacacctgtgaaataggtactattctcacacttagggggtaatgcaggttttgtggggcctgcaatttatgcaatttgggtggtcctcttaaagaaaaagcaaatactgtgtattagtccgttctcacactgctataaagaactgcgcgagactgggtaatttataaaggaaagaggtttaattgactcacagttccacatggctggggagacctcaggaaacttaacaatcgtggtggaaggagaagcaagtaccttcttcacaaggaagcggaaagaattgtgagcggaggaacttgccaaacacaaaaccgtcagatcgcgtgagaattcagttactatcacgagaacaacacgggaaaactgtccccataatcaagtcatttctctccctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggtgtctgtgcggtgcagaaactgtacaactgtatacagtgaccatttctactctgggtctctaaacaagggctggtatcgttacagagactgaagactgaggaagaccatctctgtaggatgccaaggattgactggagaaagtctggcagaatagaacgtcttgcacaagaggagtggaacagcggtcagagcattacagctgactcatcttgaccagagaaggttacagctggaggccccagagattgcccacttcccccctccatttgacagcaagggaaacaatggccagagaggatctggaactttctctcaatttcagtgaaggccagaggtaaaatcaggattgtctgaagacaagtaaggtcaggtgcatagggttatatgtaggagtatagttaacaggtgtcagaaacttggatttaatttagaggtggttaggacatgcataatatttttcaactatgcgtgaaatctgggattctgcatttatttaaaatataggattgtccattaattctttctcttgagagggcgcttctttcagaaatgatctaggcacttacaaacattttaaaaatatatacacgtgagatcatactttcatagtgatataagcatcattgctcatatccctaatgaacagatggggaaaaggaggtagagacagagagagagacagagagtcagcaactcaccacaagaatctcctggttgcctgtctgggcttctgtcagctccatttagttgaatttctattcaatattattactgaggtcttatacttaagaacatgttctttgggtttcctgcttatctccaagctgaagaatttattttcttctatttgcttttccaatcttcagcttccatgaccttaaaaaaaaaagtacacaaactgagctggtctaagagcagcctgtttgcaacctgatatgagacctggaatgcaaccagataaaccttggtgtagggttctctaaacacattcaacattttttccaagaggcaatcggtttatttcctttgaaatgcttgatgatgaattaacagtacattttcgaaactattgaaagagcagaggtaaaatggtagttatacatgtcggaatgggaaatagagaactatggaatttatcttactttgaagcttaaaccccttttaatattccttgtatttagccacatgtatttttaaggtggaaattagttaatggaatattctcatagtccatactttttattaaggttgatgtttgatgaaccagataatgtctactcactttctgctttaaagtttataattcttgataaaaggaaaagtggtgaattatgtgagccaaccctggaaagtatttccgtattgagttttgtttgtttcaaagaacctactgtacatatgcaaaaaaa

SEQ ID NO: 2210 - DNA, 2328 bp, Homo sapiens
acagtgctctgtgccatccagggaccagccgtgtgctctcgagttactggagcagcgcaagcagctccagtggtctcagctgtggagacagctgtttgcccaccgtctgcgatggcagaaatgtgtggtcccaatttgggccccgagtctgctggagaaaagagaaaggctaagaagcagcctaccttacctgtggctctgggtctgaggatggccaggagaacagagagcaaagcagagccaatgcaagacctctggccctggaagccgaagggtctctcacaggtcaacgcaggatctactccatcatcatcttcactagcacacccagttcgattgaggagccttgacgtgggatattgatgggatattgagagaaaagagaaatggtgaatcaagcactaatctcaaagcttctgcacagaactacttacatgtcacttcctcccatgactattcctaaattcagccaaaaggggacacataatctcttacgggggagggcaccacggggagagaaacccgaatatttggtgaatagtaacacaatctactttgttatagaatctgtcctcaatggtcttacagtctaagagcattacatttagttacggtagtcttaaatatgatactaaatgaattgaatagccagacatctgtgaaagtaaaactgtgataatacaaagtcagtgtgcttttaagtttcaattgcttaaagttatttggaagtaaggatcacatgagttcagagccccaggattcaaaaataactccggaatcttttatcactccccaaaggaaaagcaataataagtaagttaccagacattcatgtaatctctctgaaactgtaagactaacaaaggaaaattttcaaaaggcagaaatactttattatttatttgcaatagaaattattcagccgggcgcggtggctcatgcctgtaatcccagcactttgggaggccgaggcgagtggatcacctgaggtcgggagttcgagaccagcctgaccaacatggagaaaccccgtctctactaaaaatacacaattagctgggcatggtggcacatgcctgcaagcccagctactcaggaggctaaggcaggagcgacagagcgagactccatctcaaaaaaaaaagaaagaaagaaaggaaaaaaagaaaagaaaagaaacaaagaaatttttcagtaaatacatacaacagcattgatggcctggagacataccaccttcagttgtgatcctggcagatgtgatagattctacaaggttggacaggttaaattcttgcaaggaagtcctttctggaacacccaagaattacagaaagtttagctatctttcagatgagatttcattctcagttttacttgttccatgacccttccaaactacacacgggattcttttcattcagttgccttggccagcattttatcaccaatagtcctattttatgtaactgagtttgccttgccctttactgcatttaggtaaatggaatggtgttttttagacttccgaaactatttgtagaccttttccttcacaagtttgaaatagatgtgaggcattcattttactcagacaacattgagcccaattcacttgggaaaatgcatcttgatgtgtaattcatcatccagagcctgtccactattctgttcctccctgagagtaaattaggcactttgaaaggtgcattaaactcttcctggctactaggtaccatttagaactgtggggcaataatttacttcatggtaccttggtgacctcaaaaagtttatattgttttgaaagttcttaattttctcccactaaataatttatgcattcagaggttgggtgtgcttatgtttccagagagacaacagctattgaatagcataaataagataaaatagtcatgctagtgtagaaattaaatgttcacaaatgtgttatcgagtctatccatagaataaaagtgtagcttataaaacaattattgctttggatttcatgttttaaatttacaagactgtgttacattttgttgtaattagtaatgcttcatagctacaaggattaccagatccatatcactgcatttttccatagcacaaaacacatttatccaaagtaaaaatagtgtgctaaacatactgaagtttctgacagacacttatatttctcttcattctttcattcacagcagagtttcatccatattaaataaattggttaagttttgatacctcctactttaatcactcatcttatgtactaaaatgaaccaaattaagtttgagccaacaaataaaagtgatatgctttga

SEQ ID NO: 2211 - DNA, 1080 bp, Homo sapiens
cccatctcggcctctgaatagctgggactacaggcatgcaccaccatacccggctaatttttggggttttttttgagacggagtctcactctttcgcctaggctggagtgcagtggcacaatcttggctcactgcaacctctgcctcccaggttcaagcaactcttctgcctcagcttcccgagtagctgggactacaggcgcacgccaccacacctggctaatttttgtattttttagtagagacagggtttcaccatattggccaggctggtctcgaactcctgaccttgtgatccgcccacctcagcctcccaaagtgctgggattatagacgtgagccaccgtgcccggcctaatttttgtattttttaaagtagagtcagagtttcgccacattggccaggctggtctcaaactcctgacctcaagtgatgcgcccacctcagcctcctaaagtgctgggattacaggcatgagccactgcgcctggcctagatattcatttctacaactcactgagcacccaccccgattcgggactcggtactgggtatccagggatgcgtatgaccagctctgccctcaatagcggctcaacacagggagaccttcaggttcttggataaacaagctctgacgatcattcccaaacaagagttcaaaaatgttttccgcaatagcaatgatatggacggaaaggatgccctcctgcactgatgcctctggaggaccacactttccattcagagacacgctcagcactcaactcatgctgcacacccggccgaccccagtaccgacactcacagaatgcaggttggagagagatgccgacttccgaggaggtgtcttcttcggactgaacgtattcccaaagaaaggcatctttggcctgatgaaagcaaagccagtgctcccttctcctagggtcagaaaaagtcaggggtacaagcagctggatcactgaccttatgccattgtcttcaaatcttgaagacatacattttatcatgtggctactaacgatcctggtgctatggtttgaatgtccccaccaaaactcatgttgaaattgaat

SEQ ID NO: 2212 - DNA, 16455 bp, Homo sapiens
cagaaagtcaggcagccacattcctttctgcatgaggataacattttatagtcagccagatcagagttcttctcctcttttttgccttctcttttcattcttgattagagactacattagagactactcctaattagaaacttgtatgttttagtagaaaccatgccagatgtgtgatgcagttcagtggaatgttagagagcaactgatggtggcactttgaattgggattgtaagcgtgacagatgggggctgaggcaagaagagcctagaagcatgagtcagtgaaagaagagcaaggacaaaaacccagtcttcagagaaatcagctgactgaaccgagaccaaatagcagcctccagtccatgattcaaggagagggcaagactatattggctggcactgatgccttgttgggttgaaggagagacccaggtattcaagggcactacacagaaggagacaagaagatgaaaggaactcttaaatttattgagcatctaatattctatttaattcttgcagcaatcctgggagcacccttaacacaaatgtttaatgttttggtcaagatcaggaatttaacagacggaggatttagatttgtctgtctctaaaatccatgttcttttttaaatgccattttgagaattctcagagattgttgcccaatactcttccataaattgaggaataaagaagactaagatattccccaaacttgatgacttgccccatgagaactatcgatttaagtcccacaagcctctgtgttagttcacagagggaagaggaagcctatgggtagatagggagatgcccaggggagaatgaaggatggttctgctccattgtccagaatctcagtttgctttgttccagattaactccaggtggcctgatactgtgtactgatgaccacagcaaccttccaaaggatccacaggagcctaatagccttcaaaggaagcatcacaatatagcatgagaatatgcccaatgttgaaactgatcaggaaaaagcaagtgaaattaatcattatatacttaaaaaaaaatgaaactaagtaaatatccattcacaaaggaggagttaaacaaatcacagggcatttttccctttacaaagccaattaaaaaggtggttgaattaattatacttccatggatggatatccaggatgtattgagtgcaaaaagcaagttaataagaacaacaaaaatgatatacctatgtgctcatatacctctgtgtgacacagagaaaggccaggaagaacatgtatcctttaatggttattttgggggaagagaaggtggaatggggaaggagtagagcagtgacttttgctcttcatgcatttctgcatggtttgaattttgggaagaaaactgagcatttattactgttataatataaaataaacccaacacaaaagtgaatagtcagtagaatacaactatctttctgagccagaggcagagaatgatgacttaaggtcatggatgattctgtatcagcatctaattcagaaatacagacgcatgctgaaatctgctccagttaggagatccaaaaaaatctgctccaggagaaaaaacaaacaaccccatcaaaaagtgggtgatgcatatgaacaggcacttctcaaaagaagacatttatgcagccaacaaacatgaaaaaaggctcatcatcaccggtcattagagaaatgcaaatcaaaaccacgatgagacaccatctcacaccagttagaatggcgatcattaaaaagtcaggaaacaacagatgctagagaggatgtggagaaataggaacactattacactgttggtgggagtgaaaattagttcaagcattgtggaagacagtgtggtgattcctcaaggatctagaaccagaaatactatttgacccagcaatcccattactgggtatatacccaaaggattataaatcattctactataaagaaacatgcacatgtatgtttgttgcagcactattcacaatagcgaagacttggaaccaacccaaatgcccatcaatgatagactggataaagaaaatgtggtacatatataccatggaatattatgcagtcataaagaagaatgagttagtgtcctttgcagggacatggatgaagctggaaaccatcattctcagcaaactaatacaggaacagaaaaccaaacactgcatgttctcactcataagtgggaggtgaaaaatgagaacacatggacacagggaggggaacattacacactggggcctgtcagggggtggggggcaaggggagggatagcattaggagaaatacctaatgtagatgatgggttgatgggtgcagcaaaccaccatggcacgtgtatacctatgtaacaaacctgcatgttctgaacatgtatcctagaacttaaagtatcatttaaaaaaaaaaaagagacataaatgaatgtatgtaagatatacattggttcatcccataaaggcatgacatctcaaagtagtgatgtggggggcttccaccttatagatggatttaaagatttcctgaattataattggttgaaagggttaaactccacctgaaggagtgaagttagcagaaagaaatgtttattgttaagataagggggcttgtggaagccaggggtcttgttgtgtagatgaagcctccaggtagcaggcattagatagaataaatgataaatgtctcttatcagactctaaaaggtgctccagactcttaattaaatctctcctggacgaggaaaagaccaggaaaacgaatctgatttttctacagaatgtagattttccctacaagagacagctttgtgaggccatatcaaaatatgtcataaaatatatctctgcctgtaacttctgtccccctaaaatgtttaaaaaaaaatgtaacccaactaccttgggcacatgttctcagggtctcctggggctatatcatgggtcatggatcttacatttatctcagaataaatctcttcaaatatttaaaaaaaaaaaaaaaagaaaagaaaagaaaaaaaacctgctccaggcagaactgcagccagtagaacaggaatccatttttttctgcattccagtgtacttcagccagtgttcttagtggcattatctattactcagcaattcctttaactctgaacctcaggttgacctcttgtttttcccctgaaacaatttttaaatgcttttttgttcccatcaatttacattttaatgtttactgggttcatgacactgttagattctttgtaataggtgctaaaatgtatgtaaaatttcttcaatttttttcaaagataaatacaaggcaatgcctcttagaaggttataatcaaaccagatgtcattggcatgtagtatatgcatgtaatgaaattcagaaaatactgtaaaaacattaattttcccccaattttatatatagttgattttctttcatttatttttgaagaaaaataagggttaggaggaagatatggaagagatcagagaggtaaacagaagagagaaaagtaagcaggaggattatgaaaaatggtaagagattgagagatgagatagcatcagtgaaattttgtctggacctacacaccctttcaagctcatgagtggtgccacaatgcaactggcatcctgtgaaagcaagccttgaactctactgcataactctctgtatgggtcctgaaccactttatctaacctctttcctgttctgcaacttggtttgcttcaatccctcatgcttctgatcactagatttactttcctatttttagcctaacctcatatcttggaattgacatgtggtgtttatgacatctactctcatccttaactagggttcagagttctcctgtgtggtaggcagaataatcaccctccccttcaagatgtccatgttctcatccctggaacctgtgaatatgttgcttacattcaaagaggaattaaggttgcagatggaattaaggttgtcaattagctgaccttacaatggggagattatgcttgattatcttgatggtcccggtatagtcacagggatccttaccagtggaatagtgaggcacaggaggagctcagagggatgcgatgtgagagggacttgccttgcctttgtgactttgtagatggaggaagaaggtcacaagccaacaagtgtagacagcctctagaacttggaaggcaaggaaatgtcctacctagaccccacagaaaggaatgcatgcggccttgccggtgccttgattttagcctagtgagacatataccagatttttaactaaaagaggactataaaataataaatctgtatggtttttagccaccaaatttgtggcaatttgctatagcagcaataggaaactaatacaccctgactactttaaagctgttctcctggtctgtcctaaagccctttccaccctttaacttcatggagtcttctatgggcactaaaaaggaggttctgaatgtggccaggaaatggactgccttgttcagagacaagttgacctactcatgtgtttctccttccatcccaactatactttcactctttcagcaaagagcttcttctcagcactgtcccaagatttggaaacagagtgaatggggatacatgataacgggcatgtatttgagatatgattggttttagggcagtttcagaactggatgactgatcccatataagttcaatggaaacagcttagcaaaagctcatgattatttatggccagtggaagttagattgctgttctgtgctgacagtcaagtagaactatgctaggtttgggctaatagatacctgtgtaaatgacattggggattcactgtccacgctctaaatgtgaatgaagtcataagcaatgggattggggagtgggagaaggcatgctcctctgggggcgtggtcacacatggtcttcaggtgggcgtgtggaaagccctcccagattctgatagagaaacaaacattgactgtataagataccagtcctggtagattagtcattcacaaacttctgaatacatgaaagtcacctggagactttgttaaaagatgtagatttctagctctgttcctactaattcagatttagtaagcctaggatgtatttttgacatgtatccaagtgattcttatgcagacagtcagtgcagctcacaatgagcacggcattgaagaacactgtgtgggagagagataccattcaaatagtctagtgctttgacttaaggaggaatctgtaatttcccagtttgttttctgctttgatcctcttcacatgtgtatactctttcagcattttctcattacataagaatttgcaagcgatgggagccaggagtgggagagggcatgctcctaagggggcgtggtcacacatcagggtcttcaggtgggcatgtggaaggcccgcccagattctgatactattcctctatttcctactccactcaccaataggtaattcttagctccaagaaacacagatgtcccttagtggggcatttctgggtgtgaggagacactcgcaaacactcaaggcaccgtgggacttgcgctgtaggtgagtagcagacaagacctttcacttggaaatgttcctttccttccaaggtagggagaaatgatctgatctcttctccgagaggatttactctccaaagtcaagtcttcctttgatctgggtgggtgggaggtgggggtcctgcctacggttgcgcaggttgagcgtgaattcccaaagggtaagtgtaggtggagtcctgttcaggtcctactcagcaagctggatgctggagcaagggcaagggtctggctagaggaaaagctgccctttaaaagtccacacgaggtctctgctggttgtgaccctgccaggtggcaacctcaagggtttctcagtcttaactctccccttgaattcagtaatttcaggactggggtgataggaaaatgaaaatagaatgaaattcaggaagaattctgtttactgcgacattttccaacagttggaagtctccgctttcctgacaatatttgggtttattaaaagacccacctgtatgactttaggtggcactcactcatttacccactggaaaaacaaatttttttttttgtcaaatgcgactgagtgtcgcattatgctcttgtgtcttgtcaatcctcctatttgccaatttccagcttatcagctagacttgcttaatgcctgaggccaaggtactgcagtatctcttaattaactagttgcagacagctaattacttaactgcagtatctcatcagtatacaaagtatattgactccaaattggaaaaatgcctctgagcatttttaaagtattacaaaacttctactagaaaaggcatcttttaaaataccacccatggaagagcgtagacaaagggaggataagagagaagtgtggaggaaacacacttgaaagagtagtttcatttttcatctcaatcccttaccctctatatttcctatgtcaaaatgatggctttagagattctgtagaagtactcgcctcttcacaacctactccactctcctggagatgaccataacccctgaaatgctgcgccccaccctttctgagcaggttcccatcctgaacttctgactgcagtaaaatttagagagttgcctgctgcccagtctacaggccactgaagatgcaggaaacgtttctgatgaatgttttcaggacttggctcccaagcacttgctgaccagcctctttggtccagatccagccttgcctccaaccttgctggctggagtatctgtggcttcttgtaaaaggccggacatactctccttattaaagtgagattaacaggtgctaaggagggtattacagatcattagctacctaatcattaaagttctaactgaggagttctcccaagtagaccatttactgttctctcactagatggccaggcctgcgctgggcacttcatacagaatcaaactcagtctctacacactatgagctagagattattcttgatttttatttgataaactcgaagtgcagagaattggaataatttgtctaaagccacacatataattagaaaaaaaaacaatgcaagggaaaaaaagtgctttagaggaaaggagctagtgaaacacatcatattgagagtaaatgctcatttgggatgagtagatttttcttttggactcctctgccggttcagcagatcagtgctgcagtaatagttactgggttcagaaatgatttcactttgttggtctcattttattcttcgattctttacagctgaagcctgtcttcgccaaaatggagatctaagacatatgttatttccacttttcctctgtcagtttaatatatatagtgaccattttttttccttgagaagtacatatcctgtgcattggtgtggaggaaaagaaaatgccagtatgtcaccaaaagattagcagttccacaaccttggctgcacattagaatcacatagagagattcgggaagtccctatgcccaggccacactcccaacctgctaaattagcctctgtgtgtgtggcttcctgatatttctagcagtgcttctctaactttacatgaacacaaagcacctaggggttttaaaatgcagagtctggttcagtaggcctgtgtgggtgctgagaccctgcatttctaacaagctcccagttgaggccactgtttctgggcatctccacgttggggttaggctctaaattagtcattttcaaaatatggtccctgtatctgtggcatcagcatcaccagggatcttgttagaaatggaaaggtttgggcccctcccagacctagtgaatcactaactctggaggtgcagcccagcaatctggtttaacaaacctccaggtgattctgacgtacactaaagtttgagaaccactgctggggaatcatttgtagtttactccaggtttaggcttttgggaggcaagagagtttatccacagtttatccaaaacaatggagaaggcttattacaaggatacttgtggaaatgagattaggcttcataggaacccaaggaacagttgcacaaccaggacatatgtgacaaaccactcacagcaaggcatcctagaaattgggatgtgtccgggagcatctggagtgaccacccaggctgactcattgcttgcccagctgttaagagttcactgtttcttcctatagtgccttctcttatcatgactcagcaattcttccccatctctgctcccagcatagtggcttagttggagtcctggaatgagattacttgagttagaattctggcttattatgtgtactatcaggcactttacctaatctctcttggcttcagtttccacatactaatgctacctacctcatagacttgttgtaggatcaaatgagataatgggtgtaacatgtttaaagcattgctcgggacccagtaactgttcaaaatatcaagctgtcattattgtctttttgtgtctttatgcttctagttatatctaccattaactcactctcaatctgagttcaaatgtttgcaaaagaggcacagattgctggagtgagtcactgtcacggttattggtccaatctctcccaccaagcatctgtggacatcctgtctttttgctgtctggggttagatgccctcctctggtctctagtacttcacgtacttgagaagatccattcacgttaggactaaaagaaggaagaaagcacatgtgatgttgcgtcagtccaaggcagtgtgcccttcagggtgccttattcccttcgcttggcccaaccagtttcaccatctgctgatgaccttttgtgtctgactccacaatttagaaacctattattacatgaatctatcagattataacttggcacatgggttacaggagtggggactctgctgcactatcacttctgccttctcctctggaaccacgtgatcaccaaactagtgaatttaaataaaagggagaggtgctgctcatcaatagaggcaaagaggatgccaatctaggaataaacactacacatttaaaaagccatgcccttcccaccctccccagaactttaaaaagaaatatctttgtcattgtttaggcttgaagaaaacaggagctgctatcagtcatttagaaacactttccagctgggttcctacaacaaaactgctgggttaattcactaagatgtgtggactttgtagctcacaaatattaagagcagttttgtaatgaatcctccacggacaagacagtccttatttgactagatgggaactactagctctttccctgtctactgacctctgagtgatgagataaaaccatgcaaagtgtgagatgcttccctttatagttttgaatttgcatggtagcatttcgttcttgatcaggtagaatatctctgctgtctttactttctccttgtaggaaagcagacagaaagaatagtttgggctgagcatggtgactcacgcctgtaatcccagcactttgggagactgaggtgggaggatcatttgagcccaggagtttgagaccaacccaagcaactcactctcaatccttgtctctaccaccaccaccaccaccaccaccaccaccatcaacaacaacaacaacaccatctaaaacaaaacaaaacaaaattagctgagtgtagtggtgcatgcctgtagtcccagctacttgggaggctgaagtgggaggattgcttgagcccaggaggttgaggagtaagctgagatcatgccactgcactccagcctgggtgatggagtgagaccctgtctcaaaaaataaaatagtttaatgattataatgaaaagtctcataatgatctgaggacacagcattggttcctatcccttccgtctgtctcctgcacttattagtttccttatcatagggttttcaatgtgaaagagataatctcgtttaatgtctgaatttgagtaatccagggtacatacaaatctcttttaaagaaaataaattcttgcagatcttcagcatacctttattactttttattataaaatttctgaaatatgtaaaaatataaaactacatgtgtgctatacaatcataaaaacgaaaacaaatttgcaaattaaatataagctgggcatggtggcttacgcctataatcctagcactttgggaagccgaggtaggtgcatcccttgaacttaggagcttgagacaagcttgggaaacataatgagaccttatctttacaaaaaatcaaaaaattagctgggcatggtggcgtaccctatagtcccagctactctggaagctgaggtgggaggttggattgagcccaggaggaggaggttgtagtgggccgatatcgtgccactgcactcccacctgggtgacagactgagaccctgtctcaaaaaaaaaaaaaaaaaaaactatctatagatatagatatatgtatgtatatataaacaaagtgacaaccaatacaattcaaattcatgacagtttaaaaagcagatactggctgaacttaaattgtcaatgctaggtgtattaatagaaagatgagttggcataattatttttactcatgacaatcttaattattgctaatcattatttaaattgtaattgttattattattttgctattttaattataaagtcattttaaaatactgaagattgctcaatttagaatgcacgctccccatactgagaaataataagtataatttaacaaaagagtatttattgcatctttatcagcaacatatgcatggcacttagcaaaggtacaggtccttggatgtttgagttttcaacactgtcatgagccatataatgattcaattttcccatcacttgtctatgtccaaattgcctcaaaagtcttgcacgatgagtggtaacagcatttgccctccgtttggtgtacacctgattgtgaacacaaatacataggcagctattagaatctcatgttcatccagatgacacacctgtgttgcattaatatttatattatgaaaatgaaaacacaaggttacattctcacggaccttttgaattttgaggaaaatctgaggactctcagaggacctagggctccaaattaagaaaccttggttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaaccttggttgaattatcacctaagtttcagccccatttaattctcacagaaaccctatgacatagacacgcgcatcaacccaactccaccaatgaggactctggggcacacagaggttaaacaacttgtccagcaccacacaggcagtgagagaggaatgacgatttcatcccaagcccatctgtctccaaagcctctcttttgagaactctcaatacccctactctagaaaatctgtccagaatcccgacggaagtgcataggagtgatcactgggcagacagggacacatgcctagcctctttgcagttactggaaaaagttaatcataagctgaactaatgcagtgcctgttttgtgggacaaagatctcaattgtaatgacaactgatttaccccacatgtactttgtctcagaatcagcctcaaagccttcaggcctcatctggacatttgaggcccttacctgaagccagtgatgagctatattgttggatgaaaattgctttttgtgccttgaagtctggcagcttgttcattcatttattcattaactaattgtacagaatagtgggctacccttccaggtattctatcggtataagaaagcaactcacaggtcctgtctctctcatttacagacctagaatattgcctctggttcccttgctattgggcatgagtgcctccttccctccctctcagaagaaggcatgaatttgctgtagggtggtgaaaaaatattaactaatctaggcatcagaaactgggtggaagtcctgcttctgctcctaaaagctctgtgacctcgaacaaatcatttatctcatctgatcacaattttcccacctttaaaataagaatattgataatgaatttattgtgaggggtctataagaccatgtgtatgacaacactagggattttgaaaattttcaacagtagaacaggttattattttttatgtcccccaaacacttactgtgtacttattaaatgtcagtatctgtgttggcactgaaaatacaaagattagacatgatccctgatcttaatgagcttgtagtctagtaagggagattagtgtttagataagaacattgtgatgtagtaagatggataattgtagaattatgtgcaatgaaatagaggcagtactcaaagcgacttgagtaggacagtttaagctacatagagcagagacatgaacttagcttctaactaccattacaagtcatagaaacacccagaagcatggtgtgtttgggaattaagatcactgaggtggggcaggatgtgaggtaagtatccctatgtcacagaggaccaaggctccagacttgttctacttttgctgtaccatgattagataccgttgtaatgctcacccatgctatttcctttctacccagaactgtagaaagtaattgttttgtgccagtttagaatgcacttggaggatgaaaaacatcattctccacttaattggcttttgttgctatttttgcattatggttgcaggaccagctctgagaattttagagccacctcaacagggtgttccatcttgttctttttgataggtctcctttccttttggcaggctgttaatttcctctcaatatataatttggcctctgcattgttgctcttttgatggcctatttaggcccccagaactagaatacacttggccaaatgcattataaacaaaggagattttacctctgtagttctttaggaaacaggtagaatttccattccttctatgaagttgatgcctggagcactgagtgaattaacttgtctttttgccttattgaattgatcagaatatttggcatctttcatcttcaacccttgtcgtcattattgccttgtgacttttgtgaagaatgtggtttctatcacataattctataaattcaatcaaaccatgactcagaaagtgttgatatcttctgaatgacattttcaacaaatgccccaaacagtatggattgaacagcatcatccattgaactaatgaaagctggagcctgtattatcctcagtccactgccttaaacctcagggaacaattaaatacctgtgtattggaggcaatgaaaagagaaagtgagtatcataagtctgtgggcccttttgatttggtttgactgcgacgtgatttcacagcctacatcacagccacaggcccttcttataaataactttttcagtctgaatttgaaaatgtgcaggtagtttttagaaagtctggtctggatcagaggtctccaacatgggatgatcacacccacaagacaatccattgccacactggaagaatatattataactaagtatatatatagtatgcataaaatattagaactaatataaaatacagtacttaaatataaaattagttatcatatattagaactaatataaaaaaggatgaatcagagctttatgcaatgaagaaattggtagtgccctcagatggtgtagatttcagatggtcaaggtgccatgagggaggggtggtgccgcacaacagtgctgtcattcatcctttcctttcagcatcttatgacggtttgcagtttatatatataagcatgggaaatgggcaacagtcttaaaagatttatgtattgaaatcatgtgataaaggtaatgcaaggtcaatggcagaggtgatcacatctgacaagaaattgacccataacttcaacattataaacaaaactatttgaaatatggattttcttatgagctgaattgtgtctctaccccacccaattcatattttgaaatcctaaccctccagtatctcagaatgtgacattttttagagataaggtttttacagaggtaattaagttaaaatgagatcattagggtgggctctaccaatatgactggtgtccttataaaagaggaaatttggacacagagatatgaatagaggcaagaacatgggaagacccagggagaagaaaaacatccacaagccaagaagagagacctggaacagatccttccctcgcaggaacagctcacaataaaccgatgccaacactttgattgatcttggacttcccgcctctagaacagtgagaaaagaaatttctgctgtttaagctacccaatcttagctctttattaaggcagccgtaacaaactaatatagattcacatccagtctcattagccatgtgccttagtcattgtatattatgccttgagttattaattaatgatagtgtgaagccattatgactagaaagacatttgaaactatgctttcagaacatgaagacaaaccaagactttacaaaaaatgaaatatattcaattcactgctgccactgaaaatattaccatcaataataagatctctaagaggagaagaaaggattttttgtgccattaaaaaataaaaattttaaaatagtgacatttattttaatttggctcctaaaattattttatttctactttgctatatagataatatgatatctatacagtagtacatgtatataatttacaaataaatatacataaatatgatcaaatggtaaaatgtgttttattgatgaggtatgtaattaaaaatgtttagggaccactggccatgataatgtggcttagattcctcctttctaaacctagctattttaggttcttcagatataggacatgttagggtaatttatcaaggaaatagaagttctgaactaaccaaagtttcactataagaggaaaggatttatgaattggatgactcatattctcctatgaagatttaaataaaaatgttttctttataggtatcaggttttaaagatagtttctaaaatgatttaaatgaagctgtttttagaaagtaagttttgtttattttttaaacatttgacttccattcaatactattggtaaaattcccacagtggcaagaaagtcaggcacagccctccaaagtagtgaagggtacttaacaacccatttatttggaagtatttttggtattttgtatagaataaaatcaggaagctcagcagctacctctggagaatgcagtttgattcagtcaaagcatcagtgtgtggaactgggtaaggagagaatttcacacacatcacacacactcatatacacatattaatacatatacacacatgcacaaatatacacttacacatacacacagacttacatactcacaaatagacacacacatacacacaccagcatttatgtatcctagggtaaagactttttaccagagacaaagctactaacttccatggtagaagaatatataaggctgggtgccatggctcatgcctgtaatccgagcactttgggaggccaaggtgggagaattgcttgagttctggagttagagaccagcctggacaatatagggagaccctatctctacaaaaaatttttaaaaattagccaagtgtggtggcaccacctgtagttccagttacttgagaaactgagattggagaattgcttgagtccaggaggtacaggtaagaccgtgttggctgtgattgtgccactgcaatccagcctggccaacagagcaagactctctctctctctctttttctctcattgtggaatgattattaaatgatgattactctatatagtactatatatatatagtcatatatatatattcatatatatatagtcatatatatatatacacacacacacacatatatataaagtcagaaaactccacagacattagacctcataaggcaagtcactctgtgcttacacatcccaaatgttttgttcttcggagcctttttaagaatggaaggaaaataaaaaatgcaagaactttttatgattatttattgtgccactgctaatttgaagcctgccactcataacaaggggaatg

SEQ ID NO: 2213 - DNA, 1373 bp, Homo sapiens
ccgcctcaaataaataggtaaataaataaataaataaataaaagtaaataaataaataaataaataataatacctagcttatggggctgctgtgggtgtttgtaaagtatctcaatggtgcctacatattgtaaaggcttatgaatatattagttcctttctcaacttcctcaattcattccaccactacaagtcaatctagagattaaaataggcaaaactgtgatctacgttaggatggggttgtttgagtggtggtttatttctgactgcttcattttatacttgtattttaaatatacaagtttttgtaaacattcctaaaacaaaacagatctgtttttattttgaagaagatcggacagattctgatataatgtttggagaactaaattatacacagaattttgtctctgaagagttaactctatcatgaaaatgcactcagtgaaaagcaaacatcatgccacctttccatacacggtattatgtgtatttgaatgaacgcatatggaaaaacatggcaattcttcttttatgcctaaatcctatggaatttgccggctcctgtatttaagtctgggctgtgatggtaaacttggttcctgtcaactgagtgttgttatgtctttggcacattcccacagccgaacctcccgtctgtaacctgcacctgcagttcacaggattcagctcggagagctctgtacttccgggccactcagtggtttgagatatgtcttcttcgtgatgcttgtgtgagagtaaaggaggactccaaacaaacaaatgcaggtagcccagggtggaaagggcagtagaaggggtgtgtacctgccacacttagggcagccaatccagaaaggcttcattgaggaggtgttttgcaaataacgagataaacaggaagtgaggaggaagtggtggtgacgggatcctgtggaactagtttgggcaaagggaaaaagcatatgaaaactaataataataagagtgactagcacttgttgagagtttattacaggcagctgctctgctaactattttacatagatgatctcattaaattctcacaacaaaaaaactttgggtccaatttcatccccattttaatccagagaaaatcaaggcagagcaaggctatgctacttaccctcagttgcacagctagtaagtggtagaagcaggatttgaatctcagagtccagtctcttaacctgtttttgcagaaaggatctgctctgtttgggccctattaaggagcttggtaaacttagagcctagcctgcttcctaggtgggagattgttggatttttacctgggaagtgatatatttcctaatcacaagcctgatcagaattttgcaactggg

SEQ ID NO: 2214 - DNA, 8836 bp, Homo sapiens
ttagaataacagaatttggtcccctcccacttccgtaagttgaattcttaattgctaaatttcaggcttttttgttgttgtttatgtaagaatttcaaggccacaactccatatttgaagtaaagtgctcataaaattaattgcaaggaaatccatcactatgattcagtaagtaaacaaattcaaggtgtcacatcatattgctttttatgcttttgattttagtaatatcctttcacattcataatccagatagagagataagcaagattgtatccaccaagcctcctctttattgatcttccaaactgaaaaacatagctgccattttagtcagcagttaaactttattatagaatatttttataccttttctgctaacattacctgcaactcccatggtgatgctcaaatcccatttgggaattcagtgaactagcagaatgaaattctaagagactggggcttgttgatgtgtccacgctttccatgggaactgatgttaaatatttcacaaataccataacttccaggaattcacatattctttattgaatgtagaattgtgaaatctttaagaaataactgaatcattatttcttcactgtctcctgcctgtgaaagcagaactatgaaatagctcaagggaatcagtgagagatttgtatccattatattcagtagcctgcatgtgtccaaatcacaaatgaaatgatgtgggcaaatataaattaaaattgaatgttgcagaagtggttgaggaacttcaccaggatacattaatgtacaaactgaaaactgatgaaagacttctgaagagagatttgctaggaaaaataaaaagatatataaatttcagtgatgctgaaggagaggaaggatgtgatgtctttccccatccgtcataagggtcatggccaacactcctataacaaaaggtaggctaacgagaaaaaagcatgacaaatatttaatcatgcttttacgtgacagagaagccttctgaaagaaggctcaaagaaccagggaaaactatccatctttatgcttagattcaatggagtggacagttgtgtagaaatgtgatcggacaaaggaagaattatctaatagtaatggactgcgtgtggaaacccataagaactgtctattctgattcttcttggcctctctgtgtggcatttcttcctcctgggtatggggcatgactccttctggaattagggtttgatgacctactatcaaataaggggaggtcagagaatgtctttatggccagctcctagatagaaaggcaggacaaggttagactaatcattctagcttttatttttggctttgaggaaaagcagatatggtttgtatgacccaccttagggaagaggaattccagtttttatggttcaccttgagggagaatgaggggcaaaagacatctgaatccttcacttcagggtatcattttctgaggctcaatatggacaagtatttataactaggtgcttaatatggccttttgagatacacagttcctatgctgcaatctcacaggcaatgaatggtctttataaaagtgtgttaaagttgaaaaaaaagcaacaaaacaaacaaaaacctgaagaaatattcctcattgaaggtccagcttacattaaaaagaaaactataataatttattctcttgagaagggttgtatagcaaaggaaaattcttgaatgttccctctgcttgccccatgcatcaattctattgatattaaagtaggcctagcaaatgtacttccattctcactgactcagtctttgtaattcaacaccaattctgaaaaatacttagaaattatttcagtaaacagctcttataagtgctacatgcataacaatatttcaatatcagagacttctatcccatgagaagatattttcaacctaaaatttattataaatgacctaacaaagaactattttttcagtaattggctattatggttcaatctgttatacccactttacactagaaactatcctatattttcttgttgcctacgtaaaagtgggcacgaaaaggttaaacagtaaacttcctgactcctgccagccaagggaagactactggtgttacctacgaagtgtcatggcattctcatttctgaataatgagggaaatctgctttcaatacaaacccccataagacagtcactcttccagacaaattaagctaaataatccatcatgacagctgagaagacaatgtgcaaaatgtcagtggaggccagggagagaaaggcagagatggactgtaagagctgcagcatgatgcaaatactgagaaaagacattctctgttaatacagctcttaattgtaggcattttttacagaacatattgagagtgaagcaaagcttccttagcagtactctgatgtcttctcagcaggataatgtagggtaattcacagtgaaggcaaggggttaggaaagtcacagccctaaaaatcaatgggctgcttacagggaagaaggtgcaacagatcttggagagcacagaaaagaagagatgagcagcctgtattgaacagaaaccaaaatattagttagatatatccagcaaagccattccacaagttcgttagtgagtaggtgccaaaagccaactgtaaatcctagatacttgtacatatgcatgcttatattacttatattttaagcagtcatatcctcaagctatattatgagttcagtcattctaaaaagatgcttccattgtcttcttggcacttactcagaatcttcagttatcttattcatactgtgtgcttactggttgtcttaacaggtgagggcaggggccctgtcttattcacctccatatctccaggatatagaatagtgcttggcacacagcaggaactcaataaatattcatactattttgagtcccttaatcctcatatcaactacaggatttagattttattgttatctccattttacagatgaggaaaatgaggaacagagaaattaagtaatttgcccaagctatgcatgaataagtggcagagtcaggatttgaagccaggcagtcaatccctagaatttacactccaacaactactgcctctagtggttatgtatgtatttatacacgtatatatttgcagaaataattgaaacttatttctgcctaggtgcatgatatattaaagcatcactaaatccttctgaatataattcaaacttcttcctaccatagacaaagtaatggcctatagtgaacataatgattatcccatcatacaccttgtactgtattagttttctttgcaatctcaattacacttgcatttttattatcatggttttataaaactttatgactggaaagtaccgtattcataaagagttgtgcctcatatatgttagacatatatgcatttttattagtaattataacttttatgcagccagatagccccaggtttatgattccacatcttttgtgttgtgtcatcttttgtagctagttgatattgtaatgtttgctgacttaattcattcagttattaatttctataaactagaatttaggggacatttcaatggactatggagagaaaataactgaaaattggaaattaagagcatctgagaaaattcaagttgtttgtacatcctggacataaatctcaggaaaactgacatattttccttccttgtcaagtcatacaaccaatgctatcactaaaactggtctaacatttaaacattcagacaatcagtttagtcaatgcttcaataagtttactgaactagcagtttcttaccaactagttacagaacagtcacagctgaaaatgatctatacattgtattataaatgggattaattattctgccagacaaccccaggtgtgccaaataacccaaccccttcctccaagacactcattgagaaactagacagcatctgagcattgtaggaacaaacactgaagtaaatggattctaaatccctttgagttctaaaatgctgtagagatctgagaagcccacaaccttataacagcaggcaacatagattacgcttaaaaagcaacatactttcaattgattgataaacccttttgttgttcatttattgcaaataggttttagagctcaattcacacttttgtgaataaacattgaaaatatttgattcaatggttatatttctgcctgacatgaggaaattatagaatctattaaccttaacaatttaattagcatgtcccagacttaatcactcactatctgggtagaattggcccaattagttaaccactctaaaccacagtttcctcatctgtaaaatgggatggaaaataataacaactcatagggttgttaagaggaatacataaattattcatgtgccctgtatggcacacaataagtccttattaaatgaaccggttgtagaactgtattaagaacaagtagtagtagcttccatatttagagagccatcaattctgttttccaacagctccattagtgagaattgtgctgtgtgttttccccccaccccgccccactacaactgcattgctatatgcaaggatataacttctgtctctaaaactattcaaatagtgagcctgggaaaaacaaacttaggtcaaaagagtttgactaaactggctgagaacatttaagttggataaaaatagatgtattttgtttgtataaatagattttggtcatgagaaagaaataaagaggttcctctcaaaagaaagcctggtttagcagtcagtaaacattgggaagagtcagcagttgacttccccactgtgtggaagaaactgccaaaagcccatccagaattaggtgtgtgggagggaagaacaaaggagaggcaaacaagaagctgtcactattcaccactttcaccttgaataacctttaattgaaaaataaagttgccaaaacaaggagtaaaagaaaaactaccattttattccctccttgagattgaattagagggaaacatactgaccacagtaatcccaaggttggactcacatgatggcaaatgtcacttagttctaaagctctaattagaaacagggctgaagttttagccagctcctgctactagaaataaaacatgaggcaacagcaacccaagccctggacaccccctgacagtgaactctgaggtgctttctgagtgagttgagtataaagctgacagagcctagagaattcatacttgagcaaatattgggaaagaataaactgggtcagttaccacctgtttctagattttatttttttctagacttcaactaagattgtctttcacattaataagaagaacgatgaacataatctatttcatccaacttctacattccaggcacagtatcaaccactttattacattttatcttctgtaatattcacagtgttattgggtagattaaacaacttgcccaagttcacacaactggtgactggcagaaatgggatttgaacttatttgatgccagaggaggtgtatcctttaatattttagaataacttatttatttcattatattttatgaaccttgaaatatgtttattgtaaaaaaaaaacgcagaaaatacagacaggctaagtaaaatgtgtctttacattaaagtatttaatttgcaaaagaacagttgttattttaaaatcctaccccacagtttttcatatttctctttctatgtagggttaatctcatcaggaatttctcttatccatccacagtttgtaggacaattctttgcacataatgggcactcaaatgtacgcagatcatattagtccaagaaaaagctgcttgttggggctaccaagccagcatggtaacaccttacaatcaccctttctacctgcagtcacattgttcccagagtggggtggtgatacttgccagctagcccaagtttctggatatagacctttaacaacttcacaagtacccttagaaaattcggttaagaccgaacatggacatgcttgctccatttttttccactctcaaaatatccttgagcagtaactcattcatagataagaaaaactttttctcttcagttttttcttttctttttgaatattctttgattttagcagaaataggcacagtaaaagaataaatataagagacgaagaataaaatttatgaaatttagaaagctcatgttagagaattgtactctttaggtagatccttatttaaagaataattagaggaaagaaaacaaaagatgaaagagtacaaatgagattcctgagcagttttttattttgattgataaacttttaaaatgtgtttgaattacaatatttatatatcaggaatatgaaaggtttaatcataaaaattacataatatttcttccaacattttcatcttgtccatttcttcatatctatagtggagaattatccctctgtaggcaagaagaagtctttattctcttcggaagctgctcctcttgcactccaaaatatagttctgatggaagctgccaatcactttatcccattcccagaacaggcatggtaccagactgaggtcaatcctatactccaccttatttgccatggaaaatagcctagcgatacttgcatgactcagggcagttggagtagtttgatggaattttttaaaccacagctgacaggaagtagctctgttccttattagttgcaaatgctgcaagcatatgaccctagagttatctgttgccagttgttgccttgtggagatcataggcttaagatgatgaaggcagcaatcagcaataagcagaggtgtgcttgtgtgtgtgtgtgtgtgtgtgtgtgtgtgtgtgtcagaatgagagagagagaaaaattactgcttctgaaaccaaatccatttccaaggtgtggttttagaagcaaataaattgccaatttcagagctgattcaagttgaatttttgtcctgtaaccaaaagagtcctgactaacagccaaaactcaggctgtcaagtaaacataatctgtaagaatccgctttccagcctccattccccttgacatcttcctgaaagaagatttgtataggaaatgctgacgtctctttggcaactgcataaaaattattgtattcaacaaatttattatatgtctctttgtggccaggcagcttgcttggcactggaaattggctagggagattggggcaagaaaaatacctctctccatggtggaggcatacataaaagccgattgctacacaactgcgtaagaagtgctttaatcaaagcctgaataaagtgttgtggaaactcaaaggagcaagcaaaatgcttcacatgaaagttggacattcgagtcaaagactcacaggattttcccaagcagaaaagaaaggagaggacatcatggacagaggaaatagcatggtgcaaaggcatggtatgaaaaaaatacacgacaaatttgtggaataacagaacttttgatgtgatcacagcataatgtggagttgggtaacagtgagggattaggctaaccagcttggcagaatactgactaaaaattcttaaatgctgtgctaagttgttagaattttatcttacaggttttgagaagccatctgcagctcacaactagatgagtgacacaatcagatgtgcgtatgcaaaaaaaagcctggagacattgaactaagatcaaatttaatgtattaaatatggtagaaagaagagagaatgaaaaataatgttaacaatctaggtgaggaattgctgaggagacaaattaagtaaatcctgtggaaggaaagaagaaaggaggaaagaggattggatggaagaatctccacttctcataggtgtagtccttccttagcctgctttttaatgagtgctgctaaagcccttagcctgcctgtttacccttggagtggagcaatgaactgaagatatttgagtgagttcaagagagactcagaagagaagaattggaggcagcaaacatagacagcacttttaatgcttttctcatatgctgtaagacatgaaagcaatctattgggatgaaagctgaaaggagaagcgggacaagagaagtgaatccgtggaagacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaaaatctcagaatctgcttgagaatccggtccttcttcctccatacacccatggaacactcccaaactctgtatgctgctcactaattctgattaaggtcttcaccctccctaccttggaaattgctacaacataattgtgtttgtatgtataattaatatatacaatacattttaaatgaataactaaagttgacaaaaacctc

SEQ ID NO: 2215 - DNA, 8642 bp, Homo sapiens
tttatgcttactctccttccctctagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaattttatgtgcatacagaagcattatttgaagtcagcctgttttccctcaacctctagtactctgtaaagtataccaaaagtcaaggttttaaagaactgtgttacatattagagagaacaaatcaaaagttacctatctccatcgttaccagtagaacattagtatgtattttgaagcaccatttgactctttctatttcagctacttgcttgtcccttgcaaagttattatagtactcttttaaaacttttcttcaagggaagagctattttgacttccttttctttgatctaaacctaacacccagaatatgcttagcagatcatcccaaaacaatcataacttgtttaaattgttcatagcaaaagttacatattataaagagttatgagtgtcttaggcagtgaatagtaactgaatatccttttatagttgtccttcactagcaggaagccttattccctgcccttttacatatcttaacttagaatgttactgtctaaatagtggttaggcaagagtagttcttaaacgtgcagtaattatcttgcactacatttaagggctaaatagctagtagtggtgcttgataattgaagaaatttgtacagctggaggaagtacctgctaaattttcaaaagttacctgaatttaataggtaaatctgtttttaattagagctatatcattttactctgaatgtcttaacatagaagtttacataaaatttacagattggattgatttcagccttcttctggtactttttaaaatcttattaatcattaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagttactattctctcatgtggtccatatttacctccacttagctggcatcttcaagtgccacatacttagcagcagcctggcaccttctgatattttgagaagcaggaatccctgagcataaatgtaaatagcttagaactgtccaaaagcaaagacagcagaaaataaaattgttgcttgctatgttcaggaaaggaatgcttccattggatatggaagccagtctcaattgttacatcagcctgaggaaactcatgcgagaaatgccagaaaaagaagacagcaacaaagaagataaaagaaagactgacaaaagcattgaatttctggtagaaaaagcagtgtactagaaggttaggagatttcctagctgtcagccatgaaagggttggggaagaaagagcaatttggttgcatactgtagcatggtcatctagggtggtcctcaaacacatagaaatcacacaagaattgtcaaattgaagatttggatttagtagatctgaaaacgcactttgtaaaattggccacagtagaggtggaagtgactgaaatactgcattatttatttatttaattaatttattttagtcagagtcttgcactgtcgctaaggctggtataccatggttcagtcacagttcactacagtcttgaactcctaggctcaaacaattctcctgtatcggcctcctgagtacctggcactacagacatgcacaagcatgcatggctaattttaaaaaaatttttgtagaaatggagtcatgaactcctgggctcaagtgatcctcccacctcaacttcccagagtgttgagtgagattacagttatgagccaccatccctggccaataaaggtgtttttaatacctataagaatattgcctgcaaggatgtttgataggtttcttgatatttcattctctcttgaaatgtttgcttcgtcaattttttatttttcataaaagctttactcaagaattaggatgaccactatgttatctagtagtataatttggaatcatttattataaatctgaaactgacttgactgatgaatcttgagcactgcttattgtgttctaattttggtagctgtttcaataaagtagctcttgtagaataggaaaactatatcattttagtctgaaataagcttttgattaaaaggttactttttcctattaataaaaaatggagattaagattgcttttcttgctacacaaaattatttacatactttcctgtcactagaaaagaggggaacataaaatgttccatggctgtaattgcagtgcttagagctataactcagattactatacttcctaaatgtaaagtggttattaattttagctggaggaaagcaggaatgttcagaggcaaatgaagattctgcagaataagcaagctcagattgtcaaagagaaagttcacttgcagagtgaatacagcaagaccatcttggcaagaagcaagctagaatctctttgcagggaacttcagcaaaattaatgtcaaaataagacattaaaggttagttggtttattttactgtatttcaggaactacttaggctgcttttataatcgccttgtaactacttgaaataaattcttgctctatgtcttttaatgggaattagttgctataatggcttcttgttaactggctcaggtacacttgtgctggtagatcagattcctaagcagacaactttgtagacatcttaacacagagatcccttgctttttgttttgcttgagctgatgctgcctgtgaggtaactctctaaagactcactctatgtaaattttggtttcagattcaaggataagctctaccttagtctactgtatacttgatcacagggaatctagatgacattggtttttatgttcacagctctcctgcttaaaaagctcacagttgccagatatttttgttggcttttggtgtagttggttatcatgtccttttttggtaatgagtgaaaatcttagctgaaatgaagaaactggtagccatagtcagtgtgagtttgagaaagaaaaacacactgtagagctctactataaaagttaataggatagattgttaaactacattctgccatctttggctatttggttgctaaatactttagaatattacttacagctaggctgattataacagaagaaggattaagtatgacagcttgtctcaataatggaagtaaaaagcagagatcctggaaagaatctgccatccatcagaggaatttgtctgactttgtggtattgctagggggtgtatggttggagtattattttgatggtgctggatcaccctcatcacagtaaactcaagaacataggacagcttgtgaaataggttcttacttgtaaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccctaccgtaaagtaaaaactctttcacaggacagtattttagaacttttgtgtatgcacagtggaaattacatgtttattaggaaaagagtagaaacctgtaaacagaatgactaaattggagcatcacttggcccaagtgtcagtggagtaggataagtaaagggatttctaggagatgtgtaccacttgtctcccatatgatgctacaagattgtcaatatagcatacagatatttttctcttatgcagtctaataatacagatttgttccctaaatactctgtatctcagatttctgtgacaatctgaacaatataaataggagaattgtgctatttgtgagaataaggaacctactaattacccatcaccaagtcacattgtttgtgtaatcaatgaagtaaaaagtttgtggaggactcaatagttgtcgaacctagtcattggagttattttataaattgatgtggaagttgtatgatggctaaataaaaaacaaataggtgataacctgcttatttgtttttattttttctttacttttagaggtctatacatagggtaagatttcaattttcaaaggatgcatccccttcctttattatgctttaagctagtaaaatatatatttaaatccttacttagtagattaaaattggaaatagaaagtgacaatttaaaaattaataaaacagtaaatattactttatgcatatcaaaatgttattttgagttacaccttttcatgctacttttgaaaacatttttctttaagattttgagtatcttttaaaccattttcctctatgtttcaagaacatttcaaacttattatggaagctgcaaacttatagtagaatatatcacttggctttagcaattatttacttttgtttctagcaactcttgtttccatctatttttaagcaaatccaagatattatatcattttatttattactattcaaatatgcatcatgaaataagattctttttaagccataatcactgtactatttttactccaaaaggttaaacaattgctatgtaatcacataccttctcactgtactatttaaatatctgttacttcccttttccttcaggttgtttacatcaacatcaaaataaggtttatacattttattgttttaatatgtctcaagtctttttagtatataagcttcccccccctcttttttttccttggaatgtatttattaaagaaattttttaggcctatatagtgaacttttaaaattaaatttgttttatattataaagcatattatgaatatcatcagtttttttaaaagaatcctttaaattccattgttttaaataatggtattaaaaatgattaattttattttattttttattattttactctttaggatttatattattttaactgtattaaactctccaaatttgctatagaagtagcagattgggagaggacatgtgttcaagttgtactacttgtatgtcttgtttagatattacagtctttttcttttatcagaaaataattgaataatgataaaatcagttgcagattaagacagattatctgttgcagtcttctcaaaacttaatttaagtacattattttcagctagcatttcttccttcacatagaacctccatgtgtggagggatttcctaatgagtctattgtatgtacaatagcacttaatgacatagcttttaaataataacaggattttaccaaatgtttaatatgtgccaggcatcaagcaccttacacagtttaattattgcatagatttggacagcaactctgcaagttaggtatggtcatgaacctttgcagataaggaaactgtgtttcacaaggagaagaaattgtcctggatcatacaataagctaggatttgctccagaccatttttttcattttatcaggctacctacaattaaggaatttcagaagattttgtgaacaaaaaatgtccaggaattatgtgtgtaataaatgaatttgatattttgatctccttatccatctttttcttgataaaatatcagcttttttttttccaatgtagggcagaagcaagaagtacagatattttgatggggacagcccacgtctgatagggtgggacatggggcagcagttagagggttgtgctctttctagtgtgggatagtttgcaagatgatatgttgtagccacttctgcagtgacggggacagaaggagtcagtgttcttaactacagtggtagcagcagaaaagaagggtaagcagggttctagaaatttgtgttatgttttctccccactgtatttatttctttggttagtggtgcaagaaattctgttttcctgtagcaaattaataaagcgttcaaacataaggaattacgacaacagcttgtagatgccagacttcaacaaacagcacagctgataaaagaagctgatgaaagacatcagagagagagagagtttgtaagttctacttcttggaaaaaaaaaaaagatcgccaaaattgtaaccaaagccatttaaaacaaactcctcacttaacatagtgccagggcatgcaattttgtttcttactctctggatgtgggatatgcgagtgtgtgtgtgtgtgtgtgtgtgtgtgtattaagctttctgtttctgatgaaattttcatatgaaatttactggagataagattaaattagtggaaaaacaagataattttgctttctatgtagtggtcaccaagttaaagaattgtgccagttattaggcaagataggctttgagatttagggacagttaaattttacaccaacttagtgaacatgagacttctacctagtgttacatttcatttttaaataagcaatttaaaaattggtaaatgatttgtttactttgattatattctggtataattttctgacaaaattatctgtgtcttggtcagcattgttgctagaatatgtattcagattttgtctgtccataattgagaacacagaaaaaatctaatttgactatacccatttacccccatggaaatgaaactatattctatgaatgaaaaatgattttaataatgtggtgtattacattttcttcattcaagtaatgtaggccctgagtagagcatgttatgaatatttagttccttagtgttttctcattcaagcctctcatattgaatgagtctagggtttggagagatgtttcacacagcatgtctcttcagtgcaagctgacagatatcagtgcacaattaaagaaacttaattgcacctttcaacttggagtataaattttgtatgtatctatgtatatctatgtgtgtattttgtggtttaaggcttatttacataatatgtgacattttacctcagaaattcagtgactgaatttcacagctgcttcccatgcatctttattatctatgtttctgaaaaactcaaatactaactaatctcttttcttcccttagctgttcctttcctgtggttttaaaaaagtgaccagaaactaggtctctattttcattgctttgctgcatattcttttaacctgcttttatcttttacagagttgaggggctttctaaataacctagacaatgtcaagattcttagctgcgttttctgtctaaaagtgtagatgtctagttattcctcatgtaaaacacaacatttcaaccctgagtactataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcaggtaacttaacaacagagaatagcagaatttgtgtcttcttgttcccagccacagactagaacagaggatttgattc

SEQ ID NO: 2216 - DNA, 4026 bp, Homo sapiens
cggatttgccttcttcgtttcatggccacctctgtgggccagtagttcaagctgtctgaatcctcacttgatcaggatgcaggacaccagagttagcgtctcctcagggccactgatgctcaaaactgggcagaacaaggccagatgaggggcttctaatgcacagcctcccaacactcaccagccatccagctgaaacctttaaagctgcagaccagaactggtagtcagacagacaccccatgggaagccttctcaaaagagccagcaattaatgatgaggcacttctgctgggtttctcaagtgcctttgaatccatttgaaggttctaaaaattatgatgcactaaagttgaagtttgtctgtgtttacactaagtgagtctgtagagagaggaggatcaacggagagggggcaggttgtatgtgtgcaaagctgaactctccagagcacaaagagagcacaaaagctggatttgggagatgggggatcacctgggatttagcccctgtttgtagatgcctcaagggtcctgcatcctggccagggtaggactgggcctctctattccatggttggagctggccagccttgacctgaataatcatcgtggttggttttgtgaacagggacaccgaggttttaaaggagagaaaggggagccggggttaccagggctggacggactggatgccccatgcccattgggcgaagatggcttaccagtccaaggctgctggaacaagggccagagtccttggttagtcgccaagaagtgaagccagcaagcccagagccctggggaaagcgccttgccttggaggaggaaagaggtggagaagctgcccctggacagagggtcgccagccgaatccttccagggggtacctggtttgaggggatgatcaaagtgtattgtgacctcaggagtgcaaggatgggcctctgtcctctccaagggctagagctcagccaggaaagccaaggcccccacatccgcacacctccagctctcgtggcctgctgaggtgtctgctgcagccccagccaggaccctctgctgttgctgcaattttgagggctctcggactcctcttgctcatgaagaattgtggttctgtgagcaacctctctgcagaaggggctgtcagtaccatcctgatctgactgggaaagcctcctcccgaggcaggccaggcagctgtcacctctcccacctcttctcaacagagttccttcaatttcctttggtgctgccaccatcaaccctgttacttcctgggctctttccagtgtcataagcagacgaatgtaccaagctggaaaagcaaggagcgtttgtcttagaaaggacggaaccgcaacataatggaggagagaagcccaggagtaatactgggtggccatgccgggtgcctgggctggtcctcagaaccaggagcctcacacatctagtccggtgcccagaggtgccccagccagtactaaactgacacagacggaggcagcagtctatgtagtttcaggagggtctgaagtaagccctcttagcaaaattgttgaagggacagtggctggaaattaaccaccttacatctccctttgtcatgacactcaaaccaccttgctgcttgcttcttcagtgaatagaatgaccatattttcttgttctatccaggacactttgcaattaagaagggccctggtagtcagtaggctgtgacagcagatgtcaacctggcaaaccagcaggtggtcacagtgacaatgacccaatacccacgtcatcctccagcccttccaagccaagctctggcaacagctcaacccctcctggtgccttgtagctgcagccattcaccaatggcctcaggtgtccacagggccaggtggacattgtgtggagaacaaagtgaacacgcccctgttctcacctccatgcacctgggcgagtgggatatgatcagaacacaaatgacaactctcaccgaaggcaggacagacaggccagcggaaggcagaaatgaagggcaggggacattcaaaggatagaaagatcttgaataaacaaacatttggagggaatttttccccgacactattttaagatggagaggctgggtcgccagggttaccaggccattctggtgatttgactttaaatgctgggattctgactttaaattcataacaacatctttcctcggccctggtgggttaaagaaaatgctttagagcaaatttagtgttttctcccattcacagtatctggcccacaaggcttgtgggttaaagcacactcctgatcttcatttgataacctcatctctctcctctcttttggtgcttattgtaaagtaggaacagcagcctcattacatggggaggagcagtatgtccagggctgcaaacaaattgcgcaggtccattgcggccccgttggggtcaagggcacatgtgcatgactggatgcagcaaaagtcacagctaatgcaccccgatggtgatccagatgtgatgtgaggctcagtgggtacttagagatttttcacagccaagttaaccagtcacccaaccctcctgcccttcccagggcatggcagaaataaaaggcatccctatttaaaatgacacacgtgtgagtgggtttgaggattccagatgactcacaggatcctgtacatttgtatatagtcaaatggtcttcatctcctgccagcaaaccaccccgctctaaacctacaacagtcgaggaagacaaacccatcacgaccaccttctaagaagacacagccaagtcccagggctcactgtaagatcacaaatgcagtgaaactgcttgctaagagacatttttcttgcactccactcattccaaagacaaagcaatttattgcaaagtctgccaaaataaacgtgcctgcagctcccccagccagtgggaaagcacttgggctgggatgggagtaaggagatcgggtgcttgctccggccacagcgtgctagcagagtgaccgtaggcaagtgccgcccatgctctgagcctccagtccctcatgtgtgacctggggcaggcactgcctacctcccaggtgatatgagggctatctctgtggaagcacttggaacacagtaaagagccatgcaaaggctagacaatgcgattgctagtgtttgctgttcagaaaaacaaaaaacaaaaaataaccttgcttttcatagacaaacctcaattacatggaatcacttaagaatggttcgttaaaatttctggtgaaattaggttcaaagaggacctccttggaggcatgaagaaggcctgactgataaacactgtggacactgagtaatgaagatgtggaaatggtggccagcttggggaaagacatgaggatagatctaggaagttgctttttcaaactaaagtccataaatgttcataagagatttttttccctttctcctagaaaagtcagcaacttaaattatttttgctttaaaattccagttccccatattgctcgttaaatgaggtttttctcttcagagggctccagcctgcaatgtttcctccatcctggtcctgcccccacctccctccttctatctcctgcccccctgtgcccttggagacacgctgggcagactccccatgtgatcaatctgacgtcttaagtttaaacgtcattacctcagtatatcagcagaaaaagttctatttcattgtgtcttgtggcaaacttcagttcggttaatggagggtttcgtatacttttaaaagtaagtcaggctgggtgcagtggctcacccctgtaatccccagcactttgggaggccaagatgggaggatcacttcaggtcaggagttcgaaaccagcctggccaacatggtgaaaccccgtctctactaaaagtacaaaaaattagccaagtgtggtggcgggcgcctggagtcccagctactcaggaggctgaggcagaagaattgcttgaacacaggaggcggaggttgcagtgagccaaga

SEQ ID NO: 2217 - DNA, 569 bp, Homo sapiens
aaataacataaattgtcttagctaacactgaacaaatatcgattatgtgctggcacattatctgatttaattctcttaacatctccttgagacaggtctattgtgcagatgaggaaactgaagccctatcgcaaggtgatggctctgttgaattctagagactgcaaagatgaagaaactaagaaactgtggcacaaattattaactatactgcccaaggtcatacactggaaatgggtggtgaagctttgagaacttaaaaactgtttccctgcatcacttttccgaatctaacagagacttcaagcatggtttaagggcagagatggcgctgtgtgtttgattgttaaagtgaaaatgcagactgtgaggaaaatcaagactcccagagcatttaaaatggaatggtatttttcatttccatatgagaaaatatacggatttattaaaaaattatttgtaaaaatcctaataatgagatgtcatggatattttattttgttttattatatatattttttaaattaaaaaaacgtaggtagaggcaggtcttgctatgttgctcaggc

SEQ ID NO: 2218 - DNA, 11931 bp, Homo sapiens
agaaattagaaaacttagaaaatgctatttaaattaaaatgttcatgccaatgtgactgctgactgaaaaaatggcagtagttcaagaaaaaagaaagaaaaaaaggaacaaaaaaagataagatgaagaggaaagaggagaaggatgaagaagaggaggagatgaagtggaaaggaggagtggaagggcaagtgtaggaagaaaggaagaaaagaagaaagaagagagaataaaagaggaaaagagatttgaaaagcaagagttgtccatttacttttattctttcccttctgttaatctttaatttgcgttgagtggatattcactaaggtatttaatggagcctattattatttttgatatggtcataatgtaaattttgtgagtcagagatttcttttttactgttttctctccagcatctagaacagcatcaggcatatggagaacattcaatatgtttgttgaataaatgaactttcaggttgtacttttaaatatactaagacctagtcaattagatgattaatctatttcttatattgaataagttaagaatacagagaataactgtctgttgacagaatagacttttctaagtgaatgcatttccatttagtacttaacatgtcaacttggtaaatatttcagaattaacacaacaaataagcaaaatttttgccagtcggatctatgtactgataaattcctccttcctttcagaaagcttcaatttattacctctgccaacagggaaaatgttattgatgttgaaataaaatagaatgacggagggggcctgataattttgaatgtgaaatagttctagtaatgggtgtaaggagaatgtgggccctggtagcttcttcccttttctattttatcctggaaaatgtcagacaatcccatagacatttgtgtgggtgtagccaccaccaccccaaattgacaaaagcaataaaactaacagccatcattttatcacttattagatgccaaggattgctctgagtgttttacatgtgttaactcatttaatcctcagaacaactctttgaggtaagcataacttgacttccttttaagttccttgccttttttttgtttcctccctctctcatcattggagccacaaggacgtattttgaaggttggcaaattctgatttactgactgttttagtaaataaagtgattagaaaataatcacacccatttatgtgtgtatcatctagagatgcttttgcataaaaaaaaagtcattgtggtggagaccatatggcccacaaagccaaaaatattttctatctagcaatttacaaaaaacaattactaactcatgatctgtatgtttcacagaggaatctggaaaattttatttctttctttccagctctctaaaagttctgcctccacttttgcttctccatttcccacttctcttggcattttattttgcagagctagttagcttaagactaagggtgcagatctagctatgtggaatgaactcattatatgaaataaactctaaactaggggtgaaattgcctggattttagttcttgctctacccaaaatagctttatgatcttaagctgtccctttaccttttctgtattttcctttcctcacttctaaaatcaagcatgctaggtaatctctaagttccctctttgctacaggatttttataaagctgtataatcctgaacccacttaagggactcttaaaacttgcccaaatgaagtctattcaaacagacctgaatttgatatgggtgaaaatcatcaactatctgggctatcaaagcaatggcctttgtcttagcaaaacagcctaatgggtcatctcctctgagggtcctttacgttaaacaggttcaaaaattatagagaagaaaagaaaatagcttgcatagtcttttttcatctagatcaactgtttcttgcagaaaaagagaaatgactttcttttctttacaataatttctacacctcaagctgtattttaacacaaacctctaggctcctggtggaggaaacatatacggcagtatattggaggagtttaaatgtcagatatattcaatgctttctaagcaatagcttcagtataagtggggaaaaaaaagacagccagggactgaatttggggcaaagattaaaggctatttgtgtgaagaaggggaaaaatgatgacatgatgggttgggaaacaaaaataatctgaaagtatagatgtttaaatttcaatgacataaatttcaagctattcttgacacattctttaaggtctttatttgtaattctacttcaagagaaagggattaaaagtattcaattttggtttgtgaggagacattgctaaaattccatttctgaataaggaatgagtatactaagtacagatatttgggccctgaatactgtaaagaagtctttgaaaatgtgttcgtgggccatgttggtcagtgacatattgaagactatattttgcaggtgttatttcaagagttctgtcacccctgtttaaacccatttagaatgaagaacagagaaattaaattcaaaagctagtcttttgttttagtaatttatgtagcctaataaaggagttcttacaagtgaatttttaaagctttttgcagaaaaaaatatagagattcttcaatttggagagagagacacagagagagagagagtcggcagggaggactgttgcagagaagagatgacaaatggcagaaagtgcttgtgcatgtctttatctgggtgaaagacttatgtttaagcagcagtgtgcttgttaccaagaagcctctgaaaggcatggcaacatgtgccttgacaacatactcactgatggcagcagcagcccatctggagtggcccctgaaaagatgccaggtacagctgggaagccacagctggggttacgctccacagggctggtgggagctgggaacagatgggagccccatcccccaccaaaatggcagggcaggatccctgcactctcaggtgcagttgcagcctcctagccatggcaccagatctgggcatccctgtgcactcagaagcccagaaagccatcctgccctcttcaggcttagaagggcctgctcctgctccctggcttctcctggtgcctgatctgattttggagcaaagttatggccaagcctgggtgctgtcacaacctggtgggtgtgtaaacacttggggcagcactgacacactaccccgccccccacatacccactgccatcttggccacctctgggcatccatgagtgtgggaggtaggccaggtggggggtgagggcagctcagcagtgggtctgcaggtgcccctcagcacaaatagccacggcaccatggaccacatgttgacagtgggaggcagacaggttcctggatggaaaggggtggttccctggtgaaaccccaccttcaagccactgactgcctgaagcctgagggccaggctgccagttccagatggagtctaaggccagagtaagagcttatggtgctttttctgggctgcccatggccacctgtgaaccaatcaacacacactccctcccttctgagcacaagaaaaacccagactcatccaggctcacacagatgtcagggctatcagctgcaggaaggagctacccacttagggtaacccccacttgtggggacaacctgcctgcagaaaggagctaaccactatgggtctcctctctgctgagagctggacactcattgggacgacccgcctgcggaaaggagctacccacttcaggtctcctgagagctgctctgttgctcaatgaagctcctctctaccttgctcaccctccagctgtccacatacctcattcttcctggacatgggacaagaacttagggcccaccgaatggcaggattgaaagagctgtaacacagacagggctgaaacatggcccctgctcaccacattatgggtgatgaggagagaagagctgtggccccttggggaacccagacctagcggatccccaagccagggctgtgacaccatctctggggctctgcagttcctggtgtctccaagcttccccagtgcctgcagtggaagctgcttgcagtatacctggtccagccgcagcctcacatagagacggtgcctgtgctgatgcctggagctgcccaccctgccgcagctggcatgcctggctgtgcacagtggccagaccccatgcttgcttacacatccctcatggctctgcgcctagctcacccttggcaggagtgggatccaggccattagcacttctgagcacagccttccagcccaagtgggcagaacaaggccagtgggccggagcaaaacttgggcaaaggtgctgctagccacagaggtttctggctggaaaagcaataccctaaggattctgtgacatcacgaggccagaggctatgggaggtaagcttcactgcccagcttccactgacttcagcctgctgcgctttgtagcacattgtcaaagctagaatttctggaaacatattcaaaagaattaagaaaaattcaagacagcatcaaaaagtcactaatgataacaaaataattattatagtataacagtgattcacatcatctagtaaagcatgccaagtaatatgatttggctgtgtctccacccaaatctcaacttgaattgtatctcccagaattcccccatgttgtgggaagggcccagggggaggtaattgaatcatgggggccagtatttcccaagctagtcccatgatagtgaataagtctcatgagctctgatgggtttatcaggggtttccacttttgcttcttcttcattttacccttgctgccaccagaaagcttggaacgtcttagagacttgggaaagcttgggaacatcttgggaaagcttggaacatcttagagacttgttgaatggctttgacaaaaatgttgatatgaacaatgaggtccagacttaggtggtgtccaatggagatgaggaacttattgggaactggagaaaaggtgactgttgttatgttttagcaaagagactggtggcattttgccctgccctagagagttgtggaactttgaacttgagagagatgatttagggtatctggcagaagaaatttctaagcagcaaagcattcaaaaggtgacttgggtgctgttaaaagcattctgtttttaaagggaaacagagcataaaagttcagaaactttgcagcctaacaatgcagcagaagagaaaaaccttttttttttttttttttttcaggagaaattcaagccagctgcagaaatttgcttgagtagcaaggagcccaatgttaatcctcaagaccatagggaaaatgtctccaggccatgtcagagaccttcatggcagcccctcccaccataggcccagaggcccaggaggaaaaagtggtttcatgggccaggtccagggtccttgtgctgtgtgcagccttaggacttggtgccctgtgtcccagccattccagccgtggctgaaggggccaatgtagagctcaggccatggcttcagagggtggaagccccaaaccttgacagcttccacgtggtgttgagccttaggttgcacagaagtcaagaattgaggtttgggaaactccaactggatttcagaaaatgtatggatgcccaggcaaaagtttgctgcaggggcagggccctcatggagaacctttgctagagcaaactggaaggaaggaaaatgtgggtttggagcccccacacagagttcctagtgggcactgcctagtgcagctatgagaagagggccaccatctttcagaccccagaatggtagatccactgacagcttgcactgtgttgctggaaaagctgcagacactcaatgccagcctgtgaaagcagctgggtgagggctgaatcctacaaagccataggggcagagctgcccaagaccatgggaacccatctcttgcatcagtgtgatgtggctgtgagacctggagtcaaaggagatcattttggagctttaaaatttgactgcctcactgaacttcagacttgcatgggccctataacccctttgttttggcctatctctctttcggaatggctgtatttacccaatacctgtacttccattgtatctaggaagtaactagctttcttttgattttacaggctcataggtagaagggacttgccttgtctcagatgagacttttgactggatttttgggttaatgctgaaatgagttaagattttgggggactgttgggaaggcatgattagttttgaaaagtgaggacacgagatttggaggggccaggggcagaatgatgtggtttggctgtgtccccacccaaatctcaacttgaattttatctcccagaattcccacatgttgtgggaggggtccagggggaggtaattgaatcatgggggccaggccttcccatgctattcttgtgatagtgaataagtctcacgagatctaatgggtttatcaggggtttccgcttttgcttcttcctcatttttctcttgccaccaccatataaaaagtgcctttcacctcctgccatgattctgacacctccccagccatgtggaactgtaagtgcaattaaacctcttttggttcccagttttgagtgtgtctttatcagcagtgtgaaaatgaactaatataccaagctatcacatcactgagtgtgatgggccatcagcactgctgtgatgtcctgcaaaagtggaattatttcttgacttgacctcactcttatgtacttgagaagctgagttctcttctcgcatgttctaataaacaagtcttataagtctggctctggttagcccacatgttgaacctcttacttgcaaccccactgatgtgtctcccctatgcctggacataagagcctctcaatctcacattcatccaacagcatctctaggtgtatactcacttgtagccaaagtaaattttacaccatgataaaaattagtgtaaagactttacagggaaccaaagtgcctgggaattctgatgagtaactactgagtggttttttttaatctctttattcaatagacgtaaaagtttaacaattgaagattttaggtgcctcgcttttacattatgatttttaactagtgcatgcacaaatatgctttggcacacaataccctttccagagccatcaagatttaagtcatatttttaaggacagtgttaaaatgtttacaggtttatgacccataagtatctggtttaactactctgtgctgcaaccatttttataattattttctctttcacaacttttacagtaattttatattcatccttggagatgccacattgtgttttcttttggcttactaagtggacatcacaatcggttaaaaatttgccatttgtgtgtatcagggcatagaaggtggaggataatagtgggggttgtaaatgtattggataaattatatggtacaatatgttagtgttcatttatatccatctaatatgagcttatatgtcacccaaaggtagccccagttaggctgtgaatactgtggcccagtatcaaagtgatcgtaagttattcctagaagagcgtgtccctgccaaacacatatcagggcttcacagttttgaccttatttcatgtggtccctcttgcagctagagtctggcacagaaggcaggacttccagctggtactttaggtacattggggcactagagataatgaatgcacttgacatttacagttgggtctaaattcacaactgtgtcagataacaagagctggattaacgagtggccagtatgcagagatacagaccatctcaatggagacctccctggagtatcaagacttacaaagagagatgaacacattggaagccaagaatggtttatggattatatttgctaaatgtgtgcaatcctcaacaggaaaaccacagccaggtatccaaagcagaactggagtgtgcttatatgtgtcaggggaagaggtttttatgtctaataggcacagctagtttaatatgaaacttgcactgacagtttatacctaactcgactcaagactttcatagttatctgtaaagccaaatactagatttgactggctattaaataagcatggcagaattgtgaagacagtattatacgactatgaagcgaattaaacccttcttatcacccctctccaaaatcagaagaaaaaatattctttcactcctttttttaaaaatcatgagatacatttttttgttaaaaaattaaaaatgcaaaagtgcaaaaaggaggatataaaaatcttcacaacctcagataaaccccattagtattttggttaatatccttccagtctcttttcaatgtatgtgtgtgggatcaattttaaaatatataatatgaagtataaagcataaaaatatactttttcacaacctgattttagtctgactcaccaaaactttgcgattatctttccatgatattgttcttcagctgcttcaggtttagtagcacatgatattccattgtataatcttattttaatttacttaagcagcctcgtactgttggacatttgttatgtccaagtattttgttactacaagcaatgctgtaatgcacactaagaagaaacatatcccttgaaactggttctacttttaatattttcaagcgttctttctgccattcccatcattataaattaagtttcacccactcacttgctgagcatctagttttcctctttgtctggaactttatgtatgtccccaaatggaaatgacaagaaatatttaaaccccaattggtttaaaaattaggtatctaccttatttagggacagttttatttataataattctaaatgtctgtgaaatttttaaaaggattgtatctgcatgatccagtttcttgatgtatgtattgccgtagtttatgcagtgatgcatctatttacagagtgtgtaacactcaggacatatatgtagagcattgttgatcagtgtgtggccttgggatcaagaggaagctggagtaagttagcactggttctcaaaaaaagagttcaagctaaaagcatgtggcatgaggaactagtctactcaggctacatggttgaaaatcctgagatagcaaacactgaaatccagttcatgggtattgatgccagggaaggataccagcaagtaaaaaagtagctttttgtatggcaaattttgtctgaagcaggaagtctctctcctttctgccaaagttatctgataatctcagaaagtgggcagacatgagctcaaaattatagtttagtaaaaggttctgtttttgatggcatgaagatacaaacagagtagaacgtctctgacactaatagcttgtggatgagcagcttcataagcaaccaattatgcttaaaaatggtatcgattggcctgggaaagtctttcagagattttctaggctgatgagcatgtggtgccctctggagtgacacagtctatgatacaaggagaaacatgaagaagctaagcttctcatctagtctgcacaggaaaagaatgaatcaaactcataccttaatactctttccagggcagcacaaagtcaatccctcatgttttgtcttacaaaagcaagacagctaagaaggtacatatgtcttttaagatgctggcgtggtccccactccatttgcttattcacctacagaaataatagctgtagaagtcatttcaaatgcaaaagctgctgttatacatatttaatatttatatatgactacatagttatccatttattttttgattttgaaggaaatacacttattcattgagtaacctttattaattagctgtttgttgacttccactgtactaagtactattaagtacataactaaatgatttctatgcttaaggaaattatgttaccgagaaacatatgtgtttttaatgtgtttttaatgtgtctcatgttatatgttctataaattgtttccatatatgttatctcatttgttcggctgtatttcagaaatttccatctgaaagagatcaggatatcgtttcacccaccaggtgtacagatgagcagaagtaagacccacagagattgtgacttgtttggacaatcaatatcagaaccaaaatcttctgattaaacagcaatgcacctttttaacactttttttcttcctatgcaaacagatacaaaaatgcctcttctcctttccaatatatattctaactttcagtttgtccagtcaattctaagtttgtcaaacagctttaattactttcaaatacttgaggtttgtcctgatacaaatcatatttatgaagaacattttttaaactttacagagctgttatatttaagggagagctaacacatatgtttctgattcattacaattaactcaaacttttatttgcaatacttatttgatgcttaaatacatcattttggcttcagtacagtttctcctaaaagtagatgccattgttcattaaaattaaatttaccactaaaaatcatcatttagggctcaaaacttcataacattctattagatttcaagcttaacaaaattgttcatttttactaaaacaaacttttcctccttttacatttattttcaactccctatttgcttatagataaagctatttccttttacattttctaagaatcctttagactttgtatatcacagttatttaaatggcttttgttgtcaaaaaggaaagaagaaggaggaaaaaatttgctgatttttttctaaaaaataataacaagcctttaaatgaatacctcttttcaccgttcagacatgactgaacttggcattaaacctgttcttaattcaacccatctgttcagtgcccactactttatttttagtgccaccctttaaaactgcctgaaatacttcatagtaaaaattatcaaagaacatgccactctcaacataacaaacacatatatgttcaccaatgaaccaccctttctgacatggtggtatttatctcatgtctctctaataccaaatacatcttttgaaaaaaattctcaacttaggcagtttaaaccactaatcatgtggttttattcagtgtggcatttgagtttaaatcattaatttagtatagtgccaagtatatacactggattttttaagttactggcaataaacggaagatggctgcatattttattaatgtctgaaattgtggtggcaatgaaaacaaatgacctcatgtaattcctcaaatggcatagatgggattgttgatggtggactgcatttagttgaagttcaggctttgccactgtcttcagacccacggacatccttgtgctggagtgagaagccacaccacagctacagagcgacgtggagggcactgtggtgaacccaggacaacaaccaacagactttgcctgggacatgcccaagcttctcctgaggatcctctgctttccaaaacagccctgagagtttctcagaaaaacctgattgtgctgcttggaactacagtttcagtctctgtatagttcggaactagagtttcctatttcaccaagaattcttggtatttattattaaagccaaaaatcagtttcccatactttaaaactttttattttacacgagctgtacatcaaagatacacgaccattttttatgagaattctgtagttttaacttctgggataacatgttttatgcataatcttttttttaaataggactttcattgcgagtaagaatttgaaagcattggtggggttggagaaagcaaaaacttgtgcaggaactgcactgggaatacagcaatacaatatgatatggactcatttcttaag

SEQ ID NO: 2219 - DNA, 5948 bp, Homo sapiens
atttatatatatgtctttatatacacatataatgtaaataatatactatattattatataggggatatagagcattggagccaccttgtataccctaaaaaggttttgacagatggatgaaaggaggaaaagacattgttgacattgttggcaaagggagccatgtgcacaaataatatatatataatgtaaataatatatataaacatatataagtataatacatatgcacacacacacatatatatctgtttcaaaataaatatcacagatcttgacttttgggttagttagttcctcctctgtgccataggcctttgcatttatgtcttttagtgcatttgttatacataaatcatttgttttcccaattaagtggtgagttttctgagtggctgctcagtggtacatgctcaaagaaatagtggtttgaactgaagtaagatttaaatctgtttcagtaaataaaattacctaaagctgggacaatatgatattgaccttactcgttcttatataaatcaacatttaactcttaggctttgcctaggccttcttaatgtttgaaaagtgatgataatagctaacattgactgtgcacatactgtgcatcacactctgttgtaagtacttttattctgttctaaatttctgttatttgattttctgttatatatgagaaaactgagatgtagaggttaagtaacttgctcatgattgcacatctgttaagtggtggacttctaccagagcctaatcgtaacaatgtctgagatagtaattttaccctacatgtgcatatgacttaattatctacaagtgctttagcacattatcttatattattcttatttaatgagcaaatttactctaacaactgtacgttttccttgatgaacaaaatacagaagtagtcagctgacctcaagacctcagaatctagtgggagtgattttggaatactgatgacctagattcttgttctgacatagtcaccaataaatatcgtgacattaggcaagacatttcatctctctgggataaactgaatggtagggttataatcaaataatcatcaaaagcttgaggatctttttaatcagcagaatacaatgaatctgcagtatgttcaagatcttggaaggtattagtgacagagccaggctaaatcccaggggttaaacagcttgttgtttataaaggggttctcccaaagctgatactaggccatcttagtttacatagaatataagaatgagttttgtgtcatttgattcaaaaattaataaaattagttaacaacatttaaatctaagacgaatatctcattcccttggtcagggtggctgtgtatatctgcacaggctatgcactgtacaactccagagagcactgttcacatacactgtggggaaaatgacacccttggaactggaaaatatggtggcctggtctttggcgacccaattccccataaaagctgctcctttggtattattgtcattatttatttgttaaggcaaaaccccatattgtagaatgagaaatgaatataatgggaaagtgtcggcaggtctgtgtggtgcacagggtagacacctcaggtcctccacacctgtttagtctcttgatccagcctggatcacttttcatagattctaagaaacttcatgtggtcacatgtgactggcgttgcctgccttctgtgagagtgaaaaggaaagcaaatttgaaccaatgatgtatttgcatcagaaatatcaaaccagtagcagatgctgctggaaccaagtccaccagactacagttgaagatcaagggatgagggagatgcagaattgaacaggtgctgaggtagagtccagtgatgaggaatgcgtggtaggttcaggctacaagagggaagaaacagagcagaggaagcaggacttgcatttatttcagcgaaccagttttgcaagccaggatcaaaggtcccaagaggccctcttgtttttcttaaaggtatctaatcccttctctggttgtggtcattctgaggggtctaaaaactggctttagcccacatatcccagaggttcttggattttaaatatacacctagagatgacagtagagggtaataagtggattccaagtgctgcctaggagggacattttgggaaagagatgcttcttagaaagccttgaatcatgtgcccctgcaggtgcttgtgaggcccactgtgttccgagtaagcaacaaagcacaaggatgcttcctacatacttgatcccaaaggaaaaatgcttacctaaaaccgagaaacacgtttctttctactgaacagtacataatacatagtgcatgtgttatggagtttctttgtgtcatcttctaaagatttttttgtttttaatcattttgacattatcacttattattcagagtcttgaggacgacaaaaaattataacaataattttcctgattctcctggagtgccttcatggctgtatttcatttaaaatgaaagcacctaattagttactcaatttgagataattatccatatcactcacctaaatagttagagtcttctggctcccaggaaaatgaagtcaattagcaaatgcccaagttctttatagtcctctagttccagatgactaattttctctatttctctgtcatgcacacatcactgacacctcagactttcattatgttccctgacttcctgtgtcattttaaataagtgtttatattatattccttatttgttcttcaaagtagtaatagtcaaaataagcttgctgttgaaatacacactggattacaatattttattcccttaaggacctggggtgtttgagatgcatggacttcttagttctgctaggctcagttttgatatattccacacatggctaattactgtccaacagggattgaagcccagcttttctatgctaggtagtgtttggcaggacatccttttgcactcaaccatcagtcatcccctttgcctttctggtacttctcagaggatgccttggtcctcagcactcacgagcccacactgtggtccttttcctctgtcctctcaccttgtagtatgggcagtgcccccagctctagagtgtgctgcccctgtcataacacctgcagtcttgtggcataatgaaaagcaaacatttggtctttctcctaggctctcagcacagagctcttaaaacccttggagacatctgagccataagagtgtcctttgtatgctaatcagatgactcatggtagagagttgggggtggagtgggtagatagttccagaatgggggctggtcccagaaacagcccgtcattattaggtatggtcattaggagcaggccattattggaacttccagccccatgcctcaacctcccaggaggggagaagggctagagattgagttcaaccaccaatggccaatcatttgatcaattgtgcctgcataaagaaagctccataaagaccctggaacaatgggattcagggagcttgcagggtggcaaatgtatattcatgtgctggtgcatcctgactccatggggatacacctcctgcacttggggaccttcagtcattgctctatgaagttcttcatttggttatttctttgtatccttaataaggaaagtgctttcctgagttctgtgaaccattgtagtgaattactggacctgagatggggtcatagaaacccgtggatttatagtcaatagaagtgtaggtaacctgaacaccccatctgcagctgccatctgaagtggggcagtcttgtgcggctgaacttataacctgtggggtctatgctaactctaggtgtcagaattgaattgaattgaattcttgaatgcccagttggtgtcagagaattttgggggaactgattgttgtcagaaaaaacccacacacatttagtattagaagtggtgtctgaaaacactacacagactctgatctctgttaggatcatttcaatttatattaaaattgttaaaatctcaatgaaaaagtttttttccccaggcaacagattggcatttaatgagactctctcaacaccttactttagaggtgtccgcaacagtggggaggctccagtgtggcaggctggtgcagaaaagctatttggccagcactgtagcaatacagaaatcataccacattggcaatgggtgcagcagaacccttggatataccattgtatccacagtaaatcattattttttatcactagtgagagtgatctgagtggcaagagtgtctgcagcacatgttacattataatattgatggtgatggtaatgctgataaacctttgaacatttaataattcatttctgtagcttgttccaaaatgccctgtgatgtcaaagtactgtgaacagaagtgcagtgaacattttgacttaaaggatgcaaggtacattattcttccctattgtagctatcatggggccgtgtgttgagatgatggatccacaaggcagaagcatccagatgcctctgtaacctcctggcagagggctgtactgcacaattgcggagatctacggtggactttgtgtgagcaagagataaactgttacctgtttgaggtgctgagattgtgggttgctatttactgcaggattgtctagccaagttccctccaagagttattttcttcccaggaagctcaaagtagaagttccctttttctgtgcgtaaggaaacaccccactgatgaattcatttcgtgtcaatatggctaagctagaaacacattttccagaattcccttccccttgtagttcctatttagcataggcttcaagaaaaactttgtgtaagatttagaagagggagcgaaggggcggtttgttccttcacatactcaggaggtgggtgcagtgcacgcatgcggttgcttatctactacctcacctagttggtttgggaccatgctgggcccacagctccagctcctgcaaacgttctgcttcagcttctctgaatcatgggttagctacatatgagcatcctgacgaagagtacccatttcttacccagaaagctgttgtcatctgagctgagggcttggaggtggggagacagcccagactccagtcttctctggtgggttccagctcagccttgctagttcccacttgtcctccacttcatgtacagtctcctttcccagctgcatgccctgtggcctttgggctctagcaccaggcatggaaacaacagccttgcctagactaagtgactagctggtccactgtgtagggtgcagtcctcatgatgcgtattccctagtggttctcattctctgagcagacctgggctggtgcataaaccatggctctctcctcctcaccattttagttactgctaacttagaacacaccacctgtctctcaccttcactgctgctgccacttctctgtttccattccagccccaaccattcactgtccacacaacaattaaaaagggatcattttccagtatgaatggaatcacatcccttccctgatcaaaagcctcccagggcttcccattacttttaagaacaaaatccatatgagttatttaaggcctgcctgacttggccccatacgcctcttctccttctgtttccacgttctgccagactccctctctgatgcacacaggccccctcccaccttcctcctccagagatagcttagaaaaagagacgagtgaggagaacgttaagcaaggtgagaactatccttcataccatgaaaataagcttatggtaagccaaacaagatggaaccatggatttaaagctttgtggatcatgatctgcagtaagcaaatgcagtttacacacacatacacacacacagccaaaaagagtcatttcattaaacaatgtaatatggtcttatgtggtatatactct

SEQ ID NO: 2220 - DNA, 17048 bp, Homo sapiens
cagtgtgagaatgaaaattagtgtcagactgagtgtctagtaggttaggggtaagggtcagagtcaacattagataagtgtcaggttcaaattaaggtttgggaaaaaattaaggtaagggtcagacaaagctcagggtgagggtgaggatgaaggtagaatcagggtaagagccaagttcagggtcaggtgcttatttagcatcacgttcagtgtcaagctcaggtcatggtgagaatcagtgtgaggttcaggttaagggtcagagttcagtcaggaagagagtcatgtgagtatctagatcaaggtcagggtcaagatcgtgatgaaggtcagattcaggatctgagtaattgtgaatgtcatggtgaggattaaggtcagattcagaaggagtgtgaggtatatgtccagggtcaacatcacgataaaggtcaatgtcagcatcagggtaaggggtagggttaaattgagagggtaagtgtgagggtcagagtcagcgtgagggccatatgttcggggacacggtgagagtcaggttcaagattaggatcagattcagggtgagcatagggttagcctcagagttagagtctgcctatagacaagttcattgtgagggtgagaatctgagtccatgtcagggtcagagtctgggtgagcatagctgagagtcatggtagtgtgagaaacaggatgaaggacaaggtcatgtcctgtgtcagagtgaatggcaggccaggctgaggctatggttcaacaggaggctcaaaatcagggtcagggtcagcgaaaggattaggttcagggtcagcttcaggctgagggtcaggtcaaggtcagggtgtgggtcagagtctggggaaatgcaaggccaagggtcaccaacactttttgggtatttgttgtatagaataaccaaaacacaccctaggccttagaggtgcattatttatatgcaccgaaagccaacagctgcttcattgatcctccgcatcccctgctgtccaacctactactttaggtccttggaaagaccgacctgaagaaccctggctcttaggaagccatctagaacagcaggagtatctgcttttgtgttccaaatgcctccccagttgcatccttcaggctcattgagctagtgacctggggttggtcccagcctcctaaaggcacattttaattctctttattaggagcagaggacgacttgtcagagattccctggtcttttctactgataccccaccccccccccccgccgcccactgcaggttgaggccgatgctgggctcagccaatcctgttataagcattagatcttgtgccagcgacttctcttgttgcctcatctgtaaaataggggagttaggttttatggccttttcaaactctatgggaacctttcaagcattgactccttgcaacttttaggccttgcttcttttctgaagactctatgaaacagtgttttccagctttttagattcaaatccctaatggctaaaaatacacggtgatgatctcagctctcacaattcagaggccgcctcccgtttcattgggaattgccataactcttacataatcccaaaggtcaaaaaggttctggacagctttaatttctatagtttgtactatgagaataacagcttttgggggacatttttctaaataacaaattgcaatatgaaatctgctttttcaaacaccgcgccctaccactcactccctaggagagcccaacaaacttcctcaggctgtcattttcaggtctcttctcacctcccatttgggaatttctgctctcgaatcatttaaagatattgattatctgctccaccacggaccctgttctctttctttttgtcctagttgcctgtgcttcgtgtcagttttcagataagaaaagagagtgctgtcaaggctctatttataatatatccttgaaagccaagtgctgtctttgagctaaaacaaggcaaggccacccttagggagaatgagagccctcaatgcccaaatgtgggcacacgggcacgctcccaggcaggcttgctcatgcacacacacacaacatccaggtccaaacgaacaagagaaaagacacgcaggtccagggaaagaagaggaaatgcctggaatgtgatagaaactcaatacatgtttggtgaaaaaaaaaaaaaaaaaaaaaaagacaaggggaggggatcagggaaggaggaattcagagggactgcaaatttagtgaggaaagcactgaagttggagtcaggggatctggatttgaagcctggctctacttttcttagaaatttgagcttggacaagttcctttcctctctgaattttggtttcttcctcccttgagtgggtgtaagatttccttcccaactaatctcataagattgctgtaaaaatcaaatgaaataatagctatggaagtactttgtaaactgaaactactataaacaaatgaggtgctcagtgtcgtagctagcattttttagggtgccgtttgccagtaactacgacatgctctgtatacattaaagtatttaacctcacaacaatcttgcagatataagctgttattgttactctcctacagatgaggaaacataaagacacaaagtaatttgctggaggtcacactactagtaagtgatcaactgggatttgaaccaggcctaccttagtccagcagccaattcttttaaccactccactacctgctaggccttaatatgtatccaatgccttgtcacatacacaagtgaacttcaatctgcctttcagtgttaaaagacattgtattagttgcctagaactgccaaacagaataccacagaccaagcagcttaaagaacagaaatttattttttcacagtactgaaggctgcaagtccaagatcaaggtaccagcagggttggtttctggtgaaggctctcttcctggcttgcagacagctgccctctccttgtgtcctcccatggcctttttcctgtgtatgtacactcctggtgtctctttctcttcttataaggacaccagtcctattggattaggtccccactcttgcaagctcattaaaccttaattacatccttatggccctgtctccaaatacagtcacactgggggttagggcttcaacacatgaatctgagggggacacgtttcattccataacagacaagcaatagataaatactccaaaaaataaaaagtttgtctacttcccctctctgtcccccaccccgcccccagtgaaggattttttaaaaaaatctcatcaggtcaacaacaggcactgcagcaaaatttttcagctctgacttctgcccagataacttgctctcccataatgccaagcagctctgctgtgaaggaacgaagcaagttttgtgcaaaacattgaacatgtttctgttctctgcctcctgctcaagagcattctgaagaagtggaaagatctgtcccacctttccctcttgccagccattcctatttatagtttctgatgctggtgggtctgaaggagtcaagagttttgaaatcacttccgttgctctgcggcatgttccctgcccctgcattggcttctcctaggccattagaaacttattatttctggttcccatgtggtaggggttggggtcaaagggagacagagaaagaaagatttgcagcatgcaaaagtgtgggttcttttttttaaaaaagcctcagaggaaaataaattgtggttgtatccccgtagtgttttctgtttaggtctgctcataactacgcctcccagtctgttcctggaaacctagagaaaaagttttaggttgacttcatccttgaatcctacttcacagagatgctgatgaatctgagggcaaagagagaaaggcaagaggagtttgttgcctggatgccagaagccagtaaagggttttgcaatgcatctccctattcctggcggcacatgataaattaccagcatcaatctatctaacagtatcagacttcagaacttctgtcctttcaatctttgctttcaaatatatgacaaaacgtacagataaagctgaaatcctctctatgctgcttgcaagcctcatgttcctgtctgcctccccaaagccaccaccaccaggaatttggaaaacatcctttgaccacaaatatgagcagccattgataacgtaagatattgctttgtgtgtctttaaacaattatatacatacctgacggtatcattcttcaacttaatttttccttctgcattatactttcttgaaggttttctttctatgttacttgctggcgtttaaaaatttttaatttttaaaacaatttccatctctttaattagcaggacaagatgattcataacgttaacaaatcaaagtaactgagagacatctagaatctcaacaccttacagaatgttatcagggaatgctactccctcgatgtctcagtttgggactccctaagataaggacttgtatgctcttagtctatcaggagaacccagaaagtaagagtgagggaagtggggcggtgggcagtggaagccaatataaatgtacattactgaaactgctactgagcttggacaacaagggacaacgtctgtcagtacctcacgaaaagtgcaccaaacgctgcccagaaacgctgccccaggaggcggggatggaaccttcatctgccagctcctcttccccattggttgaagatggcctcagggcactgacttccccacacttcagactatcccttccatgagccaggaaggcttcagaacaggtgctgaaggaaaacaggaaagaaacacagtgcacacttccctggggctcagtcacccacctagaactgttgggccatctgaacctggcctccagctaggaccattgaagctggacaacagctagtagcaggcctctgtcttccttacacatgaatctgacttgactatatggagtagtgctgccctgcttcctgaaattcaacgaatgatggggagagtaagttttccaattcccacgagctgtctcagttagaaaattccaaacaaggggtcgccatctttgaagtcacccatctcttacagccccaaacaaacacacacacaatatcaatgctatttacgccattcatctttccacattcttttctgtatgtagaataaaagagcagctgcccagcagcatgaaaaagtcaacacctttctgggtggcctataccagattacagttcaagggaatgagccacatgtatttctaaaattccagcgcatagtagatgctcagtaaatttacggtaaagtgttgactcctacttcatatctaaaaagtcagctttactttgcattactcttcaaaggatgagtccacaacctaaggtggtttcatacagtgttcaggtcccttatttatctcactccttcccatcccctgggcagtcacaggacagacgatgggtgtgttgtgagaaataaagggacccacagcataggctctacatagggcaaaaggcaacagtggggatttaatgtgaggtggagggggaacaaggagttggtaaggaagaggtcagtagctcaaagggtgagtgggagaaactaggaagtgttgtgggttgttgctgatgaaaactttccgtatcttcacaattgctaggagtctgctgtgattctctttatgtgcaaaactccattctttccagtcatctctctggaataatttctatattcagagccttcttgttacttgtcattgtcactcagattgcttaaacttacatgataatctattgtgttcagtccaactatgtcagcattgccaacattctgcagggcagagaacatgtcagctgacttcactgtggtgcccagcgtatttgcagttctcagtgaacccagttaactgcccattccctcaacccagatggcctttcttttgattaaacatatgaggcttccaatgccaaagggagacagaggatgatagttattttctggaagactccagccataatctcacttttgcctaagtgtgattttgtttaccttaattgcctttgtagctagagggagactttactctatagggccagaaaaagacctacgaaggttatttatcatcaggataacaggcttaattatctgttagaaatagagactagatccctctaccctttcatgctgtctctgggaagaaggtcgatttcccagggccttcccttttcatctcaccacctttcaccccttccccaattaaggcaaccaaaaataaaacactcatcggattctacaaatcaggagaggacccttaggagaaataacaatatgaggtgtcttttgcgtcccatccacaaataataccttttatgttattggttaggtatgatctgatgttagactttcaaaccatgagtcaagtaaacacaaaagtctgagacttgctaaactctaacaccctgttttctggctaccgttttttcccctcaatagtctcaatttttaggtaatatcctgtaactgcaaataggttttagaagactgatttgattttttttagttaatcaataaggttcaaatgtatttttgatttactaggctgcgaggcatacactgcatttatattagagctgagcattataggaagcaaggactgtcacttctaaaggatgccaccatccacacacttcctctgtgttttcccccttctggctacaagagcgttcatcattcctagttctttatgcttatataacatctcaacactttcttagtttcgatggaagacaccagaatatttttttcttaaagaactctgtgctatagatatgcatagatggcttttcaaaacaattaattagagatgtagcttattcttgtactccataccaaacatacaatgaaacactaccctaacaactgggtagggtaccaatttcaagattaaaagcattagccaggtgtgttttttcaaagattccatttttccaaacatcatgttcaagcaaaaggatcaagtgcattgatggttttctaattattaaaggaaattttttttttaatttaacaaccattactgttttgctgagtggttcctgttgatagatattatgccatgtctgtatgggtgataattaattttatgtgtcaacttggcagggccatggatgcccagatatttggtcaaacagtattctcagatgaggttaacatttaaaccagtgcactgagtgaaacagatagtccgccctaatgtgtgtgggcctcatgcaatcagttgaaggcctgaatagaacagaaggttagccctccctagagtaagagagaattccttctgcctcgctgccttttatctgagacactgggttttttcctgcctttggacttcagtgaaaatgtcagtgtttcctaggtctcaagcctgccagcctgcagactacaacttacaacattggctttcctaattctccagcttgctgacacaccctgcagatcttcggacttcccatttccataatcacatgtgccattttttaataataaacctttatagctgggtgtggtggctcatgcctgtaatcccagcactttgggaggccgaggcgggtgaatcacctgaggtcaggagtttgagacgagcccgggcaacatggcgaaactgtgtctctaccaaaaatacaaaaattagctgggcatggtggcatgcacttgtaatcccagctactcaggaggctgaggcaggagaatcacttgaacctgggagatggaggtttcaatgagccaagatcatgccacaacagttcagcctaggtgacacagcaagactccatctcaaaagtaaataaataaataaacctttatatagtaaatctgtgtgtgtgtgtatatatatgtatgtgtatatatacatataatgtgtgtgtgtgtgtgtgtgtatatatatatatatatatatatatatatatacacacacacatatacatatacatataatgtcctgttggttctgtatctctggagaatcctgaccaatccctaatacagcaggaatctaaaagtcaagtttgcaaaccaccattatgcccagtgtaccagttgggcttcatttaacatgtaagtccacatgcaattctactcattttctggattaatgaaggtgtggtgccagctggaccaagctgtactgactacatctctagagcttcaagtggcatcctctgcatagcaatattttgtgacttttcatagcgcattttttttttctttttttttttttctttttgagacggagtctcggagtcttgctttgtagcccaggctggagtgcagtggcgcgatctcggctcactgcaagctccacctcccgggttcacgtcattctcctgcctcagcctcccgagtaggtgggactacaggcgcccgccaccatgcccagctaattttttctgtgttttttttaagtagagacggggtttcaccgtgttagccaggatggtctcgatttcctgacctcgtgatccgcccacctcggcctcccgaagtgctgggattacaggcctgagccaccacgcctagcctcatagagcattttcataagcctgacatcatttcattttggccttcatttagaaataatgatgagtattaataagtgcttaaggcacaatgtctcttttctcatgagagccttgtcaaatgagtaagtgagcttctagaaagtttggtgcaaaatggaaatgtgcatataaatgcaaaagtggggggatatgggtgttctaagctctgtaaacttaggtacaacttcccaagctactgcttatctctggtaaggagttggagggaactctgaattttctggagagagctgttcaggaactatctgtcatagaagaattaaataagtcttgtttggaggaatactgaacaggagcatcctatctgttttctgctacttaatattttaaagcaagcccattctaccaatggttttgttagactttcatgttttttttttttcttttttgagacggaatcttgctctgtcacctaggctggagcgcagtggcacgatctcggctcactgcaacctccatctcctgggttcaaatgattctcctgcctcagcctcccaagtagctgggattacaggcatgcgccaccacgcccagctaatttttttgtgtttttagtagagacagggttacaccatattggccaggctggtctcgaattcctgaccttgtgatccacccaccttggcctcccaaagtgcagggattacaggtgtgagccactgcacccagccagctttcatgttattctaatcaacacacagtgccaggtggcagacactgtgtcactatgaggaatgcaaatcaaaccccagtaaaactcactccattttaaccaaaggcaattatgttcttttatataattggtctttatttggatcaaatgctactcaaggaggggaaaggaagtttaagtaagtcatcaaagagaatcagaaaattccacatctgcaaggcaccttacagatgatgtaagttcaagtaagtgaagacaaaggaagcctagcaagcttaaacatccactcccggcttatgaacctggatggcaccaagctagcagaacagcattacctacaagactgtagtggtcaggtcttgtccacttatgtgaggcctctgctggtaccagtaccctatttttcttctgtggaccctcaccctacctctactctcaatctgcattataccattagagctgacctaaactctagctcccggggaaagcatgtgacccaggaatggcaaatctgaatcttccaatccccagacaggcatcgggttggtgacaggtatgtgatccaagtcaggacaaccacagacaattctaagactttttcttacaactggacaaaaaatgcatctttccgattatggagctcctggtagcttatcacaatttggaaagcgcctgaacaataatgaagtaaacacagagagcagggccaacagatggagagaaagatttctgaaaacactgttgaagcctgttggggttgaaatgtgtccgcctccaaattcatatgttgaagccctaaccttctgttcctcagaatgtgaccttatttggaaatcggttccttgtagatgtaattagttaagatgaggtgcctagggtgggcccctcatccattatgactggtgtcctcataaaaaggggaaatttggacacagagacatgcatccaggaagagcaccatgtgaacatgaaggcagaacttggaggatgctgcatgtgagggaacaccaaaaattgccagcaaactaccagaacaaaaattgtcagcaaactaccagaagccaggaagagaagcaaaaacagattatccctcacagcttcaaaagaaaccaaccctggtgacacttgatctctggactctagaactttgagacaatatatttctgttgtttaaaccagccaggctgtggctatggcactttgctatgacagccccagcacactaatatacagccccgaccagtcttgcctgaaggaggcttaccctagaatttttagtttcctgaactgaaaatttatttttttctttctttctctctttctccctctttcttttccttttttttttttttttttttctttacaggtatcactctctggcccaggctggagtacaatggtgcaaacatggctcactgcagcctcagcctcctgggcccaagcaatccttccacctcagcctcttgaatagctgggacttcaggtgcatgacaccatacctggctaatttttgtattttttgtagagacagggttttgccgtgttgctcaggctggtcttgaacttctgggctcaagtgatcctcctgcctccaccttctaaagtgctaagattacaggtgtgaactgctgtgcctgacatttttttaaaacttaatccaatttgattgagtttctagcatttgctacataagattcctcacaaatactccattaacctacaagcatcagaggaggggagcgcaggatgttgatggaataagactgtgtcacctaggaaaggttgagggagctgggaatatttaaccagcaaaaagacaactttacaggaaagggggtaaggaagagtagcaccatcttcacataagctccatgagagaagggatgtcttctgtgtgattcctttctgtatttccagttcctggcacatagtaagctgctctacaaacatttaaagaacaattgaaatgaacatctcagggccgggtgcagtggctcacgcctgtaatcccagcactttgggaggctaaggcaggcagctcacttgaggccaggagtttgagaccagcctgagcaacatggtgaaaccccatctctactaaaaatacagaaagtagccaggcatggtgatgtgtgcctgtagtcccagctacttgggaggctgaggcatgagaaatacttaagcctgagaggccgaggttgcagtgagcaaagattgcaccactgcaccacatcctgggtgatagagcaagactctgctcaaaaaaaaagaaaagaaaaatctcagggtccttcattgcaagcaatagaacatgtttaagagaacaaaaaaagtaggggaaggtttattaaaaggttattgttgaagagaccaaataactgctagggatggctggagaacccgactagaacgagcagccagcatcataaccaaaatcatgccacaaaaccagatgtgaggactccactcacatttgtcactgttaccaaggactaagagaaattttttacaaaaacattgcattccaatctcagtttacccatgctacattctggtccacaaatgtaaaatattcataatgtcttcagggattagaccatgttggggatagctctgctgccaactcttctaacacaaagtaatgttttcaatgaaacaataatcacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaacaataatcacatctattaaatgtttgctgtgtgctgggcttcaggcactacatgtgtccggcactatgtgtgtcaggcactgtgggattatagatggatggaatagcagagttctgcagggatatttaacaggtgtgtgtctttagttaagtgactgaactcctcagtacctcagtttctcaatttataaaatggcaatgattcttagatgacatacctcatacattcttaggaggattgtattaaaattgagttagtatatataaagtagctacaacagtgcttggcatatagtaccatgcgctcttcatcacaattctataagtgtggtgtgacattttatgatgctgaaactaaggtccagtgagcattagtgtcctgtgcatagtaacacaaagtggttggtcctagattcaaatagaaatctatctgattccatactctgaaatcttaggcatctacaggattgacattagaagcaaattatgttgaagtgcctcagtcatacctgaggtgtaaagccgtgcacagttttggacaacagagaaattagcacaattttcaaaatatatttcctgctccatttttgcatatcttacacaaactgcttagatacctaagtagtttcaagtatttctttaatagattattagtaaaaccacaaaggcaatacaagtgcttaatttggaacttgcttagaacctgaatgcagggtgcccgagcttgcaaagcaaaaatactggttgcccaagtgtgtgattttatggagcagaatcgggttagagtcagtctagattagcagcaagtcagcctcagccagtgccacccatcccactggaagtatgaggaaaattattgctcttctccccagaaaaatatacatataatttcagagggttcatggacatgtaaagatatctgtaaattccaagtgaatatcccctcttcttgattagtgactctaaaatagttttttaaatctgcaatcattttttgattcagcatcacaccatagttcctcctaatgttcagtaaaaaactaatatctgcatgctagtatgtgaagttgcatagaagccagattttttcatccaacaaatatttatcgagtgcctagtatacatttgacattgtttctaggcactggtgacatagatatgaacaagataaaccaggcccttgtcatggagctgaaattctaagggcgaaacctacaataaacatgaaaaagcaacatacgaaataaaacagggtaaggtaaccaagaatggctggtggctattttagatggggtgggacaaggaaggcatccctggagagtcagctgagctgatacctaagtgaggggacggagtcaacagtgtgaagcactcagaaacggcacttcaaggcagaggaaatggcaagtgcaaagccctaacaggtaagggattggtctaactgagaaaccgaggcaggaccagtgtagtaaattaatactgaatttaaggcttcagtaaatctaatactgcactaagttcagtttctggatatttaatttgagcaagtactaataactacttagtaagtacttaatagatttttaagaacactctggtcctgcataataatgaaaatctaggaagccaaaagatgtcaagaaagaacgaggattttcttttcttttagacacagggtcttgctctgtcacccaggatggatagcagtaatgcgatcatagctcactgcagcctcgaacacctgggctcaagtaatcttcctgcctcagcctcccaagtagttgggactacaggcacacaccaccatgccaagctaatttttaaaaaatgttttgtatagaccaggtcttgctatgttgctcaatcgggtcttgaactcctaggctcaagccatcctccctccttggccttccaaagggctgggattacaggcgtgagccaccatatctggccattttttcaattatcaaataccctatcaggaaaacctgcatggctatcgatcaatttttaagaaattgctgaactaaattcttccttgggggacagccccaaactacctctatgagctggaagcttacatgcacccatcttttagatcctgcctcagtccctgcttttacttaaagcagtaaatcttcaacatctctaaattatattccaaacacaagcttatttttggaagaaagacaaagtctcatgtttctagtaggcatatttcaagtttggggaaaaaaataaaagtaattacagttctgaccataagtcaaaactccaagactttctaaaaatgccttacaaaggcaagactttctaaagaaccaaaaaagaaggaaaacattaatttaaaaactgcaaaagtttttatcctgcctcagaatttcaggaatgctgctataatggattcatcttagtgcagatgaagtcgaggacagcaatagagttttctatcacccgcaacagcagccatttcactgccatttaacaaaacatcaccaaagtagtggttccctgaagattcttcctataaagtaatgtaaaaagctggtggcattcaactttgagtagatatatatgtgtgtgtgtgtgtgtatatatatatatatacacacacacatatatatatatatattttttttgagactgagttttgctcttgttgcccagtctggagtgcgatggcacgatcttagctcactgcaacctctctctcccgggttcaagctattttcctgcctcggcctcatgagtagctgggattacaggcatgtgccaccatgcctggctaattttgtatttttagtagagacgggctttctccatgttggtcaggctggcctcgaactcccaacctcaggtgatccgcccgcctcggcctcccaaagtgctgggattacaggcatgagccactgcacccagccagagtagctatatatttttaacccatattgaaataacacagagatctttccgtttattatctagtttattgagaaatttactagatgaaatgcattagcttaatgtcaagggaaagaaaatggaaggttttccccatcatcagggcattaagcctgcaggacagaattgaatgaaataatatttattaagcacttagagacatgttgaaagattaaagtgttagctcccagagaacattactgcatcttttgtgtagggctttcaaaaattttattttacttggcccttataataactattatagttatcatattagtctttgtggttgtaagtcaaagaagcatgtcttaaacctgcataagcataaaagggaatttattggcttatataaagtgtgatgcattcaggtctggctagatccagaagccaaactacctctcttactattctctctcattctctattgttcctttccctatgtcttggcttcattttttctgttaaatttaacatgttagtgtcattttctcctgttgcagattatttcccacaggcagctaaagcttacatcatccttgcagattgcaagtccagatgaagtggacgtcagatcgtgtggaaagtctaagtggccctactttggccatgtaccctttcctcgaaccaatctctatgaacaatggaaccctttaccatctgtattagtccattttcacactggtgataaatggactaatacccgagcctgagtaatttataaggaaaaagagatttaatggagtcacagctccacgtggctggggaggcctcacaatcatggtggaaggtgaaaggcacatctcacatggtggcagacaagagaagagaacctgtgtagggaaactcacctttataaaaccatcagatctcgtgagacttattcaatatcatgagaacagcacaggaaatacccgcccccatgattcaattacctcccacaactgggtccctcccacaacacgtgggaattgtgggagctaccattcaagatgagttttgggtggagatagagccaaactatatcatcattgacgaggctcatgtctgtggccattccagtggccaggcactggatatgattgacagtccaaccacagccatatggaattagggttgggggtactcactcagcaatggaaaagggagtgctaagctgacaaaagctacaaatagacagtgccaatatggttagccctattttgcagatgaagaaactttaatggtgaacttaaccaaattaaaaattatctgttaatgcctcaaatctctacccgaagattaagccttccattccaaaagacagataaggtgtaaattgtacagtaacacaatgaattaaattcacatcgaagtaaaactatctgttacaagatccttctctgagagtctgtcttatttaggggacaaatacagtgtctaactaaaggaggaaaaagaaatgcagcaaggagagttgtttgagtctttgtcattctttctctaggctgcaaactttctgaaggaaaaatctgctacttcctcttctttatctcctgcagggcttggcaaatgatagcacacagcaataaagggagccaaataaaaagaaataaattagcaccctttgcttgtcttcttttcctagtaaactgatgtcagatcagtatgtcaccttcaattctatgttcatctgatagataggactgaccttccacgttggcagaaactgaaggcgtttgatagagatttgagagcagagcaaataagccagaatcaagaatttacagaatatcaaagctgag

SEQ ID NO: 2221 - DNA, 5301 bp, Homo sapiens
ctttgctctgtctctctctctcttgcttcctttggttctggcctcataaacaccccaagggtaaaacacacacagtgtaagattcacacaaggctaatccctgtcctctttccgggggaatgcacttctatctttgtcatggtctttgttcacccctaaaaatcctcattcatacatgaaggacaatttcatgatacttttctgaggctgaactttacatcaaagtgggtgattaattactgataagggtataataaaacattaatgcattttgtaattaaccagcttaggaatgacatctcccatcgcttcatgagtgacatgttcacacacacacacatacacacacagaactttttttaaaaaattctttatttggctattaatctcagcagtgccctcaatacattacattctttttaaaagccacatatattttcctcaatgaaatatctaatccatcttgagtgtaaggaaagcccatacataattattccgtcgtgacagacagtgagctttctcgctattatttttgatggtgctgtcatggatgccaaatgtatgttgtggtgggagccagccagagtcgggaacccacctggagagcggctcctttcttctctcaggaaaggttccccacgcctgacagccccaccattctggttaagcttaattagtcaagagagaaaaagaactgacttcggagtgttgtgttacgtttggggctcccccctttttttcccctttccactcaaaatttgacattctttggagaagatgaagttccaagtgggatctgtgttggcacttcccaccctctcgtcatcctcacgtgggacccgcttctcacggcccatcttttgtctaccaggggcctcgcaggactctgcacagcccgcacaaaggacgtaggattctgcactggcagaactggatgtaatgttgccctgagaaacattcatttatttcagagtgaaacccgttaaaatggaagtgtgtaggatttgggttggctggatgcaagcttccctctgcagcgggatgaggctgccactaccaggagcacgctggcctgccggcgggaggaacagatgccagaggagacctgactgtgtcctcaaggccatgccccatcagccatcccagcagagcccacagccacccacagaggaatgaggatccccatccaggatcaccggaactgcacaactgactcacaaacgtgtgaagagtaatgggtaacgtgttgaactgtgagcctttgagcctggggaggtttgtgatgcagcagtagctcccagacccttgaggctcttcggcacgaaggtgctgagccatgcacctatgcaaagccaaactctgcactaggcctactggggtgtgcagagagagagggctgaacaaactgcggttccacccagaagacccagaagaacatttacggaggagtcagtgcaagaggcgagagagcatgcgtgaagaggctcgttcttgtggtgtagaaaaggaggccagagtctcccagaccacgattcttttcctttaggtgtttcttgggcattttcaatcttaaatctcttcccatgttattgagatttctgattgaatgtccccattttccctcagacagcaggccgtgtgtgagtcaccacctccatctttctatgtcctgggtgtgggcccagtgaaggacagttatggaaatttagagagaagaggtcgcaggtgtggtgggggtggtgaagcttcagaagagaaaagaagcatggtggagagggtggactctggaggctactgcagagctctcccccaggctatgagggggcatgatggtcccaatagcctgagtctgtgttcatttcaactggctaccttgtgacgaggaagatggcccaggttcccagtgggaaatctatggttatcattaagaacgcagggcctgagatgaaacctggcaggtgaaaggcacctggttttatgcaacctggttttgcagaagcctgtgggagggggcccaggggggaagggagcagagggcagtgttggctctggttcccccaccaggcaggtgggctagcacctgggtaaggggctttgcatctggagctggtcatgcctcagtccagatcctgcctttatcagttgatgggctgttacctgccagtggttatggtgaggactaaattacggaaagtcatcaaggatcttcattcattgcccaccacagagcaggcactcaatggagaacactcaccaccatctatgttgttaatgttgcatctgcagcccttggtttcctggaaagactctacagtacaggggcaggttaggggccacaaccaggaaacaagacacatctgagagaatgcatgggagcttatggaaggatgtacaaggctgggtgtgggaatcccggcacttcgggaggctaaggtggaaggatcacttgcatccaggattcaagcctagcctggccacgtagtgagaccccagctctacaaaaaatcaaaaatcaactgggcatggtggcatgtgcctctaatccaagctactcaggaagcagagatgggaggatcgcttgagcccaggaggttgaggctgcagtgagctgagatcataccactgcactcattctgggcaacagagtgaaaccctgtctcaaaaatataaataaataaataaataaataaataaataaagaaagaaagaaagaaagaaagaatttacaagaggggagttttagtggttgaaaaatcattcactcattccaggagcaagagccttgtgggttttcttcctgttcttgcctgggttatctctactgaaccaaagaatccttgttaggaatgctctggtggtgtcaatcaatgcgtttataaatcatttgcttttaccatggaaaaagatatcacaaaacaacacagctgtagtgcaggtgcagatgaccatggaacggcagcctggcgttttcagtagagcactgggcagcagagtccctgggcctcggaaccccggcctgttaccacccaacaccatccctgggcaaaatgcgaaactcccatcagatccatgaatggaaaatgggcgtaattataattgcaccccactctctacctctcagctaaggtgagaaatgaatatgaggatgctcagtgaaaatgctttgaagtctgtgaaatgcgaagcaaatgtgaagcgagaggaataataaggttctaaggacccacacttgggcgtttgctctgagctggcccctgtcctccacactgaacctacagcctctcctctcacctaatctgcacaaaaatcttacgaagcagacacacttaccatgctggcctttccgtgaaatttcaggtcttagtgtcgcccattactggtggcatttcatgccacaagttgggccatctgcacctccaagcacagggtcacagaagactttatcccgtcccttgggctgactgaatggttggtttgtgtcaacccctgttgtccctttgagcaactcgggggcaatggttatgggtagggcttaaaaaaccgtctggctgcaaacccagtgctgatacgaacaaggcctagtcaggcactaagtgttttgtgttccccaaagagatcttaatgaaatcccagcatgccactcactcctacacttaaaataccttttaagtgtaggaaagaaagtgctttcaaccccaccccagccatttggattcggagactccatttaagatgcacagctttcctccagcacaggggctgggtatccaaacgcagagcctcccccagactctctctaggcttagcctggcttggtgggctcaggagggattcaagattatttcatcctttatgtccattcgatgacagtttatcatcattgccacctcatactctattgtagccaaacatcataaccagcaccatgtgaactacgtcactgacgccacattctttttctcggctgtcactaggctcaggtcaggacagccctcccggctgacttccgcgatactttctgtatctccttttcagtctgccctaaaatgacagctggacttccgacagtggtttcttatgtgggacacatggctcttatactctgggtggcacggattcctttattgccagtggcttaattttcccagatctatttccatgcagacagtgtgaggttggacttcatgcctcatgctcctgattggggctcggaagtctaacccagcttcctgcagtgccgcccccagcttattcaatgcccaacctgcaggtcctaagttgaacccgcacactgcacgctcacctggtctgtgctgccagctgcattggaaatggaagcattaaacaccgttctccactgtcagccacctgctagctaatgagtgacatcatttaacactgttttgaaaagagagatttaaagttgttttgaaaactgaaggaaaaatacaaatgtttgagtgttaaacattttgcccaaatactaaaatgtgaatgtctttttattgtgacagttcacaggaaagcgggctatagcatgcctgtgcttgtcaatgaaaatcttagcactgagtttggtaaacattctggcagtcgggaagccacttaaaaataaagtttaaagaaaagaaagagaagtgttcactttccttctaattttcccagatacgctcaatattctgctttattttttagtattttaactaaaataagaaaactcggattctacctctatgtgtcctatgattgttgttgttttctctgattataaaatacaggtttgcagcagaaaacttggcaaaacagagatatgaagaataaaataaaaatcacctgtagttctaagccatgagaataatcatatatatattccctaggtattctgaagcatatgtattacagtccaaatatttaaaaacaaaatttgggtaatactttagatagagagttgtattctgattttttctattaatattataactttgaaacgagggacttcaccattgcttttatttttctttgctatgtaagtacttatgttctttatgaggaaaataaaaactatagaaaagaaagataagaaaataaaatcagtaataatcccctcacttacaaatgactgctgttaacattttagttttttggtttctatctatttatgtgaaatttgaatgaaaatagtataatttcgctgtctctatattgcttggtaacataatgatttaactgtataataaatagtatattacatgaatattttgagtaatagtctgtgtgataatttttattcggtgtgtggtg

SEQ ID NO: 2222 - DNA, 2185 bp, Homo sapiens
tgacagagcaagaccgtctcaacaagaaacaaagaagacagaggagctcagggctcagggaagagcatgcaggggcaccaggccagcacccattaggaagctcatccagaagaaggcttgaggtcccgggggacccagagggctagggcttggcggaagaggtcccctgcaaagggaaggcaggacagagcgggaggatgagccaggctttgcagggtctgcccacacccccgtgcccactcctctctctcctgcagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggggcgtcaggcagggaattctggtgacttcaggggcaaagaagtgggcaccgggtgggtctcccaactccactgcatcctcctggctgcgaccttggaccaagtgacaacctcccagaacttagttcctcacttggtgcccacctctcagagaagacatcgcacacacggccgggcacggtggctcacgcctgtaatcccggcactttgggaggccgaggcaggcagatcacctgaggtcacgagttcgagaccagcctggccaacatggtgaaacttcatctctactaaaaacacaaaaaattagccaggcatggtggtgggtgcctgtagtcccagttagttgggaggctgaggcaggagaatcatttgaaccctgaaggcggaggttgcggtgagttaagatcacatgcactcaaccctgggtgacagagcgagactccgtctcaataaataaataaaaaaacagacattgcacacaaagcctcagcccagcaggcactcggtcaatgctggaaacagacaggaggcagggacgttgggaaatgtaacagtggctgagacgcgctgaggagccaccgcaggccagtgagatggtgcggcgctaagcgctcacacgtgcaccatctcttagcacccaaagccacagagcagttaagccacctgcccaaggccacatcttgaagtaaggggaggaggagatggaatccccagtggtcagacatcagacatcaaagcctaggctgggtctactgcttgggaagcacgatggacccccagagggccttgaaggctgcccaaagtccccatctgggagacccaggccgtcatctcagcgagcaggctggagggtggaaaccacagtgaacctgggtggtcaagagtcagccccagaggcaggtgcaggagtttgagccaaatgtgcagagccccacgtcattcattcaaccagtatccactgggcccctgctacgggcaagtcctgctctaggtgctgggaacaccaacataaagaacagcaaacccctgaccccttagaacttgcattctggtaggagagagaaaacagatagggctggacacagcggtcatgcctataaatcccagcacttcgggaggctgaggcgggaggatcctttgagcctctgagtttgaggccagcctgggcaacatagcaagacctctctctctacaaaaactttttttttttttttttgagacagagtatcactgtcactcaggctggagtgcagtggcgccatctcggctcactgcaacctccacctcctgggttcaagcgattctcgtgcctcagccttccaagtagctgggattacaggcacacgccaccatgtccagcctctataaaaacatttaaaattagccaggcatggtggtggatgccctagagtcccactgacttgggaggctgaggtgggaagatcacttgagcctgggaggtcaaggttgcaatgagccatggttgctgcagtgagctgtggtcgtgccactgcactcaagcctgggcaacagagcaagaccccatctcaaaaaaaaaatttaaaaa

SEQ ID NO: 2223 - DNA, 507 bp, Homo sapiens
ttaagccagcagtacaaaaagaaaagaaaagaagctatagcaaaagctccactaactgacctgtggaaagagagtcacaagcatgggcgaagtatctcccttagggagaacaagaatttgttctctgtcttgtgtctcaccaacaaaatccagcatctgatagacaaagagtcacagtgcataaaagaaatgtccgcctgagtgccgtaatcaccatgtcatcccgtcctcctctggccatcagcctaggcagctggaaaggtgacttcctgaccagaatgaaagaatcctagcagccacgaggagctgagccttgtggggtatctcaggaccaggcatgggtgacagtgatgctggcttctgacagggaagatcaccctagccagcaatggaactaactgggtcgtgggaccaggaagcatccctctttccttgtctgtgattagtggttcacattggatctcacagcctccttgggaggcagacagtgcctctagcatcatctcc

SEQ ID NO: 2224 - DNA, 25505 bp, Homo sapiens
aaagaatatatatataaatatatataaaagaatatatatttatatataaatatatataaaagaatatatatttatatataaatatatataaaagaatatatataaatatatgtaaaagaatatatatttatatatataaatatatatataagataaaatatatatatatttttccattttgaacgtattgggttttttccatgctgtttcctactctcctcttttgcacccctcccatttccttcgtttttcttcgaaaatttcttccccctccagttcgctgtccggccctcacatgtgcgagaggggcagtgtgtcgttaatggccgtggcgggcaccgggctgctcctgtagtgctgggacatgtgaagttggctggggcggcgtgttccggcacctcggcgcgggtaaggtacgtgctgatcaggtcccggaggtccccggcctggcagggcgccctggagtgggaggaagaggtaaccacagcggggctggagtagggtgccctactgcgagtaggacgtgctgtaggtgggcgagcagttctcgcaggtctgcgaactggtcatggagttgtactgcagggcgcccacgtcatagcggtgtatgggctgcatctgcgcggcaccgttggcgtggaggcccgggtgctgtgcgtagcccagctggtcctgcatcatgctgtagctgccattgctccagccgttcaggtgcttgtaactgtccatgcgctggttcacgcccacgcccagaccggcgcccaccccgaccctgttgagccaacttttaagttgccacatgacacatcttgtccatcagacctatatcacatgatcacactgagctgaaagagaaactttaaatgtcttcattctgtatgtccagttgtataccaaaaactggaagaagggaaggacatcttgggggacaactggctctcttatgacaatccaccgctttgaataccaagttttcatgcctcatttttttttccccagtgtggaagatacccatccacaagagagtgggctcaaagtgactgcatttacttctaaatgtgccatactctctataaggtcttaaattagctccttgttatacttcataaatgaaaagagtatcttcccctacgtacccagagtgtagtaacaatttcaattcagaaagggaaagaggccgggcgtggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgggattgcgccactgcactccagcctgggcgacagcgagactccgtctcaacaaaaaaaaaaaaaaaagaaagggaaagaatgggcaacacaactctcactagttcctaccagttatcaaatccaccgccactatcccccagcagaaaagcgggataaaatacgggactcatctatttgaaggcagtagaaatctgtccaagcaggactctaaaaaggagtgaacatttctgaggtgagctgacctgtggctgcttttagtttgggggcacttgtccattctggttgcagaccggaggctggtaattttgattttgtatttttttaaagcttgcctccagaggacagcaaccaagaaagcttttggtagagatatggaacagccttaaacatgggcaatttccactcagaaaatttgcaaagttgtggtgctgtttaggagagaaaacaaaagtaggcagaaagcttcataaaacaaagattaaaaatcaggacttgccagaaggaggggatctggagaatatcctaggtgaccattagaaaactctgaggctaggggcacgtcaaatgtagaatgagccttatgccaagatttgtaactctgccttgatttatcatgattcttggttggattaagttctagcagaagacaggttgcctcactgaagaaagacatcacccaaagccagtaacattaaaacatctggaaaccaatggaaaattacaagaaatgccaaaaccacatggaccacgtgaccaaaaactaagagaaaaaaaagtgacatgagaaaccaagccacagacaattcacatattggagttcactggcaagaactctaagataactatgactaatgtgtttgagacaattatggataagataataggcaaagactttgatcagaaaagtaatctataaaaatcaaatggatattctagaactgaatacagtgtctggagttgagaacacagtaggtggatgtaatagtggatttgtgtaacaaaagacaagattagtgaactacaagacaggtcagtagaaaaaaatacatactgaagcatgtattggaggcatgtaaacacaatgaaaagcctttagaaagataattggagtcttggaatagaatggggccaaagtaacatttgaccaagctcagaaaactaaagcaggacaaagaaaaatagaatcacacttaggcacatcaaagtaaaccaactaaaaagtaaagacagaaaacatcttaaagacagccatctcccacagaaacaatggaaaccaaaaagactagaataatacttttaaagtgcttacagaaagtagctgctgatctagaaattcataccctgcaaaaaatatccttcaaaaatgaaggtgaaatggggctgggtgcagtggctcacgcctgtaatcccagcaccatgcccggctaattcttttgatttttagtagaaatgaggtctcactgtgttgcccaggttggtcttgaattcctgagcaaaaaagattctcctgcctcagcgtcccaaattgctgagatgacagctgtgagccactgtgcccattttgtttttggtttgtttgttttttaatttggctcttttagttgattttcatgggagcattgatctagagcaagttagtacatcagtagtttccaacctcgagatgattgtgtcccctccccaggggacctttggcaatatctggagacatttttgactgtcatagattggggtcagtgaggatactactggcatctagtgagtcaagactagggatgctggttaacatctgtaacaggatagccctctgtaacaaagaattatctttccccaaatgtcattagtatcaagattgagacatcctgcattataaagttttgattttagtatttttttaaaaagctctctgatttcagatatttttctgattttacatttaaaagaccttaaatggcacacaaacggtataaattcaagttgatgaacattgagttcaatgtgagttaactgaagagaatagccattggattcttatgtcacccctatttatctctctagagatatatggaggataacttggtggacaaaatacagttagaagctgagaatattggtctcaatttcagctgagaatttgagatgaaacatgtatgcttggaagtcatttatacacagctgttagttgaagctattgtaatgtataagtcttctcatttgtaaagcacaagagagcagggccaaggacagaactcttaagggcaggggaaggagggaagaccattggtgtttaaggactccattcctccatatgatcaactcaatagatgcaaaaaataaattgacaaaatgtaacacaataatcaaacatccatacatgatagaaacttccagcaaactagaactagaaacgaacgttcacatcctaataaagtgcatctgtgaaaacttacagcaagcatcatacttaaagtgaaagactgaaatgctttctctctaagatcagaaacaaggtgagggtgtatgctcttaccacttctagccagtgtaataaggctaaataaataaatgagtaatatccagattagaaaggaagagatgtcttaatttgcagatgacacaattatctatgtagaaaatcctaattaatctaccaaaaagctaccagtaccaatacatgtttctcaaggtggcagaatataagatcaatttgccaaaatcagttgtatttttatatagaagcagtgagcaatcagaaattgcaatttaaaaataatgtaaaaaataataaatatttaaggataacctgccaaaagacatgtgagacctgttcgctgaaaactagtaaacactgctgggataaataaaatctaaataaatagacatattgtatttatatattagaagattcaacattgttaagatataatttattctcaaattcaactatatatattcaatacgatttcaatagaaatcctagcaggcttttaaaagaaattaccaaatttatatgaaaatgtaaagaacctagaatagccaaaacaatactgaaaaaagagctaaatggaggatttacactatctgatttcaagatctattaaaaagctacagtaatcacagtataaagaaaggtaaacagagacaaatggaacaaaatttgtccagaaatagacctacagaattgattttcaacaaaggtgccagggcaattcaatgggaaaatgataatattaacaataaatggtgatggagcaaatggatatccatataaacaaatagtgaaaacaaagaacaataacaaaaaacaaatgaacttcaatccttatttcacaccagcattcaaaaagtacttcaagataaatcatagtcctaaatataagaggtaacgtataaaacttcttgaagaaaacgtaggagaaaatctcagtgaccttggcttggcacgtgtttcttaaactggacacaaaaagcaagaattattaaagaaaaataaaatggatatcatcaaaataaaaaatgtttgcctttccaaagataccgttatgaaaatgaaaatataaactacaaaatgggaaaaatagttggaaaacatatatccaagaagggacttctacctagaatacataaaactccaataataacaacaaataattataataataaatgtaataatataaaaagtatacagatgatttgaaaagtcacttaaataagatatatgaatggcaaattagtatatgaaaatatgctcaacataaatagtaatgaaaatatgaattaaaaccatacccactagaatggctaaaactgaatagctaaaattgaaaaaaccgataccaagaattgacaaagatttgggacaactggaacgtatactgatggtaggggatgtaaaatggtacaaccactttggaaaacaggttaccagtttcataaaaagttaaacatacacttatgactgagccattccacttcaaggtatttatgcaaggtatatttcataataccttgaaatgaaaagaatgtatatgtccacacgaagacttgtgcactaaagttcatagcaactttattgccccctaatagactacaaaacctaaatgtccatcaacaggaatatggataaacaaatcatggtctatctatacaacataatacaagttagcagtagaaataaactgttgatacacacacaacttggatggatctaaaactaattctgctgacagaaaccagacaaaaagagtacacattgtatggttccatgtatataaaattctagaaaatgcaaactagtctatagtgatagaaaacatatctggttgtctcaggatggtgaaagggcaaggagggcataaaggcagggattataaaggggccataaggaaagtcttgggggtgaggaatgcatttattatctttttttttttttttttttgagatggagtcttgctctgttgcccaggctggagtacagtggtctgatctcggctcactgcaacctccacctcctgggttctagcaattctcctgcctcagcctcctgagtagctgggactacaggcgtgcaccaccatgcctggctaattttttgtattttagtagagacagggtttcactgtgttgcccaggctgatctcgaactcctgagctcagccaatccacctgccttggcctcccaaactgctaggattacaggcatgagccactgtgtctggcctccccgcatttattatcttgattgtgataacaggttcacaggtgtttacctatgccagaacttgccaaattttagcagtttaaatttttgcaattaaaccatataaaaaatacccctaaaaaagaaaaaaatgggaaaacattaaaaatcgttactgctataagatcaccacgcatcctctgggtaggaaataatttctaactcttctttatccccaaatcactttttactttcattatagtacttatcagatgtctcagttatccattatcccaaaacttagtggctgaaaacagtaatttgctatttctcacatttttggggtcagctgggcaatttctctgctggtctagcctgagctcactcagggggctgcagccagctggtgagttcgcagaagctggagggtttaacatggctttggcatagatggcttgaaggcggcgactctcactacatggtctttcatcattttgtagtctaactgaatattttttttcagtgtccataaatcaagttttattggaatacagccacatccatttatttacttttttagtgagatatgattgtcagacaaataaagctatatatattcaacgtatacatcttgatgcattggaggataagtatacacctgtgaaaccatcaccatattcagtgccctaaacttaaccatcacctcttaggggactcctgtattagggtcctctgtaggggcaaaacttacaggatatatgtatatatgaaaggaagtttattaaggagaattgactcacatgatcacaaggtgaagtcccacgataggccattttgcaaattgaggacgaaggaagccagcagtggcagtctgagtcccaaaacctcaaaagtagggaagctgacagtgcagcctccagtctgtggctgaaggcccgagaggccctggcaaaccactgttgtaagtccaagaatccaaaggctgaggaacttggagtctgatgttcaggggcaggaagcatccagcatgggagagagatgaagactggaagactcagcaagtcagcttgctccaccttcttctgcctgctttttctagctgcactggcagccaattggatggtgcccactcacattgtgggtgggtcttcctgagggtgggtcttcccctcccagtccactaactcaaatgttagtctgttctggcaacacccagcaacaaccagatacacccagaaacaatactttgcatccttcaacccaatcaagatgacaatgttaaccatcacaccttgtacactattggtgggaatgtaaattggtacagtcactatggaaaacagtatggtagttcctcaaaagattaaaaatagaactaccaaatcatccaacaaacctgctactgggtatatacccaaaaaaaattgaaatcaggatttcaaagagatgtctgcattctcgtgttcattgtcccattattcacaatagcaaagacatagaaagaacctaaatgtccagatgaatggataaagaaaatgtacatacaatgaaatactatttagctttaaacgagatgagaatcctgccatttgctacgtcatggatgaatgtggaagacatgctaaatgaaataagccaggccaagtgcggtggctcatgcctgtaatcccagcacttcgggaggccgaggcaggatcacttgaggtcaggagttcgagaccagcctggccaacatggtgaagccccgcctttactaaaaatacaaaaaagtagctgggcatggtggcgggtgcctgaaatcccagttacttgggaggctgaggcaggagaattgcttgaacccgggaggcagaggttgcagtgagccgagattgcaccactgcactccagcctgggcaacagagtgagactctgtctccaaagtgggggaaataaaagtcaaacacggaagaactactcaattattccatttaggaatctaaaataatcaaactcgtagaagcagaagcagagacttgaatggtgattaccaaggtttgggggagggtgaatcagagagatgttgatccaagggtacatagtttcacttatgcaaggtgaataaatcctagagatctactgtacaacatcgtgcatatagttaacaacactgtattgtgtacttaactgaatcttcatgtggcagtcgggtacctaatgaataaatgcagaagccatgaggtctcatgggttgcccgggtcctagatattgcactgtcactcctgccacctttgaccctttatcaaaacaagttttaaaaaacagcccaaattcaaggggatggagaaattgatgccacctttctgatgtgagaaatgactatgccatattgtaaagggacatggacacggagatcattaatataatgatttgcccttccaggttatgccttataggcatttttggtacctgtatcccttctattaaatcataagttccttgaaggcagaaattagatcttatttacctttgtatttccctttgcaacgatcacagatgttgcacgctatgcaataagtgttgaatttttccggatgacaagacaagtaaaaggtaagggcaaaaaaaaaaaaaaaaacaaaacaaaacagggttgaagacgaagacgcatcgttgtagaggtaggggagaaaagatatattccaaataatttaaaatcatgatctccaaagcaggcaaaagcaaagggcaaatattgatgagccatcagagtatcttttttttttttttgagatgtagtctcactctgttgcccaggctggagtgcagtggcgtgctcttggctcactgcaacctccgcctcccgggttcaagcgattctcctgcctcagcctcccaggtatctgggactacaggcacacaccaccgtgcccagctaattttgtatttttagtagagatggggtttcaacatgttggccaggctggtctcaaactcctgacctcaagtgatttgcccgcctctgcctcccaaagtgctgggattacaggcgtgagccactgcgcccagcccagaatatcttaataataacatttttatagccaaataggtaaaggcaacagataagaagagttgagtagctgcttaagtagctagagctttatttaaatacagctcttttgattccaaattttaggctttttttccccttcttcaaattttgcaactctggggtggtattatgttaggcaattgaagggaggggtggataatttaggggttttaaattcacagagtaaacattctggtggttggtaccatgcttttagtatttatatttcccagtgtatgaaataaaagattttagagggacaatgctgaagatgcctaaaataaactttccttatttatttctaggcctttctaagcagttagattccaagagacaaagtatgttgtagagctgttctgtttagtcttttcctgaaattgcagccagtgttttgcctatctgctattaacacattaccctttgcctgccatctcatatttggcatattttataaacaggctgaaagctctaagctgaatcctggctatatcaggttttgtaattatatcttcctgcaatattcttcccactcagacagctaataaatagtttaactgactgagattcagcctttctctttgtctctgcaaaatttagaaattcaaaatgcaattcaaaataagtattttcttcatgtactttccccatgatgtatttggtgtccaacaatgaaccaaattatgaggaaggtgagtcaacagaatcatgagatccaattctttctcttgagactcttatggtatcggagagatttgcagtctatttattttttattttatttatttatttattttttggaataagatctcgctcttgtcaccaaggctggagtgtagtgacacgatcactgccacctccgcttcctgggttcaagcgattctcctgaatcagcctccccggtagctgggattacaggcgactgccaccacgcctgctaattttttgtatttttagtagaaacagggtttcaccatgttggccaggctggttttgaactcctcacctcaagtggtccgtctgcctcagcctcccaaagtgctgggattgcaggcatgagccaccgcccggccagatttgcagtcttttgggtattctgcaagctccaggattctgggattctgagtgacccacaaagttcacagtgttgctgccaagttctagtaaagcattatgttatacttttttgtttttacataattcaacgtattgggcaataagtcactttgctagtattcatattagttaatctttactctgcagtaagacttaatgtaaatgcaaccttttaaaataaaaacgttgaattattccagttgaggaaaagtgcaagtagcaatcttagagggcaagacatcagttcggtttaaattagtgaattaaattctccatgatttcgtggctccctgtggataccatgaacactctgttttacctcagttgtgccatgcctcaacattgagctcctagaatgcaaaggctatttctaattcatttgttgtgtctttggtatttgtcataatacaatactatagattattcctctttctatgtggttttaaaaattaggatcattatcaattttgaacttctgaagtcttgatgagagagttgtaaactcattaaagataaatgagtagatttaaactattcacgattcttcagggttctttttgtgccttgagtctctgaggggaatggttgctgctgataagcctagccaccagtcacgtaagaagatattaatatacagcaatttcacagctgaaggcttttgcttttccacagctatgttaatagtatttgtcatttggaatcaaacaagtccaggttattcaattcccgggggtgggaacttacacaagagaattaacttctctgagctcaagtgcccctgtttataaaatggggacaataaaatttataaaatggtgacctctgttgtagggttataaggattgaaattctatgtgtttagtgcctggtaaaatccttgacatgtagaaggtgctcagtaaattattgtagtaaaaatacaagttttttttttgggccaggcacggtggctcacacctgtaatcccagcactttgggagtccgaggcaggtggatcacttgaggtcaggagttcaagaccagcctggccaacatggtgaaacatggtcactactaaaaatacaaaaattagctgggtgtggtggtgcgtgcctgtaataccagctactctggaggctgaggcaggagaatcacttgaacccaggatgcagaagttgcagtgagctgaaatcacgccactgtagtctagcttggggtcactgagtgagactccatctcagaaaaaaaaaaaaaagacaccagtttttaacagtctttctcctcccttcaatttggttgtaaaatattcgaaaaaaaaattggaacctgtacatgttttgacctgaaaaatagtgggaaagtgaaaacattccactttccctttcggcatttattgtgtcacttaattattttaagtattgaattttcagtctgtcagacacatttctgatgaaagttaagtgtgatcagggctcactgcaacctcaaattcctgggctcaagctatcatcctgcctcagcctctccagtagttgggactatagggatgtaccactgtgcctagctttttttttttttttttttttgtagtgatgaagtctcactatgtcgcccaggctggcctcaaactcttgtcctcaagcaatccttccacctcaacctcccaaggtgttgggattacaagtgtaagccaccacgcccagctaaaaaacaaattttaaagttatttgtgccactgctactcctaaaatgaatatactgaaatgcaatgatttggatcctcccaatattttcttgtgttatgagaagctgataaagtcttatgaaactcctgtgggattattgaaataatatttaaatctaagtcttaggtcttgtgagatcctaggcaagtcatttagctcatatgaaaaatgagtactacacattattatgatctcagatttgctttaagattgaatgaaactttgcatgggaagtggctttgtcattggaacagctgttatcttataataacactgaacaggccgggcgcatggctcacacctgtaattccagaactttgagaggttgaggcaggagaatcacttaagtccaggagttcgagaccagcctggccaacatggcaaaaaccggtctctactgaaaatacaaaaaactagtcaggcacacacgtgtggtccctgctacttgggaggctgaatcaggagaatcgtttgaacccaggaggtggaggttgcagtgagctgagatcgcgccactgcactccagcccgggtgacagagtgagactctacctcaaaataaataaataaatacatacatatattcatacattacaataacactaaacatccatagggtaaaaaatgggggctttcatttgatggaaaacttcagacacagctcttttctcatgtgaaacaggactgactaatatccgctggcttcctcagaattggttaagaggagatacttgatatcccggcacctttttctgataggctgttgactgtagccttagcctttctcagcccctggcctgactcctccccttccctgggttgtctatatctaccacctctatatctaccacattttatttatgatggttgtgttgtggggtgaggtgggaaacttggcactggctaggtctcctttgcaatcagcctccctacagagaaattggccattaataattgtattaggaaacattttattcttgcagagggagacccatgctttacaaaagattcctgacatttggtagcttggcctagttctggggtgcaaaattaggaagcccatcgttgcggcatacctcagccatatttccacccctacctttatcagctgtaaggctgttatttttatcttcaactacctggcttatttattttctcaaaaagttcagaactcaaatgggaaaaagtagtattctttattaccccactgaaaagtaagggctaatttatccaagtctggttcctcacaggctggcccctgaaacactccacagaaaccagctactgctgtgagtttaagacaatcaacccaacttatggtagaattctgaagtggcggtttggttggattgatgctcacccaacctaaaatactgagttagtagaccatagacctgggctgcatatggaggttctacgttgttatgcagctgcagcccccaaagcttgaccccagccttttgattttgccaactgctaagtgctgaggtgatgacccaaaaatggaggccaaggttctgccacatcatattgctgggaccatgggtttggaccccagcccttgatcacaccatgggagcagcttatactctctcaatcatgcaaatttttttttttaaagccctacagccaaaagactgaggtttctcttccaatgcttgacgtttggccctgctagattcttctgtgctgtttgaatgcaatgggcaacagggctcacatacctgcgatgggtcttttctctgaatttctcccctccctgtcaatgttccagaagggcctgctgtgtgtgtgccctgcttgacccttcacctctggtactgtcacccgtaaccctcagcatctgttcagaaacagtgatcataattcatccagaggtctctgatgattcatccagaggtttcctaggcagggagcttgaattctgagaacttcaagatcacaatgaatgacagagatggttctttaacaccgaggtctttggtctctaaattttatgttatttgcctgggagttggtacttccataaacaactattgggtcacagagaaaggcctgattcccttgttgctgtgggaatagttaaatgccttgtcttccagaagtctttttattaaccccagacagcagttccagtgatggatttcactgtaaataagaatagctcatttttctctgccctctagagttctttttttttagtagatttttcaaaattttactgaagctgaagaaaaaaaaatatatatcaaaattgatagcacccagatgctgcagaagtagtgctgcaggtgaaagataccaggctgagacgaatctggaaaaacgggactcttgtagtcggagctccaaggaaagactggataatagaaaaggaaagatggaaaagccagaaagaaggagatgttataagaaagaaaagtatacaccacacacatatgcgcgtgcacacacacacacacacacagagagagagagagagagagagagagaaaacttataaaattttgagtctgtccattggtaaattactctgttacaagccggcaatgaaatttgaatggtagtttccattgctcaatcccatgggaagttctgagtgtgtagagcagtcaggccactttcagtactcttgggacctccgcagaccaggagggactgtgatcttgagatcttgatgatgctcaacatgtatcttggttcgcaaagcatcttcatgcaaaggatctcgttttagtttcacaacccacccgctgaagtagctgagtggaaactctccccttctacagataagggtagaaaacagtgacacctaggtccaggagtaaagatattcaccccttccgaaaataatttatgaatgatttaaaatagttttgttgggacgcagacacaggtacgggatacaaaatgtaaatgtggagccttaaacattatagtattttatttgattttgtgtttttttattattattattattattattattattattattattattattttgagatggagtcttgcttggtcacccaggctggagtgcagtggcatgatctctgctcactgcagcctctgcctcccaggttcaggcaattctcctgcctcagcctccagagtagctgggatttcaggcacccaccaccatgccaggctaatttttgtatttttagtagagactgggtttcatcatgttgcccaggttggtctcgaactcctgacctcaggtgatccgcccgactcggcctcacaaagtgctgggattacaggcgtgagccaccgcacctggcccattttggtagtttaataaccacacacgcaggaccatctagggcaagttctgagtttgggggctcccttgtgtagttccttctttttgaatctgtgctgaggatgattttctttagatcgtggcagaagtggtactatgctcattgcaggcctcagtcttaagaagtcctaatgacctcttcttttgtactcttgggaatcttaagctgccatgtaagaagtttggttgccactgaagagatcacatggcaaatccacatgaggagaagccctgagattacatggaatgagagagagagagagatagaggagaggagagaggagagagaggagggtaggggaggagggagagatcaaattggctgaaaacaatagctgaccccaggcccagctttcctgtagctaaatgcagccacaaaagtgaccactgtaaagaccagcagaagaactgctcagttgagccccaaaccagattccagaactgtgagaaaatggaatgattgtcattttaagccactaaatttgggggcggtttgttatgcagcaatagctaaccaaatagaagttagctctcagatgtggtttcttctgtaacaagaacacaaagctagtggccatggcttttggcctgggtggtgagtagaagctggaggaggctccaggagacttagtgaaggctggaagggcagtgagcagttggtattagagtctggagaaaaaacaatctgtgtcatgtagtggttgaaagtttggcaacatgttgactataaaagatagcaaatgtgtctaaagaacttggggatctgactaagagactatttccagacagaacgttgaaagtgctaactgtcttcttttagctgtgcctgataaggcacaaatagagagagaaggataaaaaataaaagtgtcaacacaggaaaactttccaacccaggacttactgagttggaaaataaaactctctccccttgcagcttttccagtctgcaaaaggttcccaaatggccttgggggaagaaagatcaaatctaagatgctaccagtaaaatggaacatgtgagtcaagatcaagtcacaggccgggcgtggtggctcacaccaaaatgctggtaatcccagcattttgggaggccgaggtgggtggatcacgaggtcaggagttcaagaccaacctgaccaagatggtgaaaccccgtctccactaaaaataccaaaaaattagccgggcgtgctggtgggtgcctgtagtcacagctactcaggaggctgaggcagagaattgcttgaacctgggaggcagaggttgcagtgagccgatatcacaccactgcactccagcctaggtgacagagtgagactccatctcaaaaaaaaataaaaaataaaaaaataaaaaaaataaaagatcaagtcacaagtgtggctataagaccctttgttaagaccccagaaagattagcagtagaacctcctagaacctcagcactagataaaagtgtttccaagaatctaaaggacatcttctcatagtactctgacccaaagtataaagaggtctgtcacaaagagatttgtgagtatagctcttatctaatggcatgaaacctaataagacttataggaatcctacatagtcttgaagagaactatattagcagaaacacagagttgtactaaaagaaacagctctgcggccataaaaaagaatgagttcatgtcctttgcagggacatggatgaagctggaagccatcattctcagcaaactaacacaggaacagaaaaccaaacaccgcatgttctcactcataaatgggagctgaacgatgagaacacatggacacagggaggggaacatgacatactggggcctatcagggggtggggggcaaggggagggagagcattaggacaaatagctaatgcatgcatggcttaaaacctagatgacaggttgataggtgcagcaaaccaccatggcacatgtatacctgtgtaaaaaatctgcacgttctgcacaagtatcccagaacttaaagtaaaataaattaaaaaaaaaaggaaagaaaagaaacagctcaacttgaaaagaggcctctggactctttctaaaggcaggaaacaggatgagaaagctattcacctacagacactggccatcccttatgggaaaagaagaaatagtcagaaagcagagtaaggaaccatgaagaaccactccctaggaacataactgtccctggagcaggggtaattggtgatatatgcctgtctggacttcagaattgctgtggactggcaagtcctgcattccttccattctccttcatttagatgagagtctgctgtgattattgtatgctggtctcactggtatatggggcgaaacaatttgtcttcagatctagaagaaatatacccaaggagtcttatctacacctggacttggtttagatgacaagatcttgaaccttgagccagactgctgctgtaatatggtgctgcttcccagaggaggtatcagttaacctaggactgaaaggatggattggatgtcacccagggacgaagcgactgtgacaagatacaagcacaggtatgttcgagattcacaatcacatgaatcgaaacaaactactttcctatattgagcagctactgtgtgcactggcacatgtatatagattatttcctttaatcatggcagagccctgcagggaaagtcatagctcctaagtcacaggagtgggattcagccccattcctgttagacctcaaagctcattttctttccatcccacacgttgccactctctacagatttcagtctgggctcagagcacagaggaaaaacagtggaggcttggacagcctcacactcagaacagtggaatcagatttttttttttttttttttttgacacagaatctcactctgttgcccaggctggagtgcaatggtgcgatatcggctcactgcaacctccgccttctgggttcaagcgattctcctgcttcagcctcccgagtagctgggattacaggtgtgcactaccacacccagctaattttcatatttttagtagagatggggtttcgtcatgttggccaggctgatctagaactcctggcctcaagtgatctgcccaccacagcctcccaaagtactggggtgacaggcgtgcgcccccgtgcctggccaggaatcagatttttaaagagccttgacagcttagtggctgctgaaacttggtctctccagatactttcagacagtgtccacacccctaaggggtctatgccaattgaagtcagatgattgcctggagaagaggggcttggttgctgctcctgtgtctttgtgtttctctcttcatttttctgagtccatgtcttcttggtgaaatgagaagtcaggagaaacagttctgggagcaggccacactgagacagggctgttcagaagaaaaggaggacccagagaaatttcacactcttggccaggatttggtgaatggggctgaagcctgggctaggcctgtgtaagacagcctccaccaccccaagcctcttgacagatgcaccgtcctggagtccaggtgctgactgtccctgactaataggcccagttgaggggcagtatggagggggaccgttaaagcatcagtggaaatccattgatagcatcaggtcctcaacacgccaggatttacctgggggcttggctgggaactaaatatcccaagggatagatgtattattattaggcaggtgtgaaagtcattgcggtctttgccgttacttttaatggcatcatatcaattacagtgagaccgggtggggagggagatgagcactcaaagaaccaggagtagcctgagtgtggtttcccttggcccaggctcagaccaggtgtgaccaggatcaaaacaaccatggggactttaaaaaacaaacaaacaaacaacaacaacaacaacaaaaaacaaaggttgggggcggtggctcatgcctgtaatccgaacactttgggaggctgaggcgggtggatcacttgtggtcaggagtttgagaccagcctggccaacatggtgaaactccatctctaccaaaaatacaaaaatatccaggcatggtggtgggtgcctgtaatcccagctacttgggaggctgaggtagaagaattgcttgaacctgggaggcagagaggttgcagtgagccgagattgcaccactgcactccagcctgagtgataaagtgagactccatctcaaaaacaaaaaaaaacaaaaaaaaaccaaaaaaaccccaaatattgtcaaatccaaagaatgtgacttacttaaaaatgaacaatatggctgggcatggtggctcatgcctgtagtctgaggtgggaagattgcttgagtccaggagttggagaccatcctggggaatatagtgagaccccatctctacaaaaaaatttaaaaattagccaggtctggtagcacatacctgtagtccaagctactctggaggctgaggtgggaggatcgcttgagcctgggggggtcaagtctgccgtcagctgtgattgtgccactgcactgcagcctgggcagcagagcgataccgtctcttaaaaaacacagaagaaaataaacaatgttttgcatatgtgttatactaatttccatgaaatgaccagggcccctcaattctcagtgtacttttgatcctctttgctctacatgaatatttctttatgtcttttagtacacgtctttctaccattgagtccctgccattgagggatacagttcctcctggcctgactccagggctctctcttgctgtctttccaaaggctctagaccctcgccccttagatgctacctttccccactgtggccttacccatcaagagatttattttcttgctgcctctaaagacaagcagatggactcctcttgtttgaagattttttattctcaacttgtcacagtggggacacagacagctgagagacaaaaataacaagcacaggaggttatgaagttttggaagccttatataatccgtgctgccacagaccctttcctgcaggcaccgacagcggagcccgaatgggaagtgtaagatggatccgtgtccaaatcctgctcgagccacttcctagctgagtgatcttgggtgaatcaacagcttacccctgctagcctcagtcttccctctggaaaatggggataataataccactgacccctctgtgttatctgaagatcaaatgagtttacacatacccagtggccagcctagtgtcaacacgtgagaggtgctccataaatagctttgtttacagctttgtgtttacagctcagatagtattggaaaggtccttggactccacctctctttgttcctaaaggtaagggttattccttttccatgccaaccactttcaagcttgggggctgcaggtggaatgggtggcaccagtgcttctccagctgcctcacctgtttacagagatggactcacagttctgaggctacaggaggggctggcggcctcttcattgggtcctggatgcatatgggtaaaatgttccctcggaatgccttgtacatttcgtttctcactgaaaagtaaaagctggccaggcagggtggctcacgcttataatcccagcactttgggaagtcgaggcaggtggatcacctgaggtcaggagttcaaaaccagcctggccaacatggtgaaaccctgtctctactaaaaatacaaaaaattagccagggatggtggtgcacacctgtaatcccagctactcaggaggctgaggcgggagagtcgcttgaacctgggaggtggaggttgcagtgagccgagattgcaccattgcactccagcctgggcaacagagtgaaactctgtctcacaaaaaaagaaaacgaagaaaagtaaaagacaacaattttattttcttttacatgctctcctccatctcagggtagtgaacataaggcctggttattgctctccagggcaggaggcaaagatagccaactgccttggaacatgctttatatcaaagtggactttctgttggattctcgagcatctctgcagttctgagttagaggttttgttggaatgcaatctgaccagagctttcacattagctgggagagtaaatcactgtccctgccatagtgggtggtcacggattagtccagcaaggcgtcaacactgctgtctctgagaatccacatccaaggcacacctgccactccaggtctccctaacacacagttgtcacactttgattcttagttaggatttgagattgggttggggtttgcatgcctccagttactcaacaaaagctctcccggggacatctgcacctgtccccttttctctatgataatgctatgggatatggagagtgtcttagtccattcgggctgctataacaaataccttagactgggtaatttacaaacaacagaacttgattgctcatacttctggcagctgggaagtccaagatcaaggcaccagtagattcggagtctggcaagggctcgcttctcccagatggcaccttctgtgtcctcacatggcggaagggatgagcaggctcccccaggcctctttaataagggcactaatcccattcacaagggtggagctcttaggacctaattacctcccaaaggcctcacctcttaatagcaccaccttggggattaagtttcaacagtatgaattctgaggggggacacagatgtttagatcatagcacagaggtactaaacatgctttattactcctggaaaaggaaaccaacattatagaccatctaattgtgccaagcacgagtgtgggaatgttgcaggcattgtctcacactctttttcacaccagctctttaaaagcaggaaaaaggccagaggcagtggctcatgcctgtaatctcagcactttgggaggccaaagtgagtggattacttgaggtcagtagttcaagactagcctggccgacatggtgaaaccctgtctttactaaaaatacaaaaattagccaggcctggtggcaggcacctgtaatcccagctacttgggagactgaggcaggagaatcacttgaacctggaaggcggaggttgccgtgagccgagatcatgccactgtgctccagcctgggcgacagagcgagactcagtctcaaaaaccaaaccaaaccaaaacaaaaaaaaagcaggaaagagacactgaaccggggcagccagtctaatgtttccctggaacccagatgaaaagtttccctttgggaatcaaattgggaaaatccacacctggaggttaggagcaaaccaagcaatcatctgtggatgaggctctagagggcttggaaccacaagaacttgtactcaggcacgacagggagtaatcccaaggggacaaaacagaatctttggaatctattcacttgtactttatagtgtagtgaaggagtatatgaatcgaaagtgagagacaggctggggaacagaagaaaaaaaacctggaagtgccaggagcaggctgagcctttcaaattccatcctgcagcatgtctgctgcgccatggatgccactctccctattcttgggttggtatatcctgttatgtatccacctgcaagcactccaacttggcatccccagtcatcaagcaagctctggttgtaattttgacgtctaggtatttggtgtacagggaaagacggttggttgacattttttaccccattttaccccatttttacccctctggatgtttagtgatgttatttatttatttattttgaggtagagtcttgccctgtcacccaggctggagtgcagctggttgacagttctactcctctcctctaacaaacaggcctcgtgacctatatagatcagtcctaggaagtggtgcgtgccccgtaggcaccgaggaaggttctttcctctgacaccctcctgatctcgacctttggcagtatgatcttgcactggctcatctatggaaggtctaaggaagaagacaatcattgttactaactcaataaatctgtaggtacttattggtttccaacgaaaagtggcaatctggggagaacaatgtcattaagtggaaaaaatgaaaggggcaaggttattataagtattataaggtgatgctcgtacatggacagaaaggaggaacatcaaaatctcaagtagcacctaatcccttccattcccagagacgactgcataagtcaggtcgttttatccctactgtgcaattacgaacatccagagtggacgtgatctgatccaaggagctgcagcatttatctaatattcaccagagtctttttctttccttgttgacttttactgtttttctcattgaaggaaaacacttcacttagaaatgccagtgaatcaataatatttataaagggcattttagttgctcagcatgaggccgggagggtaatgaatcatacaagacatagtttctgccagggccgctttgtacagctgcgcagattgtgcactgcacagccctagtgtgtgctctttacattgttccatgcacttgtcccctccccccaggggttgctcagtgcaacgtgtgggatatgggggacctgtgcacatccaggaggctgatgatgaggagtttggatgtgaagttacagctacattgtggagccccccacagtgcctctgatgtgaaacactttgctcagtgtgggaactgggactggaaactgtgaattccttttgtgggaggcttggtgcctattcatgagagacaagttcctgtgaagggactggaaatgaaggtgcagaaggctcctagccatgggaagaagctgggatgggaataagcagaaagtgctcctgccttacctttaggcgtcaggggtctcttcagggaaaataatggaccagaagaaaagagtgctctccagagctgtggctcttccctccctgccactgttgaatggccccttaaatgtagctggccggtaatggaatctctaaagccaccataaaatgagtcagcgtgttttatctcaactcgtgagttgatgtcatagatgagtctggatgttgggaaaaataaatagactgtcttagtcatcggggctgccgtgatggaatatcacagactgggtggcttaaacaacagaacttaattttcttacagttctggagactggaaaaccaaagtcaaagtgttagcagctttgctatctactgaggcctctctcggcgtctccctgtgtcctctcgtggtctctgggcacatgcatccctggtatctctctgtgtccaaattttcttttctcataaggacaccagtgaaatggaattaggtcccactctaacggcctcattttaactgaatcgcctctttcaggacctgatctccaaatacgatcacattttgaggtactggggtttagggcttcagcatatgaatttgggggagatataattcagcctataacatagaccaccagaagtatagtaggggaaaggaagcttgtgctataagagaggaggaacgacacagggtccatattgaaattgcaaggctgctggtcccagagggctgtggttctaaggcagtaccagttccagaggccacacacgtggtaatatatgaatacagtatgcaccatctttagcggtgtagagagttaaattgagttgacatgtttagccagggataaatgtttaaactgagtttgttgtaaccttcctgtttctatctggttcttctcgtatgtgtaaaaataacaatagtaatgaatgtttattacattgatttattaagtgctagaactactatgctagaagtttatacagcacacattgccttcctcaatctgtaccaccctttcgggtgggtcttaactgaaatccaggacccaaaggcaaactgaaagtaggtgtcggctccaggaattggatctagcctggcttactccatggcctgtgcctgtaaccactgggctgtggtaaaggcagaaaggcttggaaagcaccacctggggttgaaatctcagcttagctagtagccaggaagcccatccttgcctctggctgttcacttctatgttagagaagggactctggtggatatagattcc

SEQ ID NO: 2225 - DNA, 8636 bp, Homo sapiens
ctttttcaaataatgacttcttgtcctctaggatacccagtagtgggatttctggatcaaatggtagttctatttttagttctttaaggaatctccacactgttttccatagtggctgtactagtttacattcccaccaacaagcgttccctgttcaccgcatccacgccaacatctgctgttttttgattatggccattcttgcaggagtaaggtggtatcacattgtggttttgatttgcgtttccttgatcattagtgatgttgagcatttttcatatgtttgttggccatttgtgtatcttcttttgagaattgtctattcatgtccttagcccactttcgatgggattgtttgttttttatcttactgatttgtttgagttcgttgtagattctggatattagtcctttgtcagatgtatagattgtgaagattgtctcccattctgtgggttgtctgtttactctgctgattgttccttttgccgtgcaaaagccctttagtttaattaggtcccagctatttatctttgtttttattgcatttgcttttggagaaccccaattctttagctggccacatggtcatcaggaataaggactacatttcccagccactcttgcagttaggtgtgaccatgtgactaagttctggacaatgaattgtaagcagaagtggtgtgtgcaacttctaagaagtgttcttaaagggaggcagcatgtctctctcatttcatgatgaacaggatcatcatggctaaagcctcagccccacaagatggaggaataaaatagaagtccaggtctctgacacagtggggtatcacagcaatcctactggaacatgaggggaaacaaagcccctgtgttgtttaaggaattattatttccattttatgtttcttttcaggcaaaactaatcttaaccagaaattacctgataaaattaatttttgtccgaaaaaactattcctgtcacacttgaggattaagtgtgataataaacaattatcacactgtttcaacatagagcacttgcacaatacatatctaatcttaataggaactcaccttggtagtagagggagtttgggtccatcaacttggtgcaggaataatactaggttgtgtagagagggaccccaagtgtattgtgatatgttgacactcatataggcttctgacatactcctttgggacaaatatcagagtctaagggaaagggactcccatgtatctgaaatgtaccagcacattctggtttagtattctgtatgagactaagagcagcaatacagaagaggccttctgctgcagtggtggcgatggcactagccgcatcatgaaggtggagtgttatgacaggaaacagcagtagagtctttgggtagtgacaatgggctaggctccagagagtgtggtcaggaccgggcatgcaggaattatgtggaaataaggcctaagacagaagttgcaagacaccccaatgatccttcctcacctatcctccaccatagccaactagagccagaaggagggatttggatggggctaaagttcctccaattctgcaagtggaaactgagccacaggactgtttcgttactgtttctttgtgtatgattgtattctgccctagccaggtggtctgggcaatacctgctgctcataaatccatgagtgataaactgaaaataaaccatggaaagttggaatatttctgtggatctgtaacctctgaagttaagggcatgaaaaataattgccacacccctacagcctgctacagaggcatctgtcctccacagtggaattctgacgtaactgatttactgaagaatattaagttatttggggcattaacttgtaaaggttttatgttttccaaacgttgattccaactttgctttgttgaattcccttttcaaaattcataaccttctggtccttttcagttatcaaaatttagtccattacaaaatcccaatgtcttatcagattcgaagattgctccataccatgttgctttctagataggtgggtaggagtattaggtgtagatgcaggggtatgacattctctattcttcttccccctccttcttgtaagttagctcctctggcgttactttctagccagtctgttaggggtagggagattgctcctggcctcactctggttagatttgtttccagctcttgctggtagcttctgctgttgggctaccctctgtgtacataggtggcttatgtggctgtcacaggagtggtggctagcttcatttgcagtgttcactgttactgaggacactgtcaaagaggagcagcctggtttctctcagtcattcccaaaattccaaatgtccaatcccttcactagatgggttgccatgactatcagccctcaagctgcctgggtagcatgaaggcttttactcttctagtctgtgctcctgtatgtggagtcagaactgctatgatccttttctgtgacttttaagggcagtagggatcaggagttcagttttatcctgttcttctctaggttacattatactatacatttacattatactatagccctttcatgccctgctggaatggtctactacagcaagtatcctgccttcagaaatctccaggtgagaagcaggcccagcctcaatatttacacatactcacctgcctttacagaacatatatcattctctcttatctctttgttccactcaaaggtatctttgagtaaatcttcagggtctccagggtcatgagtatactgctagggagcaagatgccagtctccttttctaacaggctctcccaaatctacgagagattatcttgaggctcacccctacctcatttggctttggtgttggagaggaaaacctcttcttcttttgcaacaggctgaaaactccaatagcttcttcccctcctccaggtctcaggggagtagactggacgtggagagtggtagaggatagatgaagacagtatgtccagtaagccttgtggaaaatatctggtcccatttattggtggctctctttagaatatgagagtctaggctacaagacacttcaagtctggagttcaaatcttagctcttccacttagaaactatgtgtcagctcacagagtgcctgagttcaaatcctcgctcttccacttataaactgtatgtcactgggcaactcacttatatttttgggcctcagttttctcatctctaagatggagataatagtagtaactatatcatagagttattgtgaagattaattggattaagggttgtaaaatgtttaatacaaagcctggtacataataaatgccatgcaagtgttcattgtttattatctttcttactttttttttgtcttcagctttggaccattgtcaccaattttgcagtaatagaagtccccttccgcattctgttatgtttgatggatgaatcatgaaaccagcctaagagaaaggaaagacatttggaatcgcttatggtaacagttctagttactataagctgagcaaagcaaagctggagttgagcaaagaaacaaacacactgtacctacttgaatgtctcattaaatatgttgggaaagtaaacctgggtgggtcattggttcatccatccctacttagtaaatcaaacggactctccttctggtagaggagacgctgtgtcagaggaatgtgctcattcaaatcaggagccaacacattcttagtaaatgttccacatgcaataaagtgaattactgtgctgcgtaagctctggaaggatttttctaactttccactggatagaaaagcttgttttattaatatattgaataacagcattgtgtaaacaactcatactttttagatttactcctgttaaagaatgccatagttaagtgcttggaattgacacttgaaaatgaaatactgctgcaagtaatggggaaattgtagatgtattttatacctctcctttccaaatcaaaaggtctcataaatacagtctctaaaagtgtcagtggggggagttaacctaactgtacaagcaataagcctgacctttcagtgtaatttattttcgatttgctcaatccttttttattaaaactagcacatctgaagcagaattaaatcctattataacaggtgtgtgatcatatcaggttctccctgccaccagcccactttattaaaagttactttgtttcaaggaggataacctgatcagggcagtgggatacctttggaaggatagggcagcaggggaaggatggttttattttcctgtgaacaactgcttttaccagtgaaatcaaagaatatctatgagcatatttcatgtttgaaaagccatggtaggacataatagctcctctgtgtttataaaagttatttctctctggggttatttagacccagggacaaagagggtcatcaagttgttctgtatcataatccatacattactagcctgtaatcattttcatgggtagcattcttagtctagtgaccattaggagagtacaaacacctttgaaatactagtgagatacagatccacttggtagaaacttgctttcagttttcggcctatctcatggaacctaattctactaggtccttgaagaagatttagaattttaaaaatcaccccatttactagtggtttaacctgcttcctcttggtttaatcttttggtttctatctcctttgctctgcctggttatctcattatccagttcaatttctatctcctctgggatcctgaatcatccctgcccacagtgacctctttcctcttcccaaatctgaccacttatagttcatatacatcaactgagcactgacctgaatgaatttgtcgtaactcctctgtcaaactgagaactagagggcagaaagtcaagccagtctaatttccagacctttgtagtgaattggaggacatactgggcctggtcgaaataaaatatatgaccacaaggtggcagtggcacacaacaagttttatttaggtgccacttcgacaggtttgcagggttaggcaaaagtccctcacagtatgagaccttccaaaggccatggtgcagcggccaccacccagaaagggagagactttaaccttagctatagaaacatggtgactggtgcatgtctactgtcgattggttgacattctggggcatgagcctatcacttatgggttagctttcagaagcataattactagtacaaagtgtcactgactgaagaatgtattgaaaactggcagaggagattacttgttgctatagcaataaaataaaataaaataaaatagatattttcttaggagagtaagagttttctattctcagcacctagcaccttagcacagtattttgcaagcagggagcactcagtaaatacttgcagaatcaaagagcagcatatgtgtatcatttgaaaacatattgccttctagtctccctagtgtcaatgcttctacctagggtttaaacgtggagagaataatagcatctaccctgtgtccttatctttttttatttctaaacaaagcacttgatccttactttactctctaaggccaggaagaaaagaaatatttacaaatatttctatttgtaaattagaggtgaagtaaaatatctagagtcacacagtgttggatctttggactctacatttcttggcttctattattattattattattattattatttgtgggagaccagagttttattattactcaaatcagtatccctgatcatttggggatcagagtttttagggataatttggtaggtaggggaagatcagtgagtcgagagtgttgattggttgggctagagatgaaatcatggggaattgaagctgtcctcttgctctgagtcagttcctgtgggggaggtgggggtaaagggaagtgttaggccaatagaacagagattgccatctggtgtgcagaaatactagtcttcttatcctcaggtggggcagagctggcagtggccagagccctggaaaattgttctggctgcaagcaacttatctgtttttcttagtgtgttgacaattattatcattttctatttgcgtcctgatgtgaaaatgtgggaagcactacacagaagtgccatttagtgcatatgtgggtctgtatgtaacactccattaaataccaccttacatcatattgttacgtgagagttttcagagtgcttccatgcacatcatagtcacatttactcttcaaattaagcctgtcatgcagacagggtagtgaacagtgttatttaaatctacatttttaaaaagttttgaaatggcaaaaagagaaaaaaccttaattttctatctcaatcattcttaaaattttaataattaaaaaataaacattttatcaaacataattaaaatcatatgtgataattttatgtgctaactagactggactgagagatgcccatatatgtggttaaacattatttttggatgtgcctgttgtggtgtttccagaagaaattagcatttgaactggtgaactgagtaaagcagatggctgcccccagtgtgggtgggcatcatctaatctcttgaggaccaaaacagaaaaaaaatgcttgagttaggacattgatctgctgcccttggtgctcctggttctcaggccttcagacttggactggaatcttcacgatcaactctctggctctcaggtcttcaaactacactactggcattcttgggtcaccagctttcagatggcagatcatgggacatctaagccttcataatcacataagccaacatcttatagtaaatctctttatatctatatccatatctgtctatctatctatctatctatctatctatctatctatctatctaatcatctatctatctatctaaactagatagatatatacagatataatatgtaaatctctctttctttctttatatgtatctccatccttttggttttattttcctggagaactctgactaatacagatttttgtaccaagagtgattctagaggaacagaattctaaggatgagttttctgaattagttctggaattttgggattggctcttaaattttgttagatttaaagacactaatgactctatttccagtagtaaagagagcattgatatttcatgcatgatctggcaatggagataaacaaaaaagtctgtgttggatactccaggtcaaccattcataaaaagaaaggagctgggtgagttgtacatacctttggaacatctttgggagatttttgacaactaacaaatctaataaggttggttggttggtcctaatatccttggacaaagtggtgaaagaaaagcatgggctcagggactcatattctcaactaaacctccataaacagcttgaagtataataaaaaaatgaaaaaaataatttcagaaccattcattaattcaacaaacatttattgagcacctaccacataccagaattttgaaatcggtattgcttttggggatttatttttgtagtttggatttcaatttgagtttgaattctaggtttgcagcctatctagctgtgggagaatgaacaagtcctttaacatctgtatctcagtttttctgcctataaaatgggaataataattgcacctaataacgttgctgtaaaatttaataatataatcacacaaaacgcttacaaaaaaaagaagtttctgcttgtgaagggcacttcaaatgaggtctcccatatccctttacggatatgtgtctcttctcctttgccattaggagtagttacgtgggccagtttgggaactctgtgtgccaagaattatgctagatgatgaggatacagagatgactaaaacacaggccctgatctccaggatcttataatgagggaaagaaaacattcccaagtagacactgaattcctggaggatagggaaccatcccctaattgtcattgagtaaattaaacacacagctttctcttcctataatgatcagttaacaaacattgcctgagctccttgccctgtgggcaaggctgtgctggcaaggctgtgctgggtgctggtaatacagcaataaatcagtcacatgccaatccctcaggtggaccttctggtacgggaaaaatcaatggagcagagactcactagaccctgagggcactgcactcagctgagaagcactagaagcaaagatttgcagaggaagtgagttccaaatggggtgacatttaagacagaatcaccctgctttgggaaatatatcacttcaacaacaacaaaaagcagtgttaccaactatgaaatgaaaggagatgcccttttgttttgtttcactgaagtgagtttttaaattatacttttgtatgtaaaaaaatttcttcatggaacctgtgacaaaaccatgacaaatagccccagactaaatttaaattcattgggatggcagtggctccgagggtttctatgttctctgtctttaaatttttttgattgtcataaaaaatacataacataaaatttgccatcttaaccaaagagggtggtaggaaactgattttgtgatgcatatctaaacaca

SEQ ID NO: 2226 - DNA, 1214 bp, Homo sapiens
tttgagaccagcctgggcaacgaggagaaaccccatctctatgaaaaatgtaaaaactggcggggcatgatggcgcctgcctgtggtcccagcacttgggaggctgaggtgggggcatcgaggctgcagtgagctgtgattgcgccactgcactccagcctgagcgacagagcgagcctctgtctgagaaaaccaacaaaaaccatctggagcttcctgggctcacctccagcctctggtgatccatttgaggccattgttttgggctttgaaaacattcaagtgatagtgttgtgtgtcccatgtccaggattccaaaatgtgcctcagtaggtgactgtccactctgcatgggctgcctgcctgtcgctctcaggaccctgcctttgcgaatgtccattccataagggccgagggtctcctgagtttttatggcttgggctctggcctgtaccctactcagttatttgggaccaatcacatataaattctaagctattaggctgtagcaggagaacatcattttctcaatcctgaattctcgggctagagccctgtgaattagatgaacaaaagactggtgagtaagagaaaacccctctaaaaagacccttctccaacaggaggaattttcgacctgctgctatttttcgtggggaagaaaggctctgagtcttctgctcgggggatatcagcagaagcgccagtcagatcccctttttattaaaatcctcaaagtaaattccaccgacgaagtgtccacacattacagagagtatcggaacagccaggcatttaaagatgggctggaggtggcgccggaagtagaagtttggagttttagctctgccccggataatactggatgaaatcccagcagagtccttcctgcctggccccacctccctctgctcacccctcccagggagccctacagcccgcttgctgtgagctagaatcagatctgtgctaggtttccttctatccgtagcacaccctgcgggctggacgcttgcaccccatttcggggtgaggagctcacaaaggttaagtgagcaagtatctgcgtctctagtgcaaatcttcccactcctaagtccttctagggcaccccatgcttgaattgtgcgtgtgcacgtgtgtatatgtgtatttgtgtatgtatgtgtatttgtgtgtatgtgtttatgtgtgtgtgtatgtgtgtgtttttg

SEQ ID NO: 2227 - DNA, 948 bp, Homo sapiens
cagcgaactgctctggccccggggcagctctccagctgaatccgtgtccaagaatggaaccaaactctgagccaaagtctcagtcgattcctgaagcggagctgacgtctgggaggaagcagaagaccccagagctccccttggatacatcctcaggctcccgcaccttgggcttcatgttggaagatgagcgaagagaagagaagtggggccttggcctgccttcctgagataccactgtggctctctccagctactctcttcttccatttatggtatttgtgcctttccttcacctgtttaggcctttttgtggttacagtgcctcatcctatctctagaggtttctccgcaccccacccagaacttataaacagtctcctgttaaaactcagattatctagcatgactgtgctatttgctgcctacagggatcccaaagatacaaatgggagcatcagatgtatgattttctggagcttagctgtcaggctgtatcaacttacatggaatcaacctgaggcctttataagcataatttccagttgcactgatgtaatttctttattctgtcccttattggtggcaattaggttgtttccagtcaccctatgtataactttactgcaaacatagatccctgtgcttgtatctttgcacatatatataagtgttaactgcaggataatttttaaaaataataattgctacaccaaagagtatttgtatttgaaacattaataagtactgacaagtgtgccacttagaggtctgtattagtctatactaccattgacagtgtcttgccattatagcgtattatttgccaaaccaataggtgcaagaaagtatcttattgccattttaatttgcatattcaaaatttaagatgtacaacaactttccatgtagttaaaatgattttttccctgagagactccttcccta

SEQ ID NO: 2228 - DNA, 3496 bp, Homo sapiens
gttgttcagtttccatgtagttgagtggttttgagtgagtttcttaatcctgtgttctagtttgattgcagtgtggtctgagagacagtttgttataatttctgttcttttacatttgctgaggagtgctttacttccaactatgtggtcaattttggaatctcactgagcgggtggagccgtggttggggcgaaggtcagtccctacctgcatttctgtgtttatttgacagttcttcccttgtggtctttctctgagtggagctgagagtgcggccattcagcattcctgtcaccacccatccttcctccatggacactgaaggcttcaaagtgggatctcagtgggccctccaggttgttgcttggttctcacagagaccatttgctgagtcagtgggcactggagcggatacaacacccgagagaggtggtggatgttactctcaggaggataacacctagcgtccaaaaatgccacctgcccagatttaaccagctcaaaagataaaatgagtcacagtctgattcaggttgtatgtttccaagcccacctgcattttcctggataacgtgtaattgggtttacatttttcccgagttacttatgtaggcacaacgcgatgcaacaacgtgctcctcctcagccatgaatagcccaaggctgtgtggttgcctaatgtaaatctggctcaacagtggatagatctttgctataactgtaaatattttgcagtaaaaaagaccccttccaacaagactcaaatgcagactttcgttggcatcttttccaataaactaagtctccaagttctaatgtatggggcacattgccttctttaggaagcagatcatagaaaacttcttagatctggtggaaatcagcttttgaatattgcattagtgccttacagtgttgaaccgtgtcatgattacctaagacaagataaacatggggatgtctcatttcaggaagcagtgctacaggaaagcttcctcctaaattaggcttctacgtggtgtgagcaatcaggtatttgttagatatttctatggaaacaaaaaaaaaggttactagttggaacagattataaactcagtctctcagttcagagggaagccagttgagatttaatagatttgagctggaattatctttagatggtaaaatgagggggggaagtttcaatgtgaacaattttcctgatttgcagtttgaatgtcccaggcaatatcaccaggtgttccaatgagctctctaagtggcccacacaggaacaggcatgaatgttgtccatgcatgaactgtggcagcgatttctctgaagtttatatcaaattttccagtttcaacttgcagggagtgagggaaagggcagttttatttcttgtgattccaggtcagaagagtgagggaaaattggaaatgttcatttcgaaagtcacagccagacattggaggaaaaaggaaaaactcaagttgcagtccaggttagaggtacacagcaaacctcaaagacattgaacagggctagaatctgataacaggtacaccttagtacctcaaagacattgaacagggctagaatctgataacaggcacactgtagtacctcaaagacattgaacagggctagaatctgataacaggcatactataatacctcaaagacattgaacagggctagaatctgataacaggtacactgtagtacctcaaagacattgaacagggctagaatctgataacaggcacactgtagtacctcaaagacattgaacagggctagaatctgataacagttacactataatacctcaaagacattgaacagggctagaatctgataacaggcatactataatacctcaaagacattgaacagggctaaaatctgataacaggcacactgtagtacctcaaagacattgaacagggctagaatctgataacaggtacactataatacctcaaagacattgaacagggctagaatctgataacaggcacactgtagtacctcaaagacattgaacagggctagaatctgataacaggtacactgtagttttctaccagaacacaacttttgtctcttcagtcaccccaattcctaccaaagataatcatactaagactaatctgtttgcaaaatcagtctaatctcattaaacttggactgatcatttatgtaactgcatcaaggatagtggttcaatgcacattctcaaatatgacattccagtcaaagttttggtgataaccaaaggggttattagctccataaagtcaatctctactcattgaaactgtctggtaataaggagtctcagattagacttttaaaagccactccaggctaagcaaccaagccatggacttgcacaattttgtaaaatggagataacttaactagtaataaaagttgtatgtctgtattataactaatattgacaactctgaaggtatatccttttctttttttaaaaaaactaaaccaacgatattcttactcaccaaagattatccgtgtcacatgaacttaaaaaacatttgagtaaattcctgtttttctgaaagttttagaattacttatacaagtgcttatttttctttgagccaattaaatagagctattttatacattaattttggaaatgccatccagaggttaaaaaaaaatacacatgtcataaagatagagatagacagagatcttacagcttccatttagaaatttcagtcatgtgtctggtacaataatacaaaacttgctagtttataaaagaacagctggatccaaattgtgtttctggcagacaaaataatttgctcaaatggctaaagacttttttactaaagatttttcatttgtgcactgtaaggatacttttggagaatcagtttgtcttttagaagcttctgcataacaaagaaggcatttcactgtctctgaaaagatgaagatcctctgtcttcaagggcacccctaagctgatctatcttacttatggacttacacgatctacaagcaacatttttgtttttttcttttctaatatgtaaatgttaaaggttccccaaagtggccatggcagttccaaattatccttttttaagtttacccatttttccaaaaacgcacaagatcctggcccacggaggattttggaccaggtggaacccatctttgccttaaattacccagacatgaacagctgttccaaaacagttcagctgtttcttccacttctgtacagaacagggtgacccaccaagaaggttcaacaaagattactcaagaaaatgggcaagctcaacacaaagggtgtggagattggatcctagagacttaccctggacttccacggcccgtgagaaagcagtaaatgcagtaggtccttgggtgccggccctgggctactcgctgatgcagcgggtccatgggtgccggccctgggctactcactgatgcagcgggtccgtgggtgccgg

SEQ ID NO: 2229 - DNA, 5339 bp, Homo sapiens
attttttcgtacgttgaccacttttccagcataattgctaagcccatgtattaatctaataatttatctatagtttattttgaatgtctatatacacaattatgtctcctgcaaataatggtagtttttcttctttctaatcttttttcttgccttattaggctggacttactagattaatccagtacaatgtaaacctaatgggcttattatattagtctagcacagtagttaataagttccaatcttgtttcattctcagtttcacagggaaaggtttcagcatttgatcattaaacatgataggcattattggcttattgtagatagcgtgtatcatattatgaagttcacctttcttcctagtttgctgagattttgttatgaataagtgttaaattttaacaacttttttctgcacctgtttaaaaaatatttttttctttttatgtaactacaataaatcattttagtttcaaatgttaaactacccttgcatttctggaattaactagtcataatgtattgtgtttctcatatattgttaaattctttttgatcatattttgttgtgggtttttgaattctagcattatgtttaggattcatgagtaagtttagtaaataattttcatgtaatgtcccttatcaggttttgatatcaacattatgctgaccttataaaatgagttacgaagtactcattattttgaaaaatctctggaagcgtttatgggaagttgatgtcatttcttccctagtgattctggcttttgggaaaatctgcatattctatgaagtctagctctcaccatcttccctcaactagcctcagatctgacagttttgggtaggtgtgcttcatagtttatgttttgggcttgtgcttgtttctttacttctttgaaaatggtgtctttttcttgatcttttttgtatgtacgttttgcattgaaatatgctaagtaccaaaccagtataatgggcaaaacattttaatgggttttaatggagttgtaagaagagagtacagcgaaaatatttttcttctatctcttggggaaaatacttctgttttaatacaggaacttttgctttaagccaaagtaatgaagctttttctttggaaattttagacatctaagatggaagaatgaaggaactgttttgggagaaacatggttcttaaggagagaaaccatggcgtgtgggaaagacactggattgggagtcagcaggcctgggtatttgactacatcctctcccttattatctgtgaggcacttaacttacttgagcctttagtttcttttcccgtaagacaaagagagcaacaccagccttgccaagctcaccggattagtggggagatcaaatgggataaaaaacatatattatcctatttgtaaaatgctatagaaattaaagtatattatttttatgctttcatattgaggtccctggaaagctgtcagggaataagaaacaaaaggctgttacagctactcttgcctttttattccatcttaatgaatatcccctagctaatctgcagtcacagaggagtcacattaatatggaacttatataattcataaactgccacagtagcttggaaagggtttaatcagttgccttcactctcaattattttaaaacctcgataatagtcaaatgagctgcatggcagtttgattaatttgcattaagcccaaaggtcttgaatgagcagtgagtttatgaacatgaagtgtaagggcttggtggcagcgtatcaagcctgaatggatatctgggctgctttccattggttcctcctaagtcaggctgggagtgtgtgtgtgtgtgtgtgtgtgtgtgtgtgtagcattcacacaattcctatctgtttattacattagaattggccttaaagcctctgaaaatgagctcatttgctgtcacttgctagtgaaaatctttggaattatctgtaaattgcaattgcctatgttcttcctgctccagtttctatggttaacagaattggctggatgttacttttatttttataataaatttggtgctttattttgctcatcatattggttcggtaattagcatatgtcaaggcaaaaaaatcccactagatgacaatggcattcctgcattgttttaatccgagcatatacaacagtgagatggctgttcattcccatttcaggaagccgccctctcaggcacagttctgggaggaatttataactcacattaccatctctgtgggtttggagttataacccatctcatcatgagacatttatgccaaaagggtcaagtggacaaagagggagaaaaaggatgtgggtaagtggagtcagtcatttgacttgttttattgctctgttttctatcggcactggacgactgctggttttaaggaaacaaagcaatctggtgtgatggtcaggtagccctgacgctcacccacctctaatcccattggcagtattggtcccatcaagggacaaagcagtggtaggtagaataaatgggtccggagactctcagaaatggagtgactaaatgtaccatcctatccagtatatgcttaccttgtttatacttagatgctaaatgttgaccaaaagttgctgatatggccagtttaaacctatgaggtaactgacagacaacgaatgttggtgggaagtctcatgtgcttactctaggatggtataggcatgcactgccacaggtgcatcaagtcagggagggcagggaactgccagctccagccgtatgtggctaactcagctggttagagtatagttgatgctctgggatatggatcagatttgatcctaagtgagcaagtcagtttcttcagatctacttctctacaagccagttctcaaatgggtgctcttggtcacaagatgatagataggaatcattagactataatgttgcatgcaggaaactcggatcttttgggttgcactgctaagtttaatttctctgtgtctgtttcctcatctacaaaaatgagagtgttatgggataaactgtctcctcaaaattcatgttgaagtcccaacccccagtagctcagaaaaatatgactgcatttggagatgggggtctttaaagaggtaggtaagttgggttactttgtaggacccgaatccattatgactaatgtccttataagaagaagtgagatccgcctgtaatcccagcactttgggaggctgcggcaggcggatcacgaggtcgggagatggagaccatcctggctaacacggtgaaaccccatttctactaaaaatacaaaaaattagccgggtgaggtggcaggtgcctgtagtcccagctactcgggaggctgaggcaggagaatggcgtgaacccgggaggtggagcttgcagtgagccgagattgagccactgcactccagcctgggtgacagtgagactccatctcaaaataaagaaagaaagtgagatcagagacaatcacagaaaaaggaccacgtgaggacatagggagaagacagccaccaacaagctgaggaaagagtctttagaagaaataaactctgcagaaacattgatcttgaacttccctagaacttccccaatccccagaactgcaaggaaacaaatttatgttttttaaaccacccagtctgtggtactttgttcacagccctagcagactaacataggggagtcgtaatgtactaccagccttccaagttgtgaggatttactgagatgcttgatgtgaagcaggtgcaacagaatctggcacttagtacaaagagtgcttatttatggaatggttattgtgtaagcacaagtcctcctgctgagacaatttttcaacttggtgtatgttcaaggcacctagagtagagctgttccatagaactttctgtattaatagaaatgttatgtagcaatgtccagtatggtagcactttaattgtgactagtgatactgagaaacttaattttaaaaattggatttgaatttaaatagccacaggtagctagtagctattgtattatgcagtttagattacacagatctgtattagacagatagtagaagatacttatgtgaggcccatttctgatttaaatagctaaaatatcatatctttcatcagcattaggtaccagattcttcacagtcctataggctagtttacaaaagtcatcaatctcattttcacttagaattactgtattcgatgtcaactcttgagtgtccaacacattaaattgagttctttgctattttcaaccaaacatgttaaaatcccctattgctgtatgccttagtggtaggaaattgtacttaaggctgaggtgggaggatggcctgaggccaggggtttgagaccagtctgggcaacataatgagatcccatctctgcaaaaaattaaaaaaaattagccaggcatagtgacatctgtagtctcagctttctggaggctgaagtggaaggatcacctgagcccaggaggtcaacgcttcagtgagccatgatcatgccactgcactccagcctgggtgacagagtaagaccctgtctcactaatttaaaaaaaaatagtattgaaaaaaggacccaaatgaaaatggcccataaagggcttttatttggatatttgagggaattttaatttattctcaggtttgtatggatctctctctcgtgaagaaggaacattggaaagcaagaaggatttttctaactggatctgaggcatgaaagcgaggtggggtccccagactgtggctcaggaccttgttgatgaggaatatggacaaggacctagattcttactagttgcttctcaaagcaggagcgtctgcttttaccttaggggagaatgatcaccccatgacttccagcatacttcaccacttcaaaaacacagagatagctggaagagaaacagctctatggtaaggcctgtgatcatggaggaggctttggtatagggacagaactgcaagattaaagcaactgggagccctgagccacaacatgggggaaagatgccttgaggaagcacccggcttgctcaaaattctctgttgcattaagccactgaatttgggggttgttactgtaagataacctggcttgttctaatatacgaatcaatgagaagacacgacaagtctttttacactttttccatcatcggtaggttatatatggcactgaaaacccatgtttttagtatagtggtcgagactaaacattttataattatatctctggcctagaattaccttccctcccctattattggttatgttgaagccatgcagttcc

SEQ ID NO: 2230 - DNA, 1683 bp, Homo sapiens
gtttagtacatggtagttcactacatactgattgaataaaggaacactctcaaatcaattcttaaaaataaatgctccaatggaaaaatggaagaggatacaatttagaaatgaagaaatatacacaaccaataattactacattataaactctgtgaaggaaaacacatgtccatcttctttatcatatttccagtgcctagcattgttttggtatataacagattcttaataaacaactgatgaataaataaatgaacaagaaaaattgttcagcctcactaatttaaacaatgacaacaaaaaacaccattcctacctaacaaaatgaaatcgatttctttttaaactgcacaaactcagtgctggcaagggtatggaaatacttaggatttaatgccttcttttaagatcaaaagctctagctgggcacagtggctatgcctgtaatcccaagcctttgggaggccgagggaggaggattgcttgaggccaggagttcaagatcagactaggcaacatagaaacaccctgtctctacaaaaaattaagaaataattagctggctgtggtgctgtgcaccagttatacaggaagctgaggtgggtggatcccttgaaagcctcaggttatgatcatgccactgcactccagcctgggtgacagagcaagaccctgtctcaaagaaaaaaaaaaggatacaaaaaccaccaaaagctccttgaaggcaaggagtgtaactattttgtttattgtaataaactttctaaagtctagcacatggtgcttaataaatatttgtttactggatcagtgaatggagaacaaatcaatatcaatctcctggagggtactttggctctctagctgtaaaaacattcataccttttgacctaattattccatttataacaacgtagccttagaaagaaaatcatgggccagcatgcctgggcaagaactgtcatttttttaaaaaggacatggttcttacaagttcgcttctgctaaacagtggttctcaaacttgaatgtgtattagaattacctgaaaggtttgtgaacagaaactgctgcctctgcccctccctcttactcagtaggtctggatggggccccaaaatttgcatttctaacaagttccacttcgctaaaagacggcaacatagaaagcccatatggtgtaatgaaaatgatgtgggttttgaggtcagtcttggctctgccctttttaagatgttttgtagaaatagttgacagactctaatcctgctcagcctctgtttccacaccaataaaagtaatgcacacttcatagatgtattgtgagggttaaatggtatgattaaatacccaacatagtgcttgactcagttaaggattttaattaatggtggtcccctttcctttgatttcctcaaagatacagcacactgggtttatggtaacatgatttaggtgtaccacaggtcaaatcatttccttcaaacttaacaaaccatacatgttcatctgctactaacaaaatcttcattgttcatctataaaattgggaataatagtgtaacagtattttctttgataaaatagataatactgtctactttgtaggcaaccatgaagattaaataaaataatatcagtcaggcacggtggctcacatctgtaatctcagcactttgg

SEQ ID NO: 2231 - DNA, 20648 bp, Homo sapiens
gttcttagtgttaaaattttcatcgggattcagttaacatacaatagatattaaaacctgattgatcaaaacaacagaactgtattataaattttagtgagtacttattaaacataagaaataaaattttattgaatagtcctttcttactgaaacttaacaggactgtttttacagttggtttgtatatttatggataaatatcacttattgctagaataagaggattcaacatcaattctatttctcagttttgtttttataaatataagcattaagaaacttggtttacataaataattagaaggaaattagatggaaaacattttgctttctcaatgccacttaatcatttgagtgccttctaagttatattcagaaaatcacatagtgatccatgttaaagtaatttttaatgatctttgaaaaaaatatttggccctcttttaattttcctgaagcaaatcattaaacaccataatgcttgggaaacaccataatgcttgggaaaagatttttttaaaatcctgtcattaaagtcatttacttttgaaatattttatttttaattgccccatttttccagccctagacttttttatacccacagtaagttcaggctgagtgagtggcatgttcataagagaagcacgactgtgacaggggaatgggaaatggagaaccagcgtaatgtctccattgcaggtaaatttcatacggaaattaggtatctggaaaaagattcccttaaaactgattctttatacccttatatccttaaaaggcctcatgtacctcaggaggcctgtgtatctcagtttgagggccaatattctcgtagagacaaaaatgtataaaaatatatacaatgtgatacttcttgatactaaaaaaaaaatgctataaaaggaagcatatggtaaaaacctggagggagagtgctatgtgagataaggcaatgagagaggcccctgtgagaggggctgcctaacctgagcctgaaggatgagcatagttgttttgcagagctggtcaggcatgttgtaagtgggaggaacagcatgtgcaaaggtcctgttggaaataagcttggcatgtttgagtggcagaaagaggatctgtggggctggagcatgatgaccaaggggaagagtggaagaaagtgaggtccagaaatgggcaaggccatatttatgaggccctgagggagctgcacattattttcagcatgattcaaagccatctgaggttttaagcaggagaatgacaagagctgagttttgctttagaaatatctttctgggtgctgtgaggtaggggcagtggatgatagggaagtaaaaataagctagcaagttgcaagatagctatagactactgctgtcatccacgagggaagtgactgcagcttagaacaggggacaacactgaggctgataagaagaactcaatttaggaaagcatttggagaaaaagccaacgagaattgctgatgggttgcatatgcagtgtgaagaaagaaaaataatctacctgtagaataaattctagaggtggaattgcttaatcatgtctatgacatattttaaaaaaaaaacataaactgaagtgctgggcagatattttggacgacacactaagtgatcaagaactccagtctgaaaatctacctggataagcagtgatatggaccctactcatgggccatttttccatatcaccatacatgccccaggcactgaaaactgccaaataaaccttcttaaaatgaggtccattttcaaggaacaactcttattgacacagttctgatcagtccaaagtgtgcaactatctagtcttaagtatgttttatttaaataatgccagtagggagttgtgaagctaaaattaatgttttgaaactatccataatttttttaaatgaattttttattaaccttgcaagagacgtgatctaaatttttatccttttcttgctatagaacatattataaaattgttgtaacacaaaaaggcaatcaaagagcaagcagccaaagggtaggaaagaagtattataggtattatagagagttgtcaggcaggtaattaataaaatttaattttatcttgcttgactttgtgattattgtggtatttttcagtaattaaaaatttgtaattcattgtagtttccttttctcagactaaacaaatactttcatactaaatatgtatttaaattttgtattttttatgtgaaagagggctccccaaattgtttaagcttcaggaccataaaacctggacctgctcctggcaagtgtcatcacttaataacataggaaagacttgacatggagcaaatgattgttgttgtttggggagatgtaatgtagggggcaattaatagggcttttttggcttggttaagctagaaatgtccatttaccatcttaatggatgtaggcagttggataaatgggtctggagctcaagagttctgggttggacatgtaagttttgggtataattagtgcataactttaagagactgtgaagattcctaaggtaagagtttatagagaaggaaaagaagagaagaggattcctgacaaagctctgaggtcttcaacatttagaaatttagtataaaaacagaatcagcaaagagggccaagcagcagcaggcaatgccataggagggaaactaggcaggtggtagcccagaaaccttgataaaggattccatggaagaaggggagtcagtcaggccaagcccagctgggaggttgtcttagttcatttaatgttgctataacagaatacctgaatctgggtaatttataaagaaagaagtttatttagctcatggttctggtggctggaaagtccaagattgggcagctgtatctggtgaggggcttatgcttctataactcatggcagaatgcagagcagaagaaagcacatgcaaacaaagaggccatgcaggaggagtaatctcactttataacaacctgctattgcaggaactaatccattcctaagagagtgagaacctacccacgacattaatctattcatgagggatttgctcccatgagacaaacacctcccactaggccccatctcccaatacaactgaactggcagttaaacttcaacataagttttagtgaggacaaaccacatccaaaccatagcagaggtcaagaaagtcaaaggtggggttggtcaaaagcctcagccattggtgactctgacatgtgccattttcttagagtggtggatgaacaactctggagagaatttaggatagtcttggaggtaaggaagcaatggaccgggtgcagtggctcccacctgtaatcccagcactttgggaagccgaggtgggcagatgacctgaggtcaggagttcgagaccaccctgaccaacatggtgaaactccgtctcttctaaaaatacaaaattagccaggcatggtggtgcatgcctgtaatcccagctactcaggaggctgaggcaggggaatcgcttgaacctgggaggcagagattgcagtgagccgaggtcacgccattgcactccagcctgggtaacagtgtaagactctgtctcaaaaaaaaaaaaagaagaagaagaagaaaaggaaaagaaaaagagaaaggaagcaatgacagtggatatattcatcctgcttgaaagtatggctgcaaagaagaacagaaaagggtggtaggagctggaggaggtgtgggtccaaggggtgaatttggttttggttttttaatgaataatattaagcatatttatttgcaaatggaaatgaaccactagcaaggaaaaactgatattgcaggaaagaatggggataattgcagaatgatctagagtttgaatggaagcctttgcctgatccattttctctatacaacatggagagaatttggaatcacaaaatgactattctgactatcggggatggggcacaggagaaggagtaataaagatttgaggtgagaaaagaaatgtgaggtattcttgaagggaaacatgactttgctgtttctatactttattacaaaattataaactctttaggggaggccctgtgtgttatacatttatggaaaccccatagagtcagcatagcatcttgcatactctaggacttcaatgcgctcctgttgagtaggtggatgggttggatggatgagaagtgccttgtaggaatccaaaggaataaattaaaagacttcatcaaatgggggaaatttcgagtgatgaggaggattccagataggagggtggcatgagtaaaggtgcaagtgtagcttctcctgggaggactgtgcctggatctgaggagagatatgtgtgtttgagatgatgggagatgcattcatatgtgttggtgggataagcccaaataggttatgccttgcaagtgatgttaaagactttggattagcatgtgattagcatgtaatgcggtatccaggttgagattttttggaacttagttaatacagcctggacaaacagaacatttaaagccacaagtagttttcagtcattcaaaatatagaaatttaaactagaaagataaagacttctgtttttagggatatcatctcaagaagtctacagtacgaaaatgtaaaataaatactactttctaaaatgcagctactattaccccaagaggctggagattagcctagaaagtaccattattagaccaatgtgttatcattcaattgcctggtagggagtggggcacagaggaacatgtaaaaccccaatagacggagggtggtgtttctcttgaaaggagtgaacatcaccactgtcaattgccctgggaagaagtagatcctatgacaggaagtaaggattgagaaggtagactacagactagagaggaggagaaactcatctctttctgtgggcctctggtgatgagcctgatcaggctttgagtactttcagtggtgggcatgagcgtgtactttgtaagcaggtcaacatttaggcagaaggcagtgggttggcctgcagattcagagaaatcacatctaagttctctaagttctcttcttgtgcttccccaacccttgagtccatttcaattcactttcagcctggcctaagcaaggtggtagggagagaagaacatgcctgggacatgtttgggtcctggtggtgaagggcagagcagagccctttcctgaggcctgaatggtaaaagcatcatacatgtcaccatgcgccacagggcagtgatcccttgggaccacaggcagtagtggcaagggcatgaagtatcattattaaacataagagtctgtcataggggattttctgaaataactgagggaaactctacaagagcaggtggtagccaaagtcatagtttagcaatttaatgaaaaaattcttagtgtttaagcaggtgatgataagtcagtcctctatctccactccctgaatttggaacctttagagatttagatacaggagactaaagatgaaaacgtcaactttattactactagcactggcttggaaattgtcatatacacacagtaaacaaccagacagcagacacactcgctctgttggggcaatattcctgggggagaccacaaagacaagaatagcagcaggtgtgtggatccccagtgcccactgccttctaaagaagaacaaagtgatcggtggaatcagacatcaactttcaggaaagggactctgccctttgggctgagaaattttaaagctgcattaataaagaaatgccaagccctcctctggagtaagtagaggtcacagtacagtataaggataatataaggttctggcatggcagctcagggattgtggctggaggaacatgagctcctcccattgcataaccagaaagctaggtctatgcctggccattgctgctgtgtactgtggcaacttcacagtgtgaaggaaaaatatcttgggctccctaaatcactaagctaaagggaaaagtcaagctggaaactgcttagggcaaacctgcctcccattctattcaaagttatccctctgctcactgagataaatgcatatctgattgcctcctttggagaggctaatcagaaactcaaaagaatgcaaccatttgtctcatatctacctatgacctggaaactcgctccctgttttgagttgtcccacctttccagaccaaaccaatgttcatcttacatatgctgattgatgtctcatgtctctctaaaatgcataaaaccaaactgtgctctgacaactttgggcacatgtcaggacctcctgaggctgtcacaggcacgtgtgctcaaccttgcttggtaaaataaactttctaaattaactgagacctgtctcaaattttctgggttcacattagcatgacctgttcccccagcattcatgattgggaagccactgcctttctcctggcctgctcaggaggctaggtccaacccttgggattcactgggattggctgccttccacccacagctataattcatttccaaggagctttgcatccagctccttttctagaaggctgatgagtgagaatcagtcttggacacattagggcttacctttctgagccaccccaaatgagcttcccacaccttcttcccaaattgtcctcaccttctcagatctgcaggccttccagtgcagagggaagatctgcctaagtaagtttactggttagaggagcagaaaatgtatgtgtcctgaagcaagatgctgtgaaagagaaaacccagaaaaggctaaacctcagtccttcttccaaatcatcagcttagtcattcacctacccttggagaggggagcaaaggatagagaagctgtcagaaatattctagtttttcctcctggggagggaagcacaagtttcttgtcctctatggaaatgtgcagcagctttggatcaaaaataaactggacatggatggatggtggtgatggcttcacaacagtgtgaatgtagtaaacaccaccgaactgtacactaaaaactggttaaaatagtacattttatgatatttactacaattacccaatcactgtaaaaaaggaactggatctaatcatgcttttgattttatttttgctttgttttgaatagttaatatattcatatgattttaaatgtaaaaaacacaaatggccccttcataatcttttcctagctaatgcagtttcttcttcagaggcaaacaataaaaacagcattttcatattcttccagagatattttacgcattctctagcaaatacatgttttaaaaatttttgacacaaatggtattgtatgttacacactgttctgcaatttgcattttaacttaatgaaatttcttggggaatgctccatatcagtgtatcagagttccagcattcatagagctatacgttttcctagagcacagatttccgtagttggcttaaccagtcccccttatgtgcaaatatagatgtttttactcttttgttgttccaaacagtgaatatcctcttatgtgtgtcatttctcatatttatctactcataagataaattcatagacatggaattgtccaatcttggttttaatagttttcattataggccaacttgactttaatgctgttgagtagacatttggaatgcagtactaactgaccaagacctctaatctaacaagctatccagaaaactgatgatgtctttcttactcacagatcattgttccagtttcatatgtgcactaaggtgggaaaactgtcaaacagaccccaagaaaataatgtccattttcaaaaagcaactctttctggcagaggtctgattagcccataacacataactatctgattataaatgagctttcttaaaataatttttaatattttttcccactgtaatttttccatgtttctatgtatgctatacatttttgttttgtaacaattaaagggccctgacaggttagccagagaaagtaatatttattatctgtatattaagatgagaaaacaaggaacataggccaagggaagtttccacttgtccaaagtcacccagcaagttagtgggagagcctgaactaaaatgcaggtcacaacctaatcccatgctctgttcactgatccatatttgtcctttttgccagttctcaaaagtaagtgagctgttcctaaacctattgggtctagaagtggtctcagtttatgggcagctgacgatgtctcactatgaagaacttgtcctgatggtgtgcagctgctgaagatgtatagcagggatcttccatgggaggtccaagaaggctgatatcttccaggcttgcctataggtatatgtggctcacatgccaagatgggaacaagtaagtctgagcttggagaacgtttgatactgctaagcagagaagaaccaggggtgagtgaattttgtgcaatggggaagaattcttcacattgtgtgtaccaaaatgctatgaactattaatatagtcatgctttgcataacgatgtttcagccaacaatagatcacatatactatggtggtctcataagattatactggagctgaaaaattcctcttgtctagtgaagtagccgtcataacgtagtacacaatgcattattcatgtgtttgtggtgatgctggtgtaaacaaacctactgcactgccagtcatatgaaagtgtagcacatacaattatgtacagtacataatactggatgatgataataaacgactgtgtaactgatttatgtatttactatgctatcctttttattgcaattttagactgtgctccttctacttataaaggaataaaattaactgtaaagcatccttgggcaggtccttcaggaggtattccggaagagggcattgttatcataggagatgacagctccatcctgttactgccccaaagaccttccagtgggacaagatgtggaggtagaagacagtgatattaatgatcctgactctgcgtaggcctaggctaatgtgtgtgtgtcttagtttttaaaaaagtttaaaaagtaaaagacaatttaaaaatttttattagaataaagcttacaaaataaagatataaagaaagaaaatatttttgttcagccatagagtgtttgtgttttaagcttagtgttattacaaaaggttcaaaactttcaaaaaatttaaaagtttataaagtaaaaagttatagttggctgagtgcggtggctcacacctgtaatcccagcactttgggaggctgaggcaggtggatcgtgaggtcaggagttcgagaccagtctggccaacacggtgaaaccccatctctactaaaaatacaaaaattagccaggtgtggtggtgggtgtctgtaatccccactactcaggaggctgaggcaggagaattgcttgaacccgggaggcagaggttgcagtgagctgagatggtgccactgcactccagcctgggcgacagaccaagactctgtctcaaaaaaaaaaaaaagttatagtttaatttttaaggttaatttattattgaagaaaaatttttaatgagtttagtgtagcctaggtgtacactaggtgtttatagagtctacgatagtgtacagtcatgtcctaggccttcacattcactcatcactcactaactcacacagagcaacttctggtcctgcaaactccattcgtgttgagtgtcctatgtaggtgtattactttatatcttttgtactatatttttactgtattttttctttgtttagaaatgtttggatacacaaacactagtgtgttacaattgcctacagtattcattcagtacagtaacatgctgttgcaacctagaagcaataagctacaccatatagcctaggtgtgcagtaggctacaccatctagctttgtgtaagtacattctttgaagcttgcacgatgacaaaattgcctaatgacacatttctcagaacataactccatcattaagctacataacttaaacccctgctatgcaatgaaactcaggtagcatattaaaaaatagataactcaagcattgcatacagagaagccattcttggaacaccagacaataagcattgcattagatcagagcagttctgggcacatctatggtcaacaagaaatattctcaaagtctgaactttgagctatagtagacagacaaactaagaattcctcaaagttagtatttccaaccgtgatgtaagagtctattctgagtgttgtgacaaactatctccagatctcgctagagtaacacaataaaggtttgtttctcacccatcacagtcgggtatggctgtatgagggaggcgtgaggaaggatctgctcctcgcccatcacagtcgggtatggctgtatgagggaggcgtgaggaaggctctgctccatgcattcatggaagtggccttgatcaccagcctagcacttcactggcagggctcagtcaatgacatctagtggctgggaagctcggaaatgagctttcctttgtgctcagaagtaggacttgggcgaacacatagcagtatctctgctccatccacataaacgggctcagaacttaaatggaaagagacgctgaagagggcatcaaatatatgagaactggaacagggaaaggaacaaagatctgaacaggatcagatagagatatttgcctacagacaagtccttggttaaaagaccgtggaaattgattctagaactatatattatttatggcttgtgggacgcagaaatgtgttctggttacctgtgcaataaactgtacatacttctcatttcagagttggagtcaatcactctctgttggccttttttgctgtctttacaaagtcatgggttaacgaaccctactgggtacttctaacatgaggtgtctgggctgggagagtcttactggcaattgatgtcaagattcttcgtccagaggcacagagcagaaaggttcttggtccacagacaccttaaaacaaggccaccctggccaggtttattcccgtctggcggcctacacatttcttatatcctggaaaaactggtgagcaagcaagtgtcgacctcagagtctctgacagggctattttgaaaccacacaccatgaaaactctcagggaagttaaaaaacaaacaatcataaccaaggcagtttagctgttttgaaaagagatggagcttcattacttcaaacccaaatttctgcaagcctgacaaccaccttacatcaaaataaacgtctacctgctagctgaaatgtttaaaaacacaggtgagctctattctctgaaatacaagccttctctaacctgagaaatgtaaatacctatgaaggtgggtccatgaaggggaggttgatgaggatgggcctatgtaagagtgtgtgtcaaggttgttacttgtatttgtgttaccctgtggatgtgtgtgtgtgtgtgtttgtgtgtgtgagagagagattcagagcaggaagaggaaggcaactcacatggatccatgtttttcgtaacactgtgtgaaactccagttaattgactgtaaaaaaataggaacccacaagtaactgacattagtaccgctgaaaggctcccagaagacctaactcttgctggctccataatcacaagcacctgcaaagctctgccttggtgaggagagggcagagcacacctgctaaccgacatctgcctggaggaaggaaagacagagcttcaaccctgaacacagagtgctggtctctcttatgtgcttgactgtcatgctcagttgcattgtgcatgagtctgcctgtcagcctgcactgaattttgcagcactgttccagggtttactatctgcactctgttcccaaagacctgttgcccctacctgtgtgctcccggaggaatctggtttctataacaacagaccccatcaccagcgtggtgcacaaggccacctgccaatccattctgattaagcccagccctcagcctgtcccctccagacctgtcacaccaattcccattcaggcaccagcactgatcatcagtatttcccaagagtggaaaggggaaaatagagactcagtaaatatatgtaaataaaagcagagttttcgtaagccattctaatcttgatatagtttgcatttccttcactgttgctttataaaagccctcttaagcttgcagcaagaagaataggaagtcagctgtcaattagcttactatgatgttttctcagtcatattttgaaagagaagttgaattcaacattttccaaaaatctgcaaacagcagcatgctgcatttatggagatgacaccttttgtgggtttttctctttcatgggtaggatttttcggagagaccacactgggagaagagaataggtgaggagttgctctgtgagcttgctgcaatctggaaggaataaagttgcagaaataggaaattggaagcagaaataggatataggaaagtcttaaggactacgatttttgtattgcaactagattcacctttgcagccatccttttaacaagacaagccactcaactaatacatgctctgaaggagcgaacagaactgactaaactaatacagaagcaggggctcagtggctgcaggttgcatgaaaaattacccattgcagttgcagggccccattgtgagcaccggtcctctaggagaatgctgggctacttctttctttaccaattgttgctaagagcaggtgacctcacatgctgttttagcaactcttactactgagaattattctcttgggaagttcagaagctggcaaaataaatctttgtattcactctgcttatattctgacaacactgactaaaatcctctactttgaaaaggaaatattcttcccaggcaaatgcaactgatgaaatagattctctgtgtgtggatttgaaggtgttaaagtaatgatactaattgctttcattttgataagctttacaggctccagagttctctcacgagttccatttcatttgatatttgcagttaccatgtgaggtaagcagagctgaccttgactggcatctctatcagcagctcagtgggattaaatggcttgccaatgtcacaagcaactaccaaggggccacctgacagaacatggccgctgcagaggaaccctgctacctgcagttggtgacatggcctaggtcccagaggcctcgtggtgccacacacacaagaacaggcaccaacaaccagtgacattttgacagtcaaatggaacctgtgactgccatctgtagatgtgccagccaagaatgtgaccctggggaaagcccttcacacaggtctttccttggtgtatttatatttagttccagcgaaaaactgcagttgtttttctcagtgacaggcatcaaacgataaccgaaaagaatgagaaataattgttccctttctccctgttaggagattgtactctttgaatttgggaccacagctctctgaacagctagctctcccatgcctggctcatgagacatcataaatgttgattgtattaaagacaatttagagggaaaggacttgaattctggttctaagctattaaaaatatttctacattttaatttttaaattaagaaagattttgtacatatggaaaggtgcagaatataaaacagacaaccatatgcttaccatccagattaaacaactgttaacgttttctcgtatttacttcagatcacttgaaacaaaagaaagacaaaaagatacggctaaagccttggcccccttcactcacatccctcccctcctcccctctgcagagcaacttctgcctgaagctggtgtgtgtcatttccatgcatgatcttgtgctttcagtacatatttgtatatccaaaacaatatttactattgttttgtgtgcattcttaatttacataaatggcatcatattgtaaattctcttgcaacttggcttttcttactcaacagtacattttagggacttatttatgttgtgtggatacagtgtagacctagttcattcattttaacttaattgtgaaataccatagtttacttatccatttccctattgggtaaaattagttattgctttattgtcgttgttgtttattgcaatgaacatgcctgtgcatgcatctttgtgcacgtgtttgttagtgtaaatgccctgaagtgaaattgctaattagtaggaaatatacttctgcaccttccttagcagagacaaattgttctcccaagtggttgtacctatttgaactcatgctagattagaaatccctgtgttcctacatccttaccatcatttgtgaggctttcaatttttcttatccaataagtacaaatgacattttatttttttaattcacatctctctaattattcatgagcttaagcatttttacatgtttactaaccagttgtgtatgtgcatgtgtgtgcatgtgagagagagagagaaataggttttaatcctttgttcttttcttataaatttatagttgtatttattctgaagttcttatctgagttgaaaagtgttctcacaaatggtatcttgccttttaattttgtttatgtcatgttctattataaatagctttttaattttcatgtagttaaatttatatgtcttttcaaggtttgtgggcatttgtcccttagttaataaatctgtttctaactctacattcaagatattctcccacattgttttctaaaaattctaaattttttttcccttcacatttaaatttttgtccatctggaatttacttttgcttatgtgatgagtagggatctaattttatctttttccaagcagaaagttaattgtcaaggatgatccagactttcccgctgtttgaaatgtcatttctggtgttttttttttttttttttttagatggagttttgctcttgtcacccaggctggagtgcagtggtgtaatctcggctcacggcaacctctgcctcccaggttcaaacgattctcctgcctcagcctcctgagtatctgggattataggcgcacgccaccacgctcagctgatgttttgtatttttagtagagatggggttttgtcatgttgggcaggctggtctcaaactcctgacctcaggtgatccgcccacctcggcctcccaaagtgctgggattacaggtgagagccaccgcgcctggctgaaatatcatttctgttaaatacaaattcccatatataagtggatcagttcctagactctaccattctgttggttcatttgtctatccccacacccataccagaattttaacattattatagctaaagagcaagtcttaatagctggtgtggtgtttgcccttattttttttgttttagctcacatttgtttttgttttcattagtctttcctcttccagtattttaggatctgattgtggattcctgtgaaaaatgctattggaattgataaaggaagtgtacctaaataggttaatttggaaaaattttgccacttgtactatagttatctatggtaaatgtgatatatctctctatttaggcctcctttttatatttatatcatttaatatggatttataattttttctgtaaatatttatacatttttattacccatattatgaggtatttatagtgcttgctacaactgtaaatagcagcttctgaaaaatgatattttctcacaatttattgtagatgttcggggaccatcttaaaaatcagtttttaattaggtaacttgttgaatttccttattcctttcaatagttggctgttacttattttgaattttttaaactagataatcatagcatctaaaatcataggtgggaattgaacaatgagatcacatggacacaggaaggggaacatcacactctggggactgttgtggggtggggggagggggaggggtagcattgggagatatacctaatgctagatgacgagttagtgggtgcagcgcaccagcatggcacatgtatacgtatgtaactaacctgcacaatgtgcacatgtaccctaaaactttataataataaaaaaaaattaaaaaaaattaataatactgtggctcacgcctgtaatcccaacactttgggaggctgcagcgggcagatcacctgaggtcaggagttcgagaccagcctggccaacctggtgaaacccagtctccactaaaaatacaaaaatcagccaggcatggtggcaggcacctgtagtcccaactacttgggagactgtggcaggagaattgcttgaacccaggaggcagaggttgcagtgagccaagatcaccccactgcactctagcctgggcaaaagagcgaaactccgtctcaaaaaaaaccacccacacgaaacaaaaaacaaataaacaagtcccaaaaaacaaaacaaaacaaaacaaaacaaaattaatgatacttttatttcttccttttgaatcttgctttattgtatttctttacttgttatcactttactgaataggacttacaaagcaatgctaaataagggcttttgatagtaggcatccttcccttattcctgaacttaactggaattattttagagattcacaaagcataactttcactgtagatttgtagtagatcactttattgggttattatttttatttctaacatgctaaaatattttggttattaatgggtattgaattttatcaaatgcattttctgcatcttttgaagtgatcatattttgttcttctttattgtgtctgtgtagtaaactaccgtaatgacttttctattgttaaacttttacttcttaagtaatccagctttgtcataatgtaatatttttaaacactactagtttcagtttgctaatatttgatttcaaaatgtcacgtttataagtgacatcagcctgcacttttcctcttctgtattgtctttttcagtttttgttttcaatgttatattaatatcatataatgggttgaaaaactttcaatcttttcttttttctgtatcagattatacaaaatagaaatcaaatttttcttgaaacttggggaaaacttacctgcaaaactatctgaggtaacagctattttttttgtgactaaatttttaattattgatgaaatatttaaggccataggtttattcagcttttttattttttagttacattttctagaaatgtttttatctaaaagttaaatattagtggcataaagtcatatatagcagtctcatgtttttgtaaatgtgtgttacatctattgttacatatttttctttcccagtatggttcatttgtaccatttttctttttcttctaatcttagaccttcgttggccatctcagttgcttaattgttttctatttcactaatttttgcccatatctgtgtcttctttcctttgtattttcttacattaacagttttttttttgctgacttcttggattgattacatgtgttcattagttatcaacctttcttcttttcaggtgtgtgtatgtgtgtatgtatatctacaattttctctctaaactattgctttagctacatctccaaaatttctatgttctgttttccctttgtcattcaggtctattttaaaaatctccattatgatttctactttgactcattaattatatagaaatgtttcaaaatttccaaacatatggttccttttttggtttcatttttgtaatttattttcagtttaatagcgtgtgaaaagggaatgcggtctgtaggattgattcattttttatttttagatacttttttgtggccaagtatgtggtcatccaaaaataagttcaatgtgtattctctaattgttaagtacagaaatgttatgctcgagttattaaaaatgttatttcaaattttggtatgtttactaattattttgtttgcttgtgctatttagtattgagcattgtattaaaatatcttattgcggctgtggattgcttgacttttttgtgattctggtcatttgtggtttatatattttgagactacattcttaaaagtctacaatcttggaagttttagatcttcatgtggaacggtgccttgcctacctgtatgattatacctccgttgtctttaactcttcttcctcttggaactaagtcaggtccagggggaccttgatgccattgcttatgccccattcccgctgctcttggattgagggtttttgttttgttttgttttgtttgttttgttttgttttgttttgtttttgagacagagtctcactctgtggcccaggctggagtgcagtggcacaatcatggcttactgcagcctcacactccttggctcaagcgatccttctgcctcagcctcccaaagtgctgggattacaggcatgaaccaccacacttgactggatgaagttccacagcccacttttgagaagctggttttgctaactttgctccaggataccctttatgctgccacccatgcactgccttgctccatgtccactgctgtaagggagcgtttccacttattttgtgattcaacttttagccatctccaagctttgttaaaattagagattgaattttatttttcattcttcttggtgcttttggatgctttccatgaaacaccaatttttgctggcatcttcacactggaattttgacatgaagcctagagttaatcaatatctttgccctcctgctggacattaccatagtacctattcattctggtcactccttcttgaatcacatgctctctttgcctagcatgttagtgatacctcatttttataaccccaaactagtcaccattatattgttttgggatcaatgcctgtttagatttgcctttgtatttaatatttaccagtctctgctcctctttgcttctcacttcctgtgccttctcccagagaaacggagcttttggaattctttcagcagggaactgtgagtagtaatttatttaaatctgtgcttgcttgcctgatgatgtccttattttgctctcagtcttgaattttagtttagctgagaatagaattctagggtgtcagttatttttcctcagcactttgaagttgtctcattacttgtttctattgttgctatgaagaaatcagctggcagtttaatttacagttttacaaactttgtttgattttacattcatataagtaaaaccaactttgtgctcatcctctagaataagtattttacacctaaatttatctatgtattaatgtactaatatgtacataatacaacatatgtaaaataaaaaaaatgactacgtatatgaaaaagttttaaaatcaaaataaaaagcatttgcttttgctaaattgttattagttataattaataatattttaaagagttaaatgtagatattaatgcttcattgattttaaaatatcttgatttaacatttaatttgacactgctttaacataaagcaataggaagatctgggtttatgtttggcttattttgatgctggtttcagtggcaataattgccaataacaaaaagtttaattacctcacaaaggcgtgtgaatacaaataagaaaagcaatagctgcacttactaagtcatgatgcttattttttaaaatcccatttaccaactgtaccaacgtttttctttaaagtcagctattatatttctgtttccctttatgtcaatcaattcttgtgacaaacaatttggaatttgttgcatttttacatatttaaaaaatgtgttcaacccactaaaactctgaaacatttagaagcattatagacagattagaaaattctgtttctaaatttttttgtgttttttttttgcaaatatgaaaaaatgctcaacatcactaatgatcagggaaatataaatcaaaaccacattgtgatatcacctttctcctgcaagaatagctattaaaaaaaaaaagatgttggcgtggatgtagggaaaagggaacacttctacactgctggtgggaatgtaaactagtacaaccaatatggaaaacagtgtggagattccttaaagaattaaaagtagatctaccacttgaatcagcaatctcgctactgggtatctacccagaggaaaagaagtcattatttgtaaaagatatttgcacacacgtctacagcagcacaattcgcaactgcaaaaatatggaaccagcccaaatgcccatcaagcaacgaatggttaaagaagttatggtgaatactactcagccataaaaaggaacaaattaatggcattctcagcgacctggatggaactggagactatttttctaaatgaagtaacccaggaatggaaaaccaaacattgtacgctctcactcgtaagtgggagctaagctatgaggatgcaaaagcatatgaatgatacaatggattttggggacttggggaaaagggtgggagggggttgagggataaaataatacaaattgggtgtagtgtatactgcttaggtgatggatgcaccacaatctcacaaatcaccactaaatgacttactcatgtaaccaaacaccacctgttctttaaaaacctat

SEQ ID NO: 2232 - DNA, 296 bp, Homo sapiens
cctgaaggttggttttggatcagcttttgggtgaaggcccagatcataagaacctaagaatcttatttgacctggggtgaccatggaaacttagtcctagcttcaaattcagtcctaatctgggaagcatttaagagaatgattgagttgtgctgggtaaggatttcaggtatatttgagttgtaggccccaaaggagtgtgcccaaaactcccatggagtaaagagaagacagtattagaaaagtaagggggcatgagccaccactcctggcctaagctaactctttgaagtaag

SEQ ID NO: 2233 - DNA, 47525 bp, Homo sapiens
agctgcattttaatgacatttgtaaaagaaaaaatagtttctttatatagattcatatattcagcacttctaattttcttctttccttcttgcatatctgtgcttcaatctggtatcctacttcagtttgaagaaccattaataacaaattattatagcgtatttttactggtgacaaattttctcagtacgcatttattaaaaatgtttattttatcctcatttttgaagtatttccactgaccgtggaatactggcttgactttaaaaaactttcagtactttacagctgttgtttcaagatcttctggcatgtatttttttctttttttttggtttatgttttgttttgtttttgtttttgagacagagtctcaccctgtcacccaggctggggtgcagtggcatgatctcggctcactgcaacttttgctacccaggttcaagcgattttcatgcctcagcctccggagtagctggtgttacaggtgcacactactatatctgcttaatttttgtatttttagtagcgatgggatttcaccatgttggccaggctggtctggaacccccagcctcaggtgacctgccagcctcggcctcccaaaatgctgggattataggcatgagccaccatgcctggctggcctgtatttacttttctgatgaagagtccatcatctttcatcttttttcccttcatatgagggttttttttgatacattttaagattttctttttaccattatctttcagcactttgattataatatactcagtcaaggttttctatttacatggtttagggtttactaaatgtcttgaatctggagggtaatttttaaaacaaattttgaattttgaattttgttttttgcttctttttctctccctaccttttcttctctcctactttttctcctcctccgtctccttttcttcttcctctggattttcacaaatagttgaattttctgaggtaccagggctctgcttgttcttctcaatcattttcttttcattgtcttcagattggttaatttatattcacatgttttcaaattcattgaccctttattgtagtgtctaatctgctgttcagcccatctagtgaatttattcagggaaagtattttttattatagaattctcattagtcctatgttatagttttcttttctctcctgagatttcccaactcagcattgtgaatatattatttctacatttttctttaagtttatatctatatctctacatatatatctctatataaataataacatatccacctatatatctatatttatccacttttaaggtctttatctccttattccaacatctctatcatgttgggatttgtttatatcaactttttacttttgactatgggtcacatttttcctacatctttgcatgtctagtaatatttgactgtatgcttgacattatgaatggtatgttgtgggatggtatgtattgagtattttttttttctttgaggagtgtttagttttattctggcaagtggttaactactggtggcttgttttgattttgttagaatggatttatactttatttcaattttatccttagttctatggcatggccattattttaggtcacggtctttcctcctaggcatggtcattccagcatctcgaccgaatgcttttgttgctcagtgaagctttctcactctggctgcgttaggactttaacatctatgagcactgtttaatgtctccattcagatgagcactgaaggatttgtcactgctatagttgttctcttaagagtgtcacagaatactctcctgaacaaaagtagcccatcttttggccaagggcctgagggcaacctctgtgaagatttcttgcttcccctagtctgcgaagctttctctcctcagtacttggccacacaaattctagctaccttaccagcccgaaactctgatctgtgccttctcctctcagtaaaattgtcattctctatttggcctctgtctcccatgctgcccctggaaagtgaccccgggtagaaagctggagttaatacggggttaacttacattttccctttctctaaaatatgacagtcctgcaccatttgttatcaagtgcttgaaaataatgtgttaatagtttttgacccagttttataattgtttatggcagaaggataagtccaatactagttggactttgtcatggctagaagcagaagtgttgtttttatttaatattgcatacacaatctattcctagggttcctgacctaagtgactctctaaacctgacagttacatgcgttccagggagaggaagctaaaataaatggggataattttgctttttgtaaagagagagaaaaaggtattcgtatctttaaatatttgagtattttaaagtatttttaaaatttcattttaagtcttctacaaaaccttcattgaattatattctttttcttaaattagctctgaactctttggttatgtatcagaaattttcccctgtgtacctccaatctacctttttctgcttacctcctactttatctcacctgatgctctagttgtgttatactatttgttcttttaaaactataccctacctatgtaattttctctttgtctgaaacggccctcttcctttttttaaggcttagcaaacttgacatactacattctttgttacttatttctgcattactcatggttcttcagagaaccatggttcatggaactcatggttcttcaataggtgttgtatatcataatattatatctgtgtaatatataatgtaacatatgcaatatataatatgttatatatgtaatatatgtaattacattatatattatgtatacacacatataatctattatatatgtatgcacatatataggaaggaaaggaatatattatatatgtttgcacatacatatatacgtgtgtgtacaaatattatctatgcacatacatatatatacatacatatatatctgtacatatacacatatgtgtatggtctctgatacacctcacatcctgtggctcactcaagtggacacataaaattaaccatcccaatttccttttttctatatgtgtaattatatatacatatatatatacacactcacacatatacacatatataagtgtgagtgtatagatatatgtgtgtatatataatatacatatatagagagagacagagagagacagagggaggagatttattataagagattggctcacatgtttttggaggctgataagttccaaggtctgcagtctgcaaactagagacctaagaaagctgttgtgtagcttctgtccaagtctgaaggcctgaataccaggaatgctaatggtgtaagttccagtcagaaagctggcaggctcaagacccaagaaacgctgatatttcagtttgagtctgaaggctgaaaaagaccaatgtcccagctcatagcagttagacagaaggagttccctcttgctcagcctttttgtctattcaggtcttcaattgatggataaggcccacccacactatgaaaagcaatctgttttactctatctactgattcaaatgtgagtctcatctagaaacaccctatagtcatacccagaataatgtttggccaaatttctgggcattctgtggctcactcaagtagacacataaaattaacattccaaatttccttttttctattttcaaatgtgattttatcctccttttcatttgttcctatatctgacactttatacactttaccatgaataatcattattctgtcatgaataataaatgtctatttttcattttgagccccttttctacttagcacaattccaggagcttggacattattgcttcttcttctttacttccacacacaatcaattactaagttacattaattattagaatctgttcttttatttttatcatgactgcatttgccatcgtttagggttttacaatttgttgtcaggtcatattggttttctctgtctccatactagtaccagagtaatcctcctgaatcacatatatagcctactaggagttaaaatctttcaacagctttgatagcatttttaaaaatccagatttcttagcctgagcaacagttagtgtaattagcttgcctggtatggtttaggaagcataaactattacatccactttaatgcctattaagaaatgtggcagtggtttataatagagaagtgatgtagagatctatgaaagactttttttgatggaagaaacacaagtgaagtattttttcaggttataagagacagggttatattgcaatgaattattcccacaggaacaactgtagattagttatggaatcagctttcctttccattttttaggttaatattgccaggttttttttaatgctgtgtgttgttattggtgagatgaataaaaatatcagtaaatgtgttagaagggatataacactacaactgggtaaatacatgattgtctttgagtctatctgctctgaaacacaatggtggcattattagagaatagctatcactggaattaataataatgttcagaatctggctaatacataccttgattaattagttaaccccatcttagacacggtagatgagccattgtagtgtcactgaaaatacaggtgatagccacacagttgataagaatcaatctagcaaaatcctctggaaaagggatttagaagtgaaaaggcttgaagtctgctccaagttgagtaattatgttgtgagtttttctgagtgattcatttccctatgcctcagttttttccatttgtacaatgaaggcattgaactgtgtaatgtctgaaatttatatcaattctaatattgaatttgaaatttaagaaatatttctgattcgtgttttatatttttaaacatgtgtatcaatgcttcgggaattaaggactttaagttgcttaatgttatctattgtcaccaattcaactggtaacagctctaaagtctctctatgtactagacagcaaacacccttcttctctccctcagcataccctgacacttaaaaaacaggaaatgtgtatttttggatgttattcaaatttacttagaagtatttactcacttagaagcaatttactcattttgaagtatgctaagaaaggcattttcaaatcctgtagtagttggaaagttttttaaatcttggtttcattttttgacttcatttctggttctagtcatctacattctgaatgtacagaggcctccagtaaattttctagctaatacttgggaagcatttgtaagggaacagagtattatctcccagcacatgttgaagaaaatgataacagaagctatagaaaaaacagtgacagaagctatagagaagaaaatgataatttttatcgcagtgactgaaaggcaaccctggccagtgctgtgatgaggaataatactagtttcattggttaagttctagcattatatacctagagcaggtatttttaagaacaggttggagaacgcttcctgttggttttggattcagttgtgaattcagcaaactgtttagaatccagtatcatttctatgtggccaattttactgcaacataagctataatttgtatacatattgagatttgtccacaacaatataccattgtaaagataataacctgttataaattataataatcatttattagagacaaccttcctgaaataacttggtatcattgaggtgatgaaagagagacattgggggagtttattgcagaagcagagactctataaagaaaatggtgaacttgagggagttgagaactatgtatagtttgattgtggattattctattgtgatcaaactgaaaaagactaattcatagagactacttataaaaaacatttaattaatgagtcagatgctgatggatacatttacactgggagagagacgtcacctgctctactaccaatggaaattgccactctgttttctataaaggattccatacatggcttataaaaagccaaagagtcatcacaaggtttcttttgatatgtgaaattagtacagatagagttgggtaggtctaaggaacatttgtggaggctcagctagaatctggtttgtcttgccccactattgtttttttgagaccgggtctcactctgttgcccaggctggagtgcagtggtgcaatctcagctcactgcagcctcaacctcctgggctcaagcgatcctcccactgcagcctccgaagtagctaggactacaggtgtgtgccaccatgccaggctaatttttgtattttttagtagagatggggttttgctgtgttgcacaggctggtctcaaactattgggctcaagggctctgcccacctcagcctcccaaagtgtggagaattataggcataagccaccccacccagcccaccctactattttgtaaatagtcattggttattagggtactgagttagggttcactcatttgtcaataaaagtctattgagtagagactatgtgtcagaaatagttctggtctctagaaatacattggtgaatcagataaagttcctgccctcataaagcttacattctatcaggaaggaataagcattgaaccagggaactacaattaaacccttattctccagttgtggttttggtgtattctttatctgtcgaaatatccttttttttttttttttgaaaagtagcaatttctcatgacaaacatgttacagattctaaaatttgctgcgcattttaaatttctccttaatttatgaattatatatatataattgatttttccatagatgatcttaaaaagctgggatcactgtggtttgcacctaaagtattagtgatgataggtttaatttgtttagtgcctattgtaagccctgtagtgcggtagtcactatatgtataatatctcatagacttcttacaatactctataatgaggcattcttatctatatttagaggaaacaactgagactcagagaggtcatgtaaattgtctaagatgacacagctaataaatgacagaaccaggatttgaatcaaagttgtccagactcaaaagttatgttcttttccaccacaccactctgtccctcatttactaggtctttcctaaggcaataattacagctagctaattacatttcattctgaaatgaagttatgacttcttccttagtttatttgggtggaatccattcagagcatagagatccttatgcctttaatcagtcagattggactacttttcttttcaaaatctctgagatctaatttgtcttagagagtgtagccaagtggttcaacgtcctttgcccacagctcaaatgtcctctgaaagtaaaaagaagctcactatgagtagagacaggtaattccaactgtggatggatttgagaaagagaatattttttaatattgagttgagaattgtctccttaaagtaccagcatctaccacgctgaagaattacaatattttatccataaaagaaccctctggatattatgtggacaattttgttttcttctggaagctactttttctagcacctacagtttcattctcttcaccatgtgtcactcgcctcgggataggggccagctgagacaagctatagctatgggacgtaattcacagctttgctagaaggtaaacatttcacaaaagctatgcacatacttgtgaagggttttctgtgggagagaaagatcagtggttgtggaggaaagctttttcagaggtcgttgaaacatgactattcacagctgaagactgttatttgtgatgctcactgtcctttgtgataacatttatcatgtggatgcacatggtaaatgcctcctggaattcagtgccagggaaaatatgttggtaatgataaattggtacaattgtcttgataattaaggcttatacacaagtagttttgggggccagagtgcaagtgttcggttggtacctacataaaggaatatcctgtagtatttgattccccaggcagttgtagttggcacagaaatcccctataatgctatgctagagagtgctgcttctcataggtgtttctgatcattgtggggctcgcttcccttggacatggctcagttgatcttgcgtgagtctttgtaccagcttactgattattcaagttctccttaagctatctcacctgacttctcctccatctcctcttccaggaagaggaaaagtcaaagtccagacaaagtagttgcggcgattgccctgaaataggtgtctgctcttagacagacctgttgacttacagactgaatggaaatacaaaggtctgctatactcacgactgtaccctgattctgtgcccaagcttatacaacttgtgtgggctagacctggaatgagagtctaaaaagtctagctctagaatcagctctcttaaaacctacagtatagtgcttcactaataatactttaaaataataaaatgaatgtgaaatccagaccctacttctataaaaaaaaattgtaaaatttaaagtgttgtagagagaaatctatatgttttgttatgtgttaaatagctcttttggataactttaatactgagataaaataaatttacagtaaaattctcagaaggatgagataatttacatgagttcactgtccagatatcgaaacttactccttctaaaaattaaaatatcagagaggaaggcagcgcaagatggccaaatagaagccttcactgattgtcctcccagcaagaataacaaattgaacaactatccacacaaaaaagcaccttcataagaaccaaaaatcagatgagcaatcacagtacccagttttaacttcatattgcttaaagaggcactgaagagggtggaaaagagagccttgaattgccaacagtacccatccccctccccccagcagcagttctgtggcgtggagaaaaaaaaatctgtgtgcttggaagagggagagcacagtgattgtgggactttgcattggaactcagtgctgtcctgtcacagcagacagcaacaccaggcagaactcagccaaagctaatggagggagcaatgagaccagccctagcaaaggggaattgctcagaaccagtgaacttggggggcatgtgacctagtgagacatcagcttgaacagcaaagagagtgcttgcactatccgttccccagccccaggcagtgtagcttgcagctctgggagatacttcttccctccaccttaggagaggatagggaagagtaaagaggactttacttgccacttggataccagtttagccacagaaagacagggcactaggcagagtcctgagggccccatcccagaccttaattccaggatgacatttctagacacaccctgggccaaaagggaatccactgccttgaaggggagaacccagtcctggcaggattcatcatctgctgacaaaagagcccttgggccttgaactttcagcagtggtagctgggcagtactcgctgtgggccttgggtgagactcaaagacatgctggcttcaggtgagacccagtacattcccagctgtgatggctatagggagagactccgtctgcttgagaaaaggggagggaagagtaaagggagcttcgttccttagcttaggtaccagctcggccacaatggggtagagcaccaagcagactcttggagtcctcattttgggccttggttcttgaatggcatttctggacctagccctgaaccagaggggatcccattgtcctgaagagagtgtcccaggcttggcagcattcaccaacatgctgactgaagtgcccttgggctttgagtgaacatcagtggtagccaggcagtactcgccatgggtctggggcaagggtggccacaggcagaaactctgtgcttacagaaaagggagggaagagtgtgaaggacttagtcttgtggcttgggtgccagctcagccacagtagaatagagcaacaggtagattcctaaggtttctgacttaagggactggcttctgaaaaacatcgctagacgtgactggtgctggaggaaactcaccattctgaatggaaggacaaaagccagagtggctttgtcacctgatgattgtagagccctagggatttgggtgagcataggtgatagtcaggcagtggtaaccacagcccttgggtgagaccccagtaccatactagtttcaggtctgacccagcacagtcctaatagtggtgacaacaggagtatttgtgtcacctctcttctagcctagttagctcagcacagagctgagctgtttgggagaacgtaaggaaagagaacatgagtcttttcctggtaatccagacaattcttccagatctgatccaagaccaccaagaagtatctctataagtctgcaagaaccatattgttactgggcttggggtgctccctaatacagatggggctgcagtgaccagaaacttagagcacaacacccaagtgcctttgaatgcttggaaagccttccaaagaaggacaggtggaaaaaaaaaagactgtgaagactacaataaatacccaactcttcaatgcccagacactgacaaacatccacaagcatcaagattatccaggaaaatatgacctcaccaaatgaactaaataagggagcagcaattaatcctagagagacagagatatgtgatctttcattcagagaattcaaaatagctgttttgaggactcgcaatgaaattcaagataacacagagaaggatttcagaatgccatcagataaatttaacaaaggaattcaaataattaaaaaagaattatgcagaaattctggagctgaaaactgcaattgaaatactgaagaatgcatcagagtctcttatcagcagaataaatcaggtggaagagataattagtgggcttgaaggcaggctatttggaaatagccaggggagacagaaaaaaagaagaagaaaaaagaatgggccaggcatggtggctcacacctgtaatcccagcactttgggaggccaaggtaggcggatcattcaagatcaggagttcaagaccagcctggccaacatggtgaaaccccgtctccactaaaaatacaaaaaaaaaaaaaaaatgccaggcatggtgatgtgcacctatagtcccagctgcttgggaggctgaggcccccaacgtcaaagataaagaaaggatcctaaaagtggcaagagaaaagaaatgaataacgtacaatggagcttcaatatatctggtagcagtcttctcagtggaaacctaacagatcaggagaaagtggcatgacatatttaacgtgctgaaggagaaaaacttgtatcctaaaatagtagatccagtgaaattctccttcaagcatgaaggagaaataaagatttttcccagacaaataaaactaaggggttttattaacatcagacatgtcctccaagaaatgtaagggagttcttcagtctgaaagaaaagtttgtaagtgagcaaaaaaaatcatctgaaggtgcaaaactcactggtaatagtaagtatacagaaaaacacactatattttgacaccataattttgatgtgtaaactactcacatcttaagtagaaagactaaagatgaaccaatcaaaaataaactacaacaacttttcaagatacagatagtgtaataagatataaatagaaatagcaaaaagttaaaaagtgggggacacaattaaaatataaacttttaattagttttctctttgtttatgcaataggtgttaatttgtcattaatttaaaataatgggttataagatattatttgcatgttttatggtaacttcaatcagaaaatatacaacaaacacaataaaaatcaagaacttgaaacgttaaaacatatcgtcagagaaaatcacccttgctaaaaggaagacagacaaaaggaaagaaggaagagaagaccacaaacaaccagaaaacaagtaacaaaatggcaggggtaagtccttgcttatcaataacaacttgaatgtaaatggactaaactcttcaatcaaagcacatagagtagctaaatggatttaaaaaaaacaagacccaatgataagttgcacttttccataaagacacacataaactgaaaataaagggatggaaaaatatattgcatgcatgtagaaaccaaaaagagcagcaatagctatacttacatcagacaaagtagatttcaagacaaaaactatacaaagaatcaaagaaggtcattacataatgataaagaaatcaattcagcaaaatgatgtaacaactataaatatatatgtacccaatactggagcacccagatatataaaggaaatattattagagctaaagagaaagatagactccaacataatcacaggtggagacttcaacaccccactttcatcatcgacacatcatcctcacggaaaattagcaaggaaacatctggcttaatctgcacaatacaccaaatgaacctaatgtatatttacagaacattttatccaataactgcagaatacatattctcctcagtacatggatcattctcaaggatataccttatgtcaggtcacaaaacaagtcttaaaacattaaaaaaattggaagttatatcacgtatcttctgtgaccacagtggaataaaactagaaatcattaacaagaggaactttgaaaactatacaaccatgaggaaattagacagtatgttccttaatgaccaatgggccaaagaagaaatgaaaaaggaaattgaaaaaaatcttgaaacaaatgataatggagacacgacacactgaaaccaataggatatggctaaagcggtactaagagaaaagcttatagctataattacctacgtcaaaaattagagaaacttcaaataaactacctaattatgcttcttaaagaaatagaaaagcaagaataaaacaaacccgaaattagtagagaaaaaataataaagtttagagtagaaataagtgaatgtgaaattaagaaacaatacaaaaatcagtgaaagaaaatattggtttttagaaaagataaataaaattgagaaaactttggccagactaagaaagaaaagagagaaggaccccaaaaaaatcagaggtgaaaatgaagacttcacaactgatactgcagaaatccaaaggatcattagaggctactgtaaacaactctatgccaacaaattggaaattctagaagaaatgcatacattcctagatgcatataacccaccaagattgaaacatgaaaaaaaatccaaaactggaacagacaaatgacaaataagcagatcaaagcagtagtaagtcacccagcaacgaaaagcctggaacctgatggcttcaatggtgaattttaccaaacatttaaagaagaactaatatcaaccctactaaaactattcagaaaaatagggcaaaagggaatacttccaaacttatcatatgaggccagtattaccctgataccaaaaccagacaaagacacctcaaaaagaaaagaaaactataggccaatatccctgttgaacattgatgcaaaaaccatcaacaaaatactagcaaactgaattggattcaataactcattaaaaagatcattcatcatgaccaagttggatttattccagaaatacaaggatggttcagcatacacaaatcaatcaatgtgatgcattatatcaacagaacaaaatacaaaaaacacatgatcatttcaattgatgctgaaaaattatttgataaaattcaacatcatttcatgacaaaaaccctaaaaaaaatctgggtatagaagaaacatacatcaacacaataaaacccatatatgacagacccacagctagtatcatagtgaatggggaaaaatggagagcattgtttctaaaatctggaacatgacatggatgctcactttcaccattgttattcaacataatagtggaagtcctagctagggcaatcagacaagagaaagaaataaaaagcatccacgctggaaaggatgaagtcaaattatcctcgtttgcagatgatatttttgttatttggaaaaacctaaaggctgcacccaaaattattcaaattgatcaacaaattcaataaagttgcaggatacaaaattaacatacataaatcagtaacatttctatatgccaacagcaaataacctgaaaaagaaatcaagaaagcaatcccgtttgcaataactacaaataaaataaaatatctaggaattaatttaacaaaataagtgaaagatttctacaatgaaaactataaaacattgatgcaagaaattaaagagcacaacaaagaaatgaaaagatattccatgttcatggattggaagaatcaatattgttaaaatattcatactgaccaaagcaatgtacagactccatgcaagtccttcaaaataccaatgacattctattcttcacagaaatagaaaaaaaattttgaaaatttatatagaactgcaaaagacccaggaaaaagctagaattatccagctaaagctatcatgtgcaaaaagaacaaaactagaggaatctcattacttgacttcaaattgtactacagagctatagtaccaaaatagcatggtactggcataaaaccagacaaatagaccaatggaacagaatgaagaactcagaagtaaatccatatgtctacagttaacttattgcataaacaaagatgccaaggacatacattggggaaaagacaatatcttcaataagtggagctaagaaaactggatatctgtacgcagcggaatggaactagaccccctatctctagctaaccatatacaaaaacaaaaacaaaacaaaagaaaaaaaacggattaaaggcctggtgcggtggctcatgcctgtaatcccagcgctttgggaggccgaggcgggcggatcacctgaggtcaggagtttgagaccagtctggccaaaatggtgaaaccccatctttactaaaaatacaaaaaattagccgggcacagtggcacacatctgtaatctcaggtgctcaggaggctgaggcaggagaatcacttgaacctgggagtaggaggttgcagtgagccgagatcgcaccattgcactccagcctggggagcaagagtgaaactccatctcaaaaaaaaaaaaaggttaaaggcttaaatctaagaccttacactatgaaactaataaaagaaaactttgggaaaacactccacaacactattcttggcaaaaatttcttgagtaataccccacaaacacaggcaaccagaccaaaagtggacaaatgggatcacatcaagttaaaaaccttctgcaaagtgaaggatacaatcaacaaagtgaagagacaacccacagaatgggggaaaatatttgcaaactatccatctgacaaggaatcaataaccagaatatatgagaagctcaaacaactcaatagggaaaaaatccattaatctgaataaaaaatacatgaatatctgaatagacatttctcaaaagaagacatgcgaagtggtatataacaatatgctcagcatcactgattatcagagaaatgctaacaaaaactaacaatatgtcacctcaccccagttaaaatgatttttatccaaaagacaggaaatcacaaacactggccagcatgtggagaaaagggaatccttgtacactcttggtgggaatgtaaattagtacaaccactatggaaaatcgtttggaggttcttcaaaaaactaaaaatagggctaccatatgatcccacaatcccattactaggtatatacccaaaagaaaagaaatcagtgtatcaaagagatttctacaccctcatgttatagtaacactattcccaatagccaagattttgaggcaactgaaatgtccaccaacagacaaatggatgaagagaatgtagtacatatacacaatggtgtactattcacccataaaaaaagaatgagatcctgtcatttataacagcatgaataggactggaggtcattctgttaagtaaaataagccaggcacagaaagataaacttcacatgttctcactgatttgtgagagctaaaaattaaaacaattgaactcagggggatagacagtagaatgatggttaccagaggctaggaagtgtagtggcggggaatgaggatagttaatgagtacaaaaatgtagttggaaagaatgaataagatctagtattcgatagcagaatggggagactaaagttaacaataatttactatatatttaaaattaactaaaactataattggattacttgtaacaaaaagaaaggataaatgcctgaggtgatgaataccccatttaccctgatgtgattattatgcattatatgcctgtatcaaaatatcttatgtaccccataaatacacccagtatgtacccacaaaaactaaaagttaaaaaaatcaaaatatcaaaagcaaaaatcttattttatatatatatttttaaatgtcttagaaaattctcaacatattttacaatttttgttaatgtctcaggatcattattattaattttaatagttgtattgccctgtaaaatacactttcggagacttgttgacaacttgataggctttctggtgttatttgtcttcacacatgatggcaccatgtattgtgactttggagggcatgatatttgttggtttgttgtttgcttacttttttgctataaaatagttatttctcaccatatgttttaaaatctgtctatttcaacttttgcttcttgataagaggttagcagtccttttctgctaagagccagatagtaaatattttaggctttatggaccatatagcctttgtcacaatcactcgactcaggttgtagcctgaaacagtcatagacaacacagaaacaaatggctttggctgtgttccaatggaactttattttcaaaaacaggcagtttgctggatttggtgtgtgggttgtagttctagaccgttgagcgtggtgaaatagccgtgtagagtaatatgtaaaaaagtaaatagaatttttaaaaatgtaagtacatattgtattaggacataatgttaccctacaagctatgtaaaatttagtgctacaattttatgacagcatttgtgggtggttagatgtctttcttttgtcccttctttgcatcttctttcaggtttgtatctatgtggcagatatttggggttattgaatgaatgagctctagaacacttgcttcatatgaaaacgtgcatatgtatgtttatgtatctcagatacagctaaattcattgtaccaattaagacctagctaagattggtttgagctccattctatgaattttagagttcagtagtgcccaccccaaccaccagcaagttgtatgcaaattttcagtgtgagtttatattttcaaggtctcctctggctctgaattctgcttctgtcaaattatttcattttagagattgtacagctatccttgttctctgaaaaagtctcttggccatttctatacctcagactgcagcctcctaccatggtttttggttttccttagtcccttccagatggctcacaggagctccaaattcttctcacattgttctgcagattaattccatttcctccagtcttactcccaaatttctctctgactcctctgtgcatgttttgatctaccaagatgctttgctgaagaaagaagacctattctcccttaattgaactgtcttcctaagaagggagttttaattttaagtagaattttttccctatggatatatggatgaaagactaggtggatggatggctaaaaagatgttatacagtactgtatattaggatagctacttcatatggaggctagtaccaaatatgaaaaacctatttttagcttattatagttgattttgtgatctagatattattcagcattgttcttcaaatcccctgccatagccaaaacacaccttatatactatttcaggaagaatttttttcatttcttatttgtttcattttataacatatcctaataatgattttattacaaaaggagtcaggaataccacttcatatgatagtctactaaatcttaaaaatagaatataagatcataaattgtgtaaggtaaaagttagacttaaaatcaaagtatccactgaaacttacaatagtaaggtggtatttctatttggaggaatgtctccaaatctccaatattagaaaaatagttatcttattattattaaatagttctaaaatcggtaattttaaaatgattttattcaaaattagtattattcagtcatatatgaattatcagccactcttaattgtctacaaagagcactgcaaagaacatcaaataaacagatacatttttaatagactaaagagcatggtggttcatgcctgtaatcccagcactttgggaggccaaggcagggagatctcttgaggtcaggagttcggtaccagtccggccaacatcacaaaaccccatcttttctaaaaatacaaaaattaggtgtggtggcatgcacctatagtcccatctacttgggaggctgagacacgagaatctcttgaacccaggaggcggaggttgcagtgaggcaagatcataccactgtactccatcctgggcaacagagtgagactccatctaaaaaataaaaataaaaataaagagcttacatctggttttgtttctggaagtgatagaaatatgattaaatgattagaaaaaatcagaagtttaaaatataagttaattttttaaaaactcacatttcctgagcactacagtaacctaaaaccagcttctttgaagtttactcagtgtgttgaactgtaatggaaagctagcagctatactgcttatacttttttcttagaatcactagaaaatatttgaccataaaaaatagattctgagtaaaattactttttttaaacaaccaaacctgatccttttgtagttcgtaagcatgatgattgggtgttcacgtgtatgtgtgagatgtgccacccttgaaccttgtcaagacatcggcacattacccatctgatatgaaaaaaaaaaaaaccctgtcatcttataaaaattcacatttataaagaggaatagagataggacactgaatgctttgggtttgttttgtcgacatttatgttttcaagcaggcttgcttcatccaatttttatattcttttgaggaaaaatacactgccaggaatcacagtatgcaatgcaaattagacacagaactattccctatggactttctagcctatggagagagatatgcatgcagacaacagagaaaaatggggtcgcttctgatgtttggactggcccacgataaactttaataaactagaagagacatagaggacagttttggctaaggaaagaaaatgaacagaggctcaaaagttcaaaagtctatgtccaagtaaagcaagtgcaggcttacattttactgtctttaatttctaaattcaagaagctctgaagaccactgtgtgtgttgttgtttttccttaagctacagactgacctgaattgacaggaggctatttatagtctttatttgtcctacttatgagaatatttatagattttactgcagaaatatcaatgtatttcattataggtgcaggccccaacatacatggattttgctaatattttatacattaactgtattactttaaaaaaataccaccttgttccccaaaaacctgaattacaaaactcactcggccccagctgtttctggtaaaggattgtagacttgaagtaattatgggggaagtgatattatagaaactatgtccagaaagctaggtgaagattgtgccagttcttgaacataccaagttacagattttggtaatttgactatagattgtaaggaaccattatacacttttgaagaagaagtgaagtattcaaccagtttttatcaaaattggttgaatccctgagcacacgctattttaaattttttctccatgcaattacaaaaactctgagtaagatggtgtcagatgaaatgccttttgaaaatagatatttacatccatcatttgttttcttgtgatggtgtgtaggagaaataaggttagagaaaacaattctagatcatgtctgcagcttgctaagtgtcatgccacataaatatggtcagagtttgatgtccccaaatgactatgcattaaaaatacaagaattgtctcatagaagaaaaaaataaacaagcaaaaaaccataagaaatagtgatttatttcatatttgttcatgtttcttgctaaaaatacctgaaggcaaattccagaaaatttgtttctgatttggttaagaaaattgagaaattaaaaatgttattgtcattgttgtgtgtacagtgtatgtgtgtcactcatagtgagtctttaaactctgcctttaagaacaagcatcaaaagtttggtacaaaatcaatgttcacaaatcagtagcactgctatacaccaacaacgacaaagttgagaatcaaatcaagaactcaattgcttttaaaacagctacaaaaaataaaaaaaatacttagtaatatacttaagtaggtgaaagatctctacaaggagaactacaaaacaatgctgaaagaaatcatagatgacacaaagaaatggaaagacaacccatgctcataaatgggaagaatcaatatagtgaaaatgactatactgctcaaagcaatctacagattcagttcaatccccatcgaaaggtcatcagcattcttcacagagctagaaaaaaaaatcctaaaattcatatggaaccaaaaaagagcccacacagccaaagcaatactaagcaaaaacaacaaatctggaggcatcaccttgcccaacttcaaattatactacaagactatagttaccaaaacagcatggtactagtataaaaaataggcatgtagaccaatggaacagaatagaaaacccagaaataaagccaaacacttatagctaattgatcttcaacaaagcatacaaatacataaattggggaaaggacaccctattaaataaatgttgctgggaaaactagcaagctacatgtagaagaatgaaactggattttagtatatgctaatccagaatgtaggtctaatgctgagtgtctaggaagaccatggactaaaaacaactaacaaacaagaaagcactatccaaataagctgccatcagattaacacctcctaagcaaaagctacttatattcctcaactcaaggtgtcagtgacagcatcaagcgtgtggtagaaaattaaaggagggggttgatttcccaaattttatcttcacataacttcctttcaaaatataacaacccaaaatgttgttaataactttaagttttaaatttcacctttaagaaaagtattttcatttgctttaaaataattatacgttttaaaaatagggacgaccagtgggtgtttcataataggttctgaccggagaaaaagaaaaaaaaatacccaaacctcttttttcggaatgtactagtccttttgaagaagatcttctgtaaatggggagtccactaagtgctaatctctatgttaagcatttccttttctttctttcttttttctttttgccacaacaaacctcaaggcagactattagctttgttttgcaaatggggaaaatgaaattaaagttaagaaatgtgtccattaacacacagctgggacttgaactcagcaatgtgtagctctcaagtgtttcttgtgatgtcatctaagactttgacaaccaaactgatcataatctctacaatgtggagtggacaactgaaatgaaaacaggaaagaaaaaaaatcaccactctaataacgtgtgtagctgtaaactatcttgctgtccaatatttttcttatagttttaaaacattaaactgcagggctgggtgtggtgtctcatgcctgtaatcccagcactttgagaggccgaggtgggtgcatcacctgaggtcagttcgagaccagcctggccaacatggtgaaaagctatctctactaaaaatacaaaaattagctgggcatggtggcatatgcctgtaatcccagctacgtgggaggctgaggcaggagaattgctcaaacccggtaggtgaaggttgcagtgagctgagattgctccattgcatgccagcctgggtgacagaacaagactctatctaaaaaaaaaaattaaaatgcaattcagataccataaaatttacccttttaatgtgtacagttcagtggttcttagtatatgtataagtctatgcacccatcaccactctaattcctgaacactttcatcacctcagaaaaaaactccatgcccattagtattcacttcttatagaattttgatgaagcaaaatccttcaaaagctttctactaaaagtccaattttcttagatttctccttcaaacaaagacaattcttaaatattttatagatacagaagagaaattattaaaataatctcaaataacaaatgagcaatattgctgttgttgaataaatcttcaaggatgaaaggatgaaaaggattattactggtagagtttcccaaaagtcataaatgtcaataagcttctccaccatatcattaccacaatttttaaggacctacgatctggcaggcaccatattaagatattctatctcaatttattctgacaacaattctaaggaagtatgaatactcactctattgtacacatgaaaaccactgaaagaaggagcagtcgtctcatccagtaaatgtaagggttgagaggtaatcctaggtccagtttgatttcaaagctcaacctctaaacactaagctccaccaagtgagagaaagtggatcaaaagagaatgtagatgtcaaattaaaaaaaaaaacaggatggagagagaaggatgaacagaagtgggttaagggtacaaacatacaatccaataagaggaataaatgtaatggttggtagcagaataggatgaccatgcttgacaaaactgtattatcctcaggtgatggacattttagataccttcccttaattgctacccattagatatgtgtaacaacatttctcatgcacctcactgatatggtttggctgtgaccccacccaaatctcatcttgaattcccatatgttgtgggagggaccccatgggaagtagttgaatcatgagggtgggtctttcctgtgctgttcttgagatagtgaataaatctcacaagatctgatgatataagggggagtttccctgcacaagctctcttcccttgtctgccaccatgtgagatgtgcctttcaccttctgccttgattgtgatgccccccgagccaggtggaaccataagtccattaaacctctttcttttgtaaattgcccagtctccagtatgtctttatcagcagcataaaaatggactaatacagtaaattgataccagtagagtggggtgctgctgaaaagataccctaaaatgtggaagcaactttggaactgggtaacaggcagagattggaacagtttggagggctcagaagaagacaggaaaatgtgggacagtttggaactccctagagacttgtcaaatggctttgaccaaaatgctgataatgatatggacaatgaaatccaggctgaggtggtctcagatggagatgaggaaattgtgagaaactggagcaaaggtctcttgttatgtgttagcaaagagactggtggcattttgcctctgccctagagatttgtggaactttgaactttagagagatgatttagggtatctagcagaagaaatttctaagcagcaaagcattcaagatgtgacttgggtgccatcaaaggcattcagttttataagtgaaagagagcgtaaaagttgggaaaatttgcagcctgacaatgcgatagaaaagaaaatcccattttctgaggagaaattccagctgactgcatacatttgcataagtaatgagtagctgaatactgttccccaagacaatgaaaaaatgtctccagggaatgtcagaggtcttcatggcaccccttcccatctcaggcctagaggactaggaggaaaacgtggttttgtgagtggggcccagggtccccatgctatgtgcagcctaggaacttggtgccctgtgtcccagctgctccagctgtgtctgaaaggggccaatgtacagctctggccatgacttcagagggtgcaagactcaagccttggtagttccaatgtggagttcagcctgccagtgcacagaagtcaagatttggggtttgggaacctccacctagatttcagaggatgtaaggaaacgcctagatgttcaggcagacttttgctgcaggggcagggctctcatagagaacctctgctagggcagtgtggaagggaaatgtggggttggagcccccacacagggtccctactggggcactgtctagtagagctgagagggccaccatcctccagaccctagaatggtagatccactgacaggttgtaccgtgtacctagaaaagctgcagacacacaacaccagcccatgaaagcaactgagagagaggctctaccctgcaaagccacagttgccgagctgcccaagagcatggggacccacctcttgcatcagtgtgacctggacctgagacatggagtcaaaggagatcattttggagctttgagatttgactaccccactggatttcggacttacatggggcctgcacccctttgttttggccaatttcttccaatgcttgaaccctcattgtatcttggaagtaacaaacttggttttattttacaggctcataggcaaaagggacttgtctcagatgagactttggactgtggacttttgagttaatgctgaaatgagttatgactttggaggactattgggaaggcttgattggctttgatatgtgaggatatgagatttgggaggggccaggtgtggaatgatatggtttggctgtgtccccacccaaatctcatcttgaattcccacatgttgtgggagggacccagtgggaggtagttgaataatgggggtgggtctttctcctgcgctattctcctgatagtgaataagtctcaccagatctgatgattatataagggggagtttccctgcataagctgtcttctcttgtctgccgccatgtgagacatgcctttcaccttccaccatgattgtaaggcctccccagccacgtggaactataagtcattaaacctctttcttttttaaattgctcagtctctggtatatctttatcagcagcatgaaaatggactaatacacccataaatatgtacaaataaaaaaataaaaatgaaaataacagttcagtctaaatggattatttacataagcccaggatgctgaagatggttatctagtgctggctcctagaagcattattgcagtgattttcatatctacatattgaatgcttacaatgtgcacttgcataagaccatagaaaacagatctttctgatccttccatttttcattatttgttaattaacctataaaactagaaatggaaacaatggcaaaatctggaagtatacaacctttcagactaatactatgaacctcttctcccaggtctttgtctgttggtcttccaggatctttatcctaaactagtcatcatcttagtttattttctgttgttataacagaatatcacagactgtaatttataaagaaaaatacatttaatttttgcagtcctggaggcagggaaggctgctagcatctggtgagggcctttttgctgtgtcatatcatagcagaaggcaagtgtgtgctagctcaggtctctcttcctcttcttataaagccaccagtcccattgtgagggccccactctgatgatgttatctaatcctaattacctcccaaaggccccacctccaaattttatcaatatatgtttggggattgagtttctaacacatgaaattttgaggacacattcaagtcagcatcaatttaagggttccaaaggctccttttctcctggcttgcatttcttttggattttttcaagacttcctttatttttatcatacttgaaaccatgtggtaggtgtgtcattgatttttaggaaagacagaaggcatgacgcatactgcttttgttgtaactgaaatgtaaggttataataaatttgattaaggctttatcttcagtcgaaccatatggttaactctaaagaaacagaatcatataactattctgcaactcgggtaaagttttcaattcaattcagcagatatttattgaccatttcctatgttttgagtagcatctgtatattgcgaaaggcagaaatagtaatatttcatgatgaatgacttttaagacttaccatgaaagggaacaaaagtgactgtgtttgtgtctgtgtgcatgtgtgtgtgtgtgtatgcgtgtgtgtgtttataagcttgaggtgaggaactgtatataaagcatgtgcccaactaattgtgacacaaactatgatgtgataagtgcctcagcatttcctgattcctctggctaaatcaacacttctaccacctctttagacaccataaaatcatgtacttctccacttttgcagccgttacagttgtaataatatattagtttgcatgactatttggctaaattttcaagaagtactttggctttttggaaatcagagactattgtgtgaaagttctgtgctaagaaatatgcgcaggtaagctccaaagaagggcacctaatccagccagggaaggtttattgacagaggtgataatgaatccaatttttgaagggttggtgtgaactcactggaagaagaaagaaagcaggatagtctaagcaagtgaactatcatgtgcaaaaacatgtagacatgaacatggaagtgtgactcaggccaggcgcggtggctcatggctgtaatcccagcactttgggaggccaaagcaggcatatcacgaagtcaggaaatcaagaccatcctggccaacatggtgaaacccatctctactaaaaacgcaaaaattcgctgggcgtggtggcgcacacctgtagtcccagctactcaggaggctgaggcaggagcatcacttgaacctggaaggcggaggttgcagtgagccaagacggtgccactgcactccagcctggcgacagagtgagactccgactcaaaaaaaatagaaaagaaaaaaacggtgagactcaaggacatggatggagttaagttcatgtacggagataaaagaagacaagcaaatcatcgtaggttttatgtaccaaacttacactgtcgacttaatcttcaatacaatgaaaagtttctgaagagccacattctttagggacttaagttttggggtgattattttggcagtatggaggctaaattgaaggcagttggaatatttttgtaaatatgttgtagtaattaggcaagatgtgatcagggcctgaaggaaggcaagaataaagtgatggatgttagagatgttaaacaaatagtatctgtaatactctctgattggagataagttagcaagaacagtctaggatggctcacaaggctttgaatttggaaactggatagttagatgtagttgctcattaaaatatggagctcaagaagtttacagagaaagatacgtgtccagttgtagttattattattatttttttgaaatacctgtggatcctttagcagaggtttccagggaaacttggaaatggatgattaaatctatgtaggtatcttgtcagcagacacagatccaggagttatcaatagcgtaggaattttaatgtgtaagaagatgcctagtaacagtaaaaatggagaagagattgaagcttggtaaatagtaacacttagaggatggcagaaagagaactatgatgttaatagagaagtagaaggaaaaccgagagaaaaatgatgtttctgaagatgaggaagagtttcttgaaatagagtgatcaataatttcaacacatataattactgcatctttgtagcattaggacaaaatgtgtccattttatctggaatagccttgattatggtgattttataaaaagaactttggtgagattgtgcaagcaggaggcagcactcgggtttaagaaagaaaagaaatgctgaagtgaaggtagtacatatagcctcttctttaagatgtttgtatgtttgtggaagggaaaaaagagaggatagaaaaataatgcacaaaggagatttcaaaattccacatgtgccttttgcctggtatgtgagagtggcaactttggccttaacctgtgttctgcacaggcagaaagatatatacatacgtacacttgtgaatatatttgtgagcataacaatcaccttaaaggggctgaaatattcattctccaaattacttcatgtccaacaagcctttgatatggatcctaatgaacatctccagttaaccctttttctcctcctttcccacaaccatttgtattaggacagttaaaagcttgccatcaggaaagttagccaaagtcataagcttagactctttcctatgcccttttctgaaagttaacactaatagaaagctcagagtttactgtaaaggcaatgcttatttttattggtcagatctttaaatgaatggctgccttctgcttctaaaaagcagacaatttacagagaaaattcaatttccagggaaaggaaaaatgccctgaaataatttctatgcctattatcaagtaagtttgattctgatgctatcaaaaccaggggcagcatcatagtgtcttttggagaatgttgcactaggaagggggcaggggttctgagccacttagttgcagccctgctgctgggggccaggtgactttagaagtcactgtcccttttttgtattttttttttctgttaaaggatggagttagaaaataaatgtctaccatgagttgacttatgttaaaattttattccctaaaaccccaaatgaagtcattccacatatacatatcctttttctatctgcattttggaagaacctcttctttacaaatatcatgatactgctatgtggttttacatggtttgcatccctcctcggcaatcagaatcactcttctcatctgtgctatcattaccacaggcttcacatttctctatccatctcaacattgtttgtatagctatctattatttccatccctatgagatagtgagtccactgagggcagggttatatttaaacaaaatatgcactcgctaaatgtgcagtgaatagaaatgaatattgtttaattcatttaacaggtggacttaatagtatcttataaaatttgatgaaagttttatttggagagcttggataatacgaaagctaaaagaggttgggtgaatctttattatcagacttgggtagggctctttattactgttttggtgtctttaatactcaagattgttgaaattccagaagggcatgtgggaatcaaacatggtttataacaatcacatggaagtaactatttttcccaatgtcacctaaatgtaagacttcccatttaaaaatgaatatatagtttaaaagtaaaataagagtagcacctcagatttatggcactttggaaatttcttatcatttcctcatgcatcccttcatcctagaggataatgatcatcaatacttgaactccttttggtaccaacattctactgttaggctctgagaagttatgatgttcacttaggtcttctgattctcaaggcatcaagactatatcctgttgcaacttagaaataacatttctagtccctgtgtgtctccttcacattctggatttttgtattttaattaagcttagtaataaatatgttttaaaaatcaaagccaaatttatataactgatttttgttgtaatatgttatttattttgaagaatatgcatatggtacatttttaaagtataaaatggaatgcagtcaaaagtaggtctccctctctgttgtgttctgctacctaatctttctccctcagacgacaactgatgccaatttcttgtgtaccttttcagaaagagtccatgagtttataaacgtgaacgtatgcacattcttattttctagattacacaaattgtggcaaactatatttattcttttatatggttgttaaattcagtaataaatttcacagatctattcatattaaaaaaattgtagcacattactttgtgggaatataccaaaatgtaagttagttccttattgatagattagtatcactactatcaaatagtgttatcaacaatgttgtaccgactactttgtgcagttgtcactgttgtatgcttatgcaactatatctaaaataactaaataagaatttgccaaagggggaattggctttttaaagtttgaaggttagagacaaatagctatccataaaggcattaatgcttacttttaccaagaatgtatgagggttcccatttcctttatattctctctagtacaccaagttatcaaacatttttatccttgaaatcttatacggtattaatatttgattttggattatatatattatttcatgtgtgaatctgatgacttttcaaatgtttaaaagtaagttatatcttctatctaattcatatcctcactctaaattctttctgagctattgtttttaaatgtaatacagaattacaaatatttttcccaattggaaaatcacaaaaaagtcccccccgtttttttttgttttttttttttttgagacggagtctcgctctgtcgcccaggctggagtgcagtggcgcgatctcggctcattgcaagctccgcctcccgggttcacgccattctcctgcctcagcctcccgagtagctgggactacaggcgcccgccaccgcgctcggctaatatttactatttttagtagagatggggtttcactgtgttagccaggatggtctcaatctcctgacctcgtgatccgcccgcctcggcctcccaaagtaaaagtccccattgttttcatttcatcaatatttaaataaattatttcttacatattctaggtaccaagatatacaaacataaaagatatgaacatgaacaccaaaatttggaggcgaaaaggctcatagtctcttggggggaaaatatacatgtgcaagctgaataaaataaatcctataatagaggaattgcagtgtgctgtgggaactacgaggaagctgtgactgctttgggggaggcggggagataggagggaaagtttaccagagagatcgctgtggcttctatggtaggtctcaagaaatgtgtataatttatagggtcagagacgtgttcaggtgataggagaaaagggtggaaacacccattttgtattgtgcccctcctttggtaatgagttttgactaatgagcaattgctttttttccttgacattcataagtatttattatcctgaactgattgacctcatattttgcaaaataaacagctcatattttactatgatgatttaaaaacattttccttccatttgaattagataactcatctttaaagttttcttatggctaacgagctcgtgtttattcaagacaacttgttacagtgctattagaagagatggaaaacgtccaactgcagccccaaatcctggaggtatctatttgaagataagaaaaaagttctcaaacaaatgacaaaatgttcaaactcaatcataattagagatatgcaaattaaaacattacaatcacactgacataaatgaaaaagtaggacaatacattatgttggtaaggctgtgggcaaataggcaatcatatattgctggcaggaatctaaattcatacaagccttctggagtaaaattcagcaatacttagcataaatatctatacacatacttttcgacccagcatttctttttctaggaggctaccctggaggcacacagagtgtatttctcacaggagtattggttagcagtgttttctacaatatgaaaatgctacacacaaggttacttattgcagcattgtttataatagtacaatactggaaacaatcaaaagaccactacatagaagagtgtgtgtgcatttgtacaaaagaaacacaggcaagataaactaaagaaaccagttacctataggcagtgcatgggaaataagtggaaaaaaagagggaacaggaactggccaggagggataatgagggaataacgattatcaagctatactttttggtaaagctttgactctaagtaccatagtaacgtttcacgcacccaaataaaaaaaataatttaagtaaactaaatctagttaaataattaaaatcaatgtgtatggaatataagtttacaaatgaataaccaaaccacactgaagaggatgggcaagtaaagaagcaacctaagtcactttcaaaagaaaatagtattttgattggatactgtaaagttcaagacaaaaataagtgtacataaatactgtactcttgtaataagtgtttctcacaggagtatcagttagcaattctctaactaccttaagtgtatagtaggatttaataaataagtgaatatattataaataacggaagtcaggcctttcactgtcagaaagaagttacaaataaggaaaaggcaaaaaataaaatgaacctggtggtattgacttaggattgaagtattaacgatatctatctctatctctagctctacatgatatatcagaatctatctaaaaagatataccgatagaaatgtagaaataaatatgatgtacgtgtatgtgtatatagatttcctagctctctctgctgagaggacctgagagcaataacaccccagtaagaatgaggacacttagcgctcagatgttggttgctattgttctccaaagaaagaacccagactcatttggcaatcatttgaatccagggctagggtagaggggacaaaataaacttggaacattatgtgatgccaaacaattaaggaactgctaaaaaacaattggggtatgtcaaaaggacacaatagcaaatcagaaggatctcccaatggctaaagccagaacaattttagccacaaaataaataatgatagtattggattataatccttagaataaatatccttgaggccatactgatataaataaataactgaatacataaataaatgtaggagaaggaacagctcttacagaattcctattactttagacagaataaaggaaatacaaaagtcactgccgggcaaactgcacattaataattgttgcaagcaagatctgtcaatggatgctaaaatcagtggataaaagtttgaggaaaaataggacattagcacagcatcaaagttttttcctcaatatatttatcaattataaatgaaaaaaatgtaactttacaatatggaaatctagtagacataactttaaccaggcaatcaaggttaataccactaactgacatcatgtaccctcccccctgccataatgatatactaagaaggatacaacatcacttctatggcattcttgccaaatgaataaccttagactaatcattagaagacattggacaaatccaaattgaaagacattccgcaaaatatttgaccaatacctattagaaatgccaaggtactgaaagacagggagactgagggaccatcacagattgaaggagattcaagtgacatgacaatcaaatgcaatatgggtcgtagttggatctggtacagaaaaaggacatgagggtggggaagagctggtgagagctgcatagctggtgagagctgaataaagtttgtagtttagttaatcacaaggtactagtgtaaatgctctgggtttgatatttgtacactggtcatgaaagtcattaacattagggaaattgggtaaatggtatgtatgaactctcagtcttattttataacatttgcataagtggaaacttatgataaaaaagtttggaaaataatagaaggagataacgaagatgaagaagatgaagagaaggagaaggaggaagaagaggaacaggagtcagggaggggaaggaaaaagaaataaaaaagaacaaaaggaagaagagaaattttaaaataacatgtttgcttttttaaaaacagtatcaagattgtatttgaaggtattgctaagatgagagctacaggcatggttttgtgccctttcagagtcaatgggctatatgcataacatggaacaaaaatgccatgttagatatcgtactgattttcatcttttagtttatatgttggtttctttgtgaaaataaatttaatatcaattcaacagacattttgccattgatatattcaataaaagttttgcaacctggcatgattctttatatgttattaccaattcaacattctcttccaaacagataaatatactgattaattgcacagctgatgccaagagtgaacagatgcctatgtttagtcttaatagaaaaatatcttagataagtcacaatttaaatatctcaaaactcccttacacaattattaatttctacaaactcttagtaattatttttaaaaagaaaaaatttaggtactaggaattcaaacacattcatccatcattatataccagaattcctaatccttctcaaaaagtgctaacttattttattttgaagccacactggtgagtcacttgctataatttgtccaagatgtctaagtcaattagaaaacagaaagaatggctaactttaaaaaatcccaactacagacagataacataatttaaaatttgggtattaaaacaataatatatctgaatataaaattaaaaatattattgccagtaaaattttgagtttggcttatgggataatacacagaaaggagaaaagatgaatgttcttgttcaaactaaaatacatcactttcttacccttcatgtgctcctggctattttttttgttttgttttgtcttttttgggatgttatgatacatgtaaaaatgaattctgatatattgctcaagatacttcagaaagactgtactctgtgtgcctaattgtggaagtgggtgacaatcacatgaggagttgctttaaaaagcatgaacattgaaatcctgataagtgtaagagccttttttaaaaaataaaaaactgtctaagtaatacaattctactgatcaagtccctttcatacttacttacaaagtagaaacttatgttgatatatacttacaaagtacgagcttactattatcaaatgtccatactatacagtaagaaaatattttgcattaaaatgttacgtgccctctgaactcacctgaaagctcaataccaacaaaacaatctataaatgtaatacttcagtttgtttttataagtactgtgatgatccatttcctctctggtcataagaatcactgtgatagccatttaaacaatacagtacactatttgaatattaattgtactgagttgtctttcctgctttgcatcctaaaagtttacaatcctgttgtggagtaagaagactcacacataaatgcttcctataatcaaataacagagccactgtattagacgtcaatagtctaacacccagaacccagggaagttggtaataacaccttatgttgcaaagataattaaaatcttcaaagcactttcacatgttttacctaattgaactcttgccacaaccttgccaggaggcagagagggttgtgataaatataaaaactgatgctcaggaggtcatatgtgttttaaaatcacacacggacctgttcactctgctcaagtgccgtcgagggaaccacagcattgtcctgttcatttgctatttttccaggagtagcacttccctcaaagtaaggaaatagctctaggtattgggttccagaataggagagccctaccggaaaaccgtgttccgctgcagcacaaaggactatttttagatgttttccttttgctaattgtctctccctctgtggggaatttctatgggtagaatcccagatgagccaattttctcactaattctcaaagagacaggaaagatgaagaccatggctcaggttgccctggggctgcataacttcttcggtgatgtcactgcagtggttttaggaagatcttcaaggaccttggagcttaaagagcttgtgataccactgaacaacaggactaagaggcgactagaaagaaaggcctgggcatatcttcttgaatcttggaatcaccccaaatgacctttcctggagcttcagctttgaaaggagctaagagggtgtgaacccaggtggtggctgtaaactcaagcggccctccagatgttctggtttttcttccatcacctctgagagaaaaaaggaagagacttcttccaggcaacttcaaacatcatttcaagtgttagggagccagtggaaccgcgaatgtttagcctatataagagaaagagaacaggtgtgatgcaaaccatttttactcccttgcagggaagagctaaccagttagtgctaggcagccttgagacaatggatggaacaaaggtgaggtcagttgttggctcaacctcagggaaaacctaacagttttcgtgcaatgaattacctagggagctgctgagttcactgtcacctggattattcaagcagaaattcactggtatgaacactggcattcatcggaaagtgaaaatgattcacaaccctacaggtggggtctaaataataataattgcaaacactattttagcacttactttaaaacaagtgttttcttaactctcagggggtgtgtgagacagatgctatctttaactttcttttaaagatgagaaaattgagggacagagcggttaagtaatttgttcaaggtcacacacctagtaggaatttgaacttaacgctgcttgtctctagtgtctgtgctcttaatcacttgtattgctaagtgtcccctaaagtcccctcttgccctgagattccacatagggttacgtcctgtcacttcgacagcattcttcccatgcttactcattgcacttccaaaagggcattgttggcatcaggaaaagaaaaaaaaaaagagtcaagggggctgctgggaaaaaaaaatcgagatctttaaactcatggagaagctgtttggtcatcggggcgggctggcagaggcaaagcctgccagaatactggcgccaaagcgaagcgctcttttgtcttcagatttctcgcctcacctgcctcctctccctctgtcccttctagctccacttcccactgcacctatgctaagcttttctaggagcctgaaaggcacggggacaaacaagcacgccgctgccaatcctctatctcacaccctcttccccacccagattgacggggagacgcccagggtggtaagtgacttacccaaggacacagagccccgaccagaaaatccaggtgtccagactcccacatcggcactctgtccacgcctacgcacacctgacttctcatagccggcacccaggagctttctttattccacgtccccgcctccctaccccaccccctagttccctagagtcgcttctgacgctctgcagcctccggggtccagccctccctgcgggtgcttcccttccgccggattcccacaccggagtcgcccttggccgcgcgcagcccgcgggaccgctgccttccgggctggaagccgcgcagccctctcagcgcctcaagcccgggacggctgggacaccgaggtagtcgggctcccagggcacagggtccggcaccgagggcaggagcaggggaggtgccaaggaccccggtccagaaggcacctgtaaggaagcaccgacccgcagtgacgtcctccgcgtcgtcctcagaccagccaccgcctccggaaggtctcaaggggccgtgctcgagcccaccgaggggtggcagcgcctcgggctctcggagggctgcccccggcggaccggcacttccgcgtcccggcccgccccctgccggcgcccgggctccctccggctccatgtgcaaactcccctccacctgggcgcgcgcgatggactcgggacccggcttccgaagacaggccgcctgttggttggactactagcgcaggtgggcggggagttgaccaaccccacacacgcgcttctccatgaagattcttgagctttctctgaagaaaggagtgcatatgctgcagtgtctctgtggaaggagcctgaggtccagcgacagcccaagtgaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttgaaaaaaataaaaaagaaacttcaacactatgggacactggctcttttagcatgaaatgacttgagcttttgtagtgatgatacacatacacactcatcagtaaaacgatggtttcataaataacacaattgatgcaaatcataaaaatcaattacaattatgatttcatgacaaaatatatttaattaagtttgttatgaaaaaaatagagatatgaatcactaacaaaattcctccattttcagtggctattcatcatttatcatctagactcacatttgtctccttcctgatagcagttaagaaaaaattctaaccacacaatttgtatattgtttttctccgtattatgttaagcaaatgttcactgcagtaaaatgttttggaaattagctttgtcttatttccagtttagttcagagaattaattggaaacctgatttcttttacacataaacctgacaaaaaatgtagcttagagcaaagggtgaatgtttgcttaactcctgcttacttctcaagtacatgaaaactttaatagaatatgccagtattcactgagtttttaaaaatattaccatgtgtaaacatataatatccaacttcatccaaaaatatggttgagtttaagtactttgtttttcaggcttatttcaagtataataattctttgattttcattgttctgatttctgggtcttcaattcattcgtcacttttcctttttaagtaaaataagcttttttttttttttttttttttttttggagttgcattgggatttttcccaggaaaaaatatggcttttagtaatgctttgcaattggctacgcagatataaattaagatatgtttattctgagttcttattggaataagtttcaaaatcaacgagcttaagaatgaaaacaaaacttttgagagtctcacaaaatagctttctggtcaatacaccttacttgatttttaagctcgcagaataaagtatagaaacaaatggagctgaagttccatttgctaattcagagacttttgtgcttccgcaaattggagggcagcaagccatcctattctcatagtaatcgttttggctttgaaatttacatacaatttaatagcacatttttagccattatggattggcgcaataaagagatatcaatgtaatgcaatgtgatgctttatgggcctcattctaattcagaaagcttgtttaaaagaactaagactcttctgtttaataaaatagcaacaatctaatatctagattggtagtcctgcggtgccactagtgggagatgagagtattaagacaagagtaaggacaaggaaagacttaaaggttgcatattgaaaagtttggaattcctaatttgggagcactgatttcttggtgaagaagtaagtatgactacgttgccagtaattttttaaaaacatagacccagaaatagcaaatcgatttcaccctcataccttagtctacaaggccttgctcttgagaaggttttccatgatattgcttaatttcatctgcacaagatgagacacaaacataaaaattccctgctcattttaataccataaaaggctgaggttatttctctgtcataaaattgtaaatagcattttttaagtcaaaattacatttaaaacagtggattgttctacaaatatatatgtgtatatatacatatgcttctgaaataaggatatattatatgagtttttatttgatttgtggtctttagtcataggtaatcaaaaataaagagatttgaatgcaaaactttatacattaatgtacatttctaatgatggtacaaattgccactttataataaaaaagaaacaggtgggaataataatcaaagcacgtgttccttcagtactttggtgatttttaatcccccttgtgatgcacaggaaattattttttagttacaaaaagttatcttagaaatctatacttcccaatacagatttcatgttaagtcatatcaaattgagaatttgtggtgaaagaataggaaaaggatgctagatgctgatctttctttttcaggatttttcctggagcccaagttaaaaattcaatacttaaatctaagttaagtgaaaattaataatgttcagaatgatgtattgagctttagtaacagacggaagcaaaaaaaaataagaatatttaacattatgataatagccttaaaataatgtaataaaaattgcatcattaaatgttctattagttggaaagaatgagctgatgtttctttgtctttgctccaagtacaatttaaagacagtgacattcattttacttaaaattgttcaaaaagtccaaaacatactcccatggctagaattggtattagctccaatacaaggttaaatgttacaatcttaagaaattattgacactgaaatgtttagtaaacatgttgtatgagaaactaaacaaattaatgtttcatttttccattaaagcacagattattcaaatcattgttttctgagctcagatttgtaaaacgtttatacatcattaccctcctggaattaaaaacaattaaaatcctgagatgctcatgcacgtagacgaaatactggcacttttttttaaacattaaacttctttgagaagtctacctttttttttttagtgtgtttatcctatattgctgaaaaagcgctgtgtctttttaagaaaaagatcaaaaattgatttacagatgggaaagatgtctaattttgtagaagagttgaaagaaaagtaaatgtttctttgtaattacgtagctacttgtctcaacctgacatcttgctttcaaggattaagaactaaagtacgttcatttattcttttattcataacataccaactagaggctcagttgagtttaggcatcatacactgaattgcaatctcaaaacaacaacaacaaaggcagacacataaataaataatgcaatacctaaaagtatgtgctatgataaatgcaaaaaagattttatataccactgaggaggcaacaaaggcatcatcagggattagaggcaagacagcgattgaaaaagaacagatatttgctgagtgataaagggggacgacaaaggcctctcaagtagaggaaatcatttgaatgaaagatggatacttggaaaacagggcttggttgggaagaatgttcagaaaaggaggtggaagaaaaactgagttgagatcaataaaaacgaaaagttactcaaaggttttcaatacagcctttgtatttgtttgaacatctgtatctgctaggatgcttctggttgctcagacagaatccccaaaccaaactggcgcttcatctcgaatatctaggtacacagcatcaccatcgaggcttactttgtagttctctcagctctgtccacctccatgtataacttctcccttagaggcagaatttcctttagtagtttcagaacctgcatgcttatatcatctattctctattagaatcccccagacgacatcttacatttcgttggcctgatttagatcatctgtccacacttcagtgactgaccatggccagagacttgagatatgttgactagtgtaagtcaaccaagacctggaggttggattgtcccccaagatacaagtctgcatggttgaggagtaaatatttgaatgcaattcagatcccttttatcaagaggaaatgtaaatgaagagcaaaaagtagcaaatctccattactaatgaatagatgtattttctatcacaagtcattggctattctaaaaatccgcagagaaatgcaaatattgattaattaaagctactgccataaaccataagaacaaacaaaaacattgacaattcaattccctaagcattattaagtgactgctatgaagaaggcactgtgcaggtcactgatgaagagataaacagctgcaattttaaagaaaagtggtacatttgacaataactcgatatatctgatatgttcaatgcttttagatgactctcatggagggggttagaaaatgcagcttgcttattctagatcagaggttcatatcatacctacttttattcatacccatgcaagcactgctaggattaggccattagaaaatgctgcacttcaaaatcacctgcaacaaccgtgcatgtctttctttcttttttttttctttttcttttctttttttttttttttgagacggagcctcgctctgtcgcccaggctggagtgcagtggcgcgatctcggctcactgcaagctccgcctcccgggttcacgccattctcctgcctcagcctcccgagtagctgggactacaggcgcccgccacctcgcccggctaattttttgtatttttagtagagacagggtttcaccctgttagccaggatcgtctcaatctcctgacttcgtgatccgctcacctcggcctcccaaagtgttgggattgcaggcaccccacctcgcccgaacgcgtgcctttcttgaatctcctctacagaacatagcacgtgttttgaacactttgaatgacactaagtgtattaacaatccaaactaccctattccatttgtgagaagtattggttttatatttatattggcatcaaaaccttgggttaccatctttcaaaaaaagtcttgattttccactgactttcaggtttgtttttttgagaggattgaatacattttatttaaaagtaaagtgcatcttctgagcacatactttcacaattgtttttcttatgagtataaaataatattgctgttgtcacattatttttctaattcattttgacaaccttatctgaaagacaatgtatcttaatttctgtgctatgtctcttatatattatacctacttgtgtattaaccttgcctacccactgcaatttgctgtcttgaaaaatatgttcctgacccagagaggcacacaaagacatacacaagaagaacattgcaggaggagtatttaatatatgaattgcatgtcagtcatgctatgacttgtctctgatgtcattttccttgcctgtttcatctttttgtttcttatatgcattttcggttgtaccactgcttcattgactgacttaactctgaatttgttgatgatatttttccctagtgttttgagtaattattttctatgctgacggcttcacctcataagcataccctcataatagatctgattggtactttacctttacaaccaagaaaatagtggctaaattaaattggaaggttgtgggtttgtttgctttttgtgtgtgtgtgtaatgataagcctgaatacaggcattccacatgttatttggaccattcaaagacatcatgaccgaagtctctgcaattcaatgtactttttcttcaaagtaccatttattcacagtccaaaatggctgctccagttgtaggcatcatgctcacatctaggacacagaaaaaaggaagacagggaggtggaaatatgtggtacctctaacatggaaacatcttttccagaaacccccagcataggtctcactggccagaactggaggttcgtgggtaaggaagaaaaaggaattgaaattgggtaaggaattagacacttctatcacaaaatgtgaactgccctcgaggtttgtactgggcatattcacaacctcttccattgtctagtacgtcctcctgctgaaggtactaacaccaacaggctataaggtctaggttaacgatgtttttgtggtccaggatacttgtttctctggcaagttgagccactgtcatttctgatctcctgtacgacaaggaaaataactaactaacctacatgctgtctgggtgttccctataagaaatcaaagagaggcacactggatgtatgaggagatgagttctttctttgaacagtgtggattagagtagcaatattctctaaatcgtataccaagaaatcttggtcagatcaccctagaatgatagagcatagatgctattacttcaccatatctagttcactaggagaatgatcatcacaacaccgcaatttgggggtctcactgaattagaaacttgcccacactactagcagatgacctgtgctgggacatctcagcccaaaggtgaactaatcatggaattatggacaagagtgatatgaatctgctttactaactcactctccatcttaaatgccagagctatttctaacctggctcgaaacaagtgactgtgacctgttagaatatagccagcataattgtccatggacttggag

SEQ ID NO: 2234 - DNA, 684 bp, Homo sapiens
gtgattgtccacttgcctttaaagtttatcctcttgatcactgtaatttgtttatttgattcaaatatgttgtcagcaacctcatttgaggtgttaaaagataattttcatataaggtaaaatcatgtatttcatacagctacgaaaatgatcactttttaaatatttattttattttttattttttagacagggtctcactgttgcccaggatttcagtggtgtgatcgtggctcactgcaggcttgaactcctgggctcaggcaatcctcctgtctcagcttctggagtagctaggactacaggcaggtactaccatgcctggctattttttaaagtttttttataaagctcccatagactcagaattcgatacaatggaggggctgctggtgctgtggacaatgaggtggttctccattgaagggcaaattttcccctatgagggaggtagaatggcgtaacgtctgagttcaaaactccactccacttccaactcggacagcgacttcgggtatgttatttaatcttccagtgtctcaatttcctcagtttataaaatagacctagtatctaacctgtatgttcaatgtgagaagtaaatgaaatgagatgacacatgtgtaaacttcttaaaacaatacacatggcacctaatgaccattcaatatacatcactcttat

SEQ ID NO: 2235 - DNA, 822 bp, Homo sapiens
agtgggtggccgccaagagcgcacagactttgaagcaggaaaagacagtctctagagcaacatggaaaggatccagtatttgttttcaggcaaaagcaagcctccaaaagccccttggttcttctctgtgtgtctcgccccttctgccttgtacaccagactgccggcaagcaagcggggaggtggcgaacagctgggatcctccagtgaaaagtttgctcagcgcgagagatgtcaagaggctgggattgtcgcctatcgggagaagaattccacagatgaattggttctgccctgtatctttgaatggtttttattttctgatgtccagtgtggcagcctggcagagacatttagttgaaagaacacggggctctggaaacaaccagtcctccttggttcatattctcgtgttgtcacttattaaccgagtgacattggaggtgatatgctgcagtttatcactgaggtcctgagatggtccatactctaagctttgtgtctactgtggggggcaaagggaaaacttcccccttgctctctgaagagtcattgaaaatcaactgacaaaagaatctaaaatattcctggaaatggagagtcctgacatgatggccccatgatgaaaagaacccaggttcctgagtcacgacgtggacatgaggcaccaaggagaaaacacgtgaaccttaataagtttggggtgagagagaaataaaccttaagtatgttaagcttctgtcatttcaaggtaatacagtgtggaaggcagaaaaatgacccactctcccctgatatccattaaagatgtccaaatcctca

SEQ ID NO: 2236 - DNA, 20804 bp, Homo sapiens
attttctttttcctgttataatttgtttttgattagcgggttacctatgaatagtaatttccaaatatgtagatattttctaactatccttttcaaaaattgatttctggctcaattatataatggccagaagagtcttttgaaatttgttggattttgctttataactgaatattcccaatataaaaaactgtctcatgtcctcttataacacatttattttgcaactgtaaactatagggttccatatatatctggtaggtcaatttacttgtttttgttcctcttatatctctgcttgttttttctttcttttctataagttactgagaattgtgttaaaatcctcactgaatttatttttcttcatatgtaaatctgtcaatttaactttatatattttgaggctctgccattaggaataagaacatatataattgttacatcttcctggtgaaactgaaccttttgtaattattaatacaggtacacttattttcccttcagtttaataatccttgatattcaactaaaacatttagatcatttgtatttactataactactgatatatttggaattaagtctggcatcttattttatgtctcactggcactcaatctatatttttttctttgctgcttatagattacttatcatttcatttttttcttgaactagtttaggtgttatatacttagtttatataattttagcagttacactaaatttacaatgtgtatcccaaatcttaattcatcaaagtctattgttaatctgtatctttattctcctcttgggtaacacaaggaacattttaccttgagtagccccttgggggggtctcagcttaatccagggtgtattttcctgtgatgcttaccacctagaacagactctagataattatttctgcccttaaaagtttatgatgctgcctaactttagccaaaatttgtagatttatgcaagtcccctaagggcaaaagcagatatgatcctcttagaatttggtcctcctggaatttggcctgtcaattctccgctatctgggcacctcttcaaagcttttaaggtatattaaaaaaatgcctgacttaacaattttaattgactttaggaggaaagttggtacaataaaggtatcccattaaaatgggacagaaaagttatttttttcttttcatgtattaaagatggtaacttttttcttctgtatttgtggcaacttttggaatttttattgaacttgttctttggggcttctgcctttccacatttgcttagaaagattatttcatctcatgatcaggcaaatatttactatttttttttctaatttgttccagtttttgatttagactaaatctttaagccaactgtagttttggtgtaaggtatttcatatggaagaaaatggattcttttccccagtagcctaaaatattgtcacaataatctttgaaattatcttccaatacactattcacttgcaatgccttcttaaatttcacatattaatttcttcattgatataatagtctatacttttattagaagcatactaacttaattgttatacacctatagcatattttaatctctttaaggacaacctctattgaatactcttttaaatatccacaggagtactttaaaatgggcaacttttaaatattaatttagtaagaaataagaggaacatatttattcataattatggtacaaaataatgcaattggtttctttatgcttatgaaaagtgaaatcagtaataacacttttcaatgtctataatttacagcatattattagtttaatgctataaatattgttggcctagagcagactagaggcacacactgaagcacacaaatttatatgatatatacacttcattcatttgttcttgtcttgaaatgataaaataagatccgaatttttctcattgtttggatttataaaaatagaacaaaatataggttatgcaaacttaattttaaacaaattatgcattacaaataccagtaaagaaggcttctatcatctagttttaagttcagcaataaaatgcatttcctgaatttttgattatttttagaaggtgtgatgtaccactcagagaacatatttattaagagagtattgtccattaagacaaataagaagaaagtcaaatacagataatttaaaaaattaattgactggttttgacaagaggttaattaagaaatcttgtgcattggtagcacatatactaacattggaaaaaatctattaatgtttatgtgattaaagaagatacattatttttatccaggctgacaattctgacataatatttttaagatatatgaaaacatagcatagaacgtggtcttcacaataatttttaatttaattcaagaacaaatgtgttccaggttgctttagatgttctctgataaaaaaggatccagtaaaaattatgatggatgtgtagtcaagcttacatcatcatttaaaaacattcccattaagttatttgtctgccattagtcttagattttcaatcaatttaagagctctaaggaaagtcagaaattctcttcttgatattaaatttattcagaatttttttaagatagtcatttatacaaaggctttctgcattggccctgaagtgactgcactgtggttaccgtggagaaataagacagtgataaaggaaaaaattttcttcaagtatcggcatattcattatctgtcacaatcagaacttctaagaaaatgtgttccaacagataacatttaggcaaagattatatataagaaaatgagatagccaaaaagctgtcctgtagatcagaaggcatatttattgtttcttataattgtaaaggttaatactatttgtgccactttaaaaaagtcacagattcatgtcactggttatcttataaagcttggaaaccaaatattttttaaagtcccagttaaatatcattctatagaaatttggaaacatacgatattgagaaagcaatactttaatttttatattggggatgagaactcattttgaagaagtatatgctgcaccacaaatgtttgtatttgaagtaattaatatcaaggcacatacagataggaaagaagaaagtgttccatcaactgaaaaaactaggaaaatatgtaaccataattttaatcatacagaatcttcctgactgagatcagttagctcttttgaacaatattatctttgcttttctcaactacatttgtcagaaaaacctgatgttcttaattaatttttaagaggtctcaattacataatgcagcttagaaagtagcaatatataaactgacatcttgaagttcccagggcttcagagaagtagtttatgctgtagaggagatcatttttatcatataccacacttggtgcttattccttttatactttccctttgactgggcattatagacatccagctatctctctgtgcagggtgtcagactctcagatagccgcaatgagtgtgaatcatgtcctgtagataataaaaaggcaattttaaagtagtgaaaccaaggtgatgttaaaggaaatgctataaggaattgtaaaaaaaatgaacaaagaattgaggcttggagcatagagcttgtatctttgaacttattgagcacggtttgtgggaatttactgaaaaatcagagatgctgtggaaaggcatggtcttagtttactggatacagaactacagaaaaaacatttatattacaatattttaaatggataaaactatacatgatagtttatcaaaaatgcatatttgaaaatccaataccttgctctcaacagagatgtatttgggacataaaaaccattagttagaaacttacccaattccctactgattttaaaatatcagagtaaatagtaaaatatgtacatatatgcatttgtaacacctgaaattccatgcattgccttgacattttgagcctcacaaggttctaggaactagctatgagttccctggtcttggcaggtatgccttgctagccagcaaaattattcaaacaagccagggacattctcccatgggaaccaagggttatcttaccctcttgtcactgcaaagcctgcttcccacagcccctgcttgttcactctacttgagtgtaacccccagatggggctgcatggcacacacagtgttcttctccccgaggctgtgagtacacgggactaataaactgctgttgatctcatctgtccaatgctgagtgttgtgtgcttggatacctggaggcttatggggcatggtatccatccttcatcaatgggggtaatcagattagcttgtagatagacgcttataacaagtgttcataaaaattagtttttaaaaagtagtctttcttcttagaagcttatcctttcccaaatgcatgctggcagccctttcagctttagccaagaccaaatagtctctaggaagtttttgtcttgttgccactttttgcaatgatttgtgttaaattctcccaatgcattgcaccatactattctttttctgcctataatacatagctcattaagttctaattcaatacttcagcaaaaatggaacaatagagacaaaacaggtgaagaaatcataatcataatactttttgtaatttttccttgaatccagtccaaattagattggttagaaatcagtttctaagaagaaagactactttttaaaaagtaatttttatgaacgcttgttagtattcagtggagcagaactttgtgacactatatgaagaaaataaatcattctctatttaccaaagcttatagttaccagtgacaatgagaataggaattaagtccatagattacaggttgtaaattcaaataatgacaggaaccaggcaggtaattaaatgggtgaagtagaatagatggtgatctaattttaaatgttggcaactaattaaaatgtttaaaaaatactgtataagccaaacaaaacacatctggggaccacatgtccaagggtgaccctaaagcaattttaaaagtcctggtcattcttcaaggcctgcattgtatgcctgccttttcaagaatcctattatagcaaaggcagtctaagttaatcctgaccttcttggagttttttattgagttagtagtcagaaatacaaccatagtgcctttgctctctcattgttttctcagtgggtcttttattccccatgacactgaagggttttggaaagagaccatgtattatgttcctctcattctcctcatgctggcagcactttatgagtcatcagtaaataatgattataatagtagctaatattaaataaggctcttttcatgagtcaaacacatttgcaatagcttttccatatctcacagcaatcctgtaagagcagtgttactattaccccatttgactgaaaaacacctgaggcgcagagaagttaagtgactggccaaggtcatagagctgctgatgggtggagctagtaacctgtgccaggctaatgctgtagccatgttctcttagccactaggctatgaatattaattaatccaacataattgcctctagctaagagttttaaacctttttgtaccaaaatgtttgccatagttgttaataagtcttcagatggcaggctaaaacattattctgttttattttcattcttattctctgtcttttatctatttttgaatcctaataagaaatggaatattagaattaacacagtcatgctcatatgatgtcaaaaaagctaggtaatttgttcaaactctgttcaaaattaagcatagcatcagttaaattgatcagtctcaattttgtgtgagcaactggcagtttaacaaccaaataggaaatattgaaaagttttgtgaaaagaacttatgaggaaaaaagtaatgtccttggtggtgaggaaatttctcttctgcagttggctgctgtgaataaattactggtaggaagaacagagcaacagtctcagggttttttgtactgtgggtatttcagtgtttgactcttgctttgttactgtcttttctctgcatagaaaagaaactatgcattgagcaatcccagtgtgcattcagtgttatacaaatacttgataatcacttatgagagcaagttattctaagagatggttttactaacttttttactaatttttctttgatcacataatagagttcatagtataatacttaaacaatggctgtgtttttcctctctgaatttatgatgaaaatttgcccttcatacccattcatgtattttctggtatgttcagacatgactagaaaattggttgtctctctggccgctgagaaaagtcttaacagtttgattttcagtgctaggaggtatatactgtagggagctatagaaaagcagaaaggtagaatctttggtcttatctatcccaattcctttcctggccagaataactttaaatctgcctgtgcagctgcagacacatgaggcacgtggcctttggacacagccctttgcatgcctgcagacatattgaagcttctttgatgtctgtcttcaaggcttcccactggtgctgaggctgaaatcccacttcccactccacttcatgtatctgcagtgaacatttcaccaccaacaacatagatttcagcccttctgctagcaatcaaaccttttctatattaagtcccagtccctcaggactgtgcattcttttaaatggtaataggtgctaatggaataatttgatagactaatctctgataatgttactcttctcaggtaaaagtccattttagcctagttgaaatgcacatcacctttaggtggtctttaaggagtgacaggaagattagaaatacgtgacagaccaatcaagaggagatattttggtgagggggggccttttataactctacaacttatgccggctaagtgtacagcagccccccaaaactcttgattgaatgtgccctgattcatatagcagtgaattggtcattaatctctctctctctctctctcacacacacacacacacacacacacacaacttttctcatcctttctctctgtctgtctcacatacacacacacacacacacacacacacacacacacacacaccctttctcatcctctctctctgtttctctctctctctctcacacacacacacacacacaccctttctcatcccctcagggtatataaacattaacacacttgcagactaactgtctgaaaacatagcaatgaaaagatgtgaattcaaatagcataacaaaaagtgaataaaaaatgttatccagtgtcatttggcataaaaaaaagcttttactgggcacagtggctcatgcttgtaatcctagagactggggaggctgaggcaggaaaatcgcacgagttcaggagttcgagactagcctgggtaatgtagcaagacctcatctcttaaaactaaaaaaaaaaaagtcttttaaaaattcatcactgaaaactagtattagttaatatatggttttatcaaggaatatctacagaattcaaactctgcatacagagaagggaaactaacatgtattgtgctccaactatgtgccatgtctcctgcctcttataacattttacgtaatctcatgcattaattctgtgaggcaggtattgttatatgcatttttgataagatgaaactgagactcacggagacatggcaacatgtaagatcatacaaagaaagattatgttcaagatttgaacacagatgaatcttccaataatatactgacagataatcaagagtgttttcagaatgtgaagaaaacgcattaaagagctgtgtcatatttataacacatgtaactatccagatgttgaaaacataaacaacccttacagatagataaacattaaagtccaaaatagaacaggcaaagggagaaaactgatgaatcataaaataaaataggcaatatctgaacacacattctaccttagtagcaggtaaagaaattcatgttaaatagtgataaatcacaattttgaccaattaaattgatagaattaaacttatatatacaaaattctagaaggaatatggtaaattgtgcataaatggtaatggataatttgatacctttgtcaacatatgtcaaaagcacatgatcaaattttcttgctcagataaatcttccctatgaaaagaaggaatcatataaaagtttatgtataaagatgcataatcagatcaggccccaaaactttcaacaaccaaaatatttcactgttgaggaatggctacatgtattttgctatgcccatcaatgaatgttatgccattatttaaatggtcacaaaacaaggttgagtaaaaaagaaaagtccagtaatataaagtccagcacattaatgtataaaatgctagatattcctacatcctataggaatcctataaaatgatatttgaacaatgttcatgtgtctgaagatgcttttaacattcaactttacatttctttgaatttttgacaattaccatgcattatttttaaagtgtttgatagtcaaatgtgatggtaatgaaaggaataagtctacatgtgccatgacaacatcagccttcagttttctgcaagacaaagaggcaaacagatctccagtcctgcttttcttcaattaccaggtgtgctacaacaacatgaccccagcaagcaagattatttctgtgcactgataggaaaaggaagcaagccatgagtgcctgttgaagctggaaaagcaagattgatgttgaggcttgattgaaggagtgcaaggtcactcacagaagaagtcatggtgcaagagtacatctcaatcctgccctagcctggaaacagcatgctctgctgcatttgcatgcccaaggcactgcttgtcctaagccccatcctagaaactctctatagctttatttcccttaagaaggtagaaaaacatcaacaacctatccgtactagctgaatggcctctaggcctattgggcaagtacacccagatgagcatcactcttaagtggctgcttcaggtcaaggtcttttgtgttggggcagctgcaaactggcctctttggctatcccaagaccctctaagtccaaggagctttcaacctctagtgatgttcaatctctgtaaagctgtgtaatgggggataaacattaaagttgtttcacatttaaaaaaaaatgtgtgagaattttgcttctgaccctaatggagtgacagagatgggatttgcccatttaccttaactaaaaatccagacaaaatatatctaacaatgggttgtagagataggacacgagggacaacagggtattgattcctgagagggagaaacaatgtgggtacaaatgactgtctcattttgcctcttagagaaagttttcatgtcattgtgcagaaagagggaaggcaagtgaaatacagtggtttctataagttggagaggcagactgtcagattccatgaggcttaggtggaaattttgggggtagagtactagacagggaggaacataaaacagcacaaaacaaattttacaaagagagttttccttgagtcttcggctgatgctgataagtgtacacttctgaggaaactacttgaggccagggaaagaactgctagaaaggcagacagaacaatttacaaggcttgcacagagccatgactaattaacgttcttctaaatagcaaggagagactttgcaatgcataggacaaaaggtagagtactcagaatggcccttgatagtggttcaagttgtttagaataaaacccactttgatgtcatctaacaaagcttaaaataaagccttggaagaattaaacttacctgcattccagaaaaaaagttaaaaaatatttaaaggaatacagaaaatccaatactcaataaggtaaaattcacagtgtctggcatttcatccaagaatacacaagcaacaatgagaaaaaataatacagaaatgacacagatgataagaataatagacaaagaaattaagagttactagaaatggattctgtatattcaagaaggtaaaagagaatgagcatatttagaagatatataaaagacatgaaacagatgctgttttagagatgaaaaactacatatctgagataaaaatataataaatggaattaatagcagattaactattagacattgtagaagaatacttactagatatgaggacattataacagatactatccaaacatagagtgaaaaagacaaagaaatcacattagtgagctgagctaacttcagattttctaatatatgtgtaacaaggagttccccaaagagaaaagtacaaataaattatttgaaaaatagctcaagagaccaagacaagccaaaaacttagagaaaatagttgcaaaagacctatctgataaagaactattataaaaaatacacaaagaactcttaaaacttaacaataagaaaaaagtccaattaaaaatgggccaaagatcttaactgacacctcacaacagaagatatgcaaatggaaaataagcttatgaaaagatggtaacatatgtcatcagggaaatgcaaattaaaacaaaaatgtgttaccaacaataagataccaatacacacctattagaataaccaaaatcaagcacaatgacagcaccaaatgctggtgaggatgtggaacaacaggagctcttgtttattgctgatgggaatgcaaaatggtatagacatcttgaacagcagcttggcagtttcttaaaaattaaacatactcttacactcacgttctgttacatcagtcacactcgttatttactcaaatcaactggaagctgatttccctacaaaacttgcacatgaatgtttatagcagctttactcataattgccaaaagttggaagaaaccaagatgtcttccagtagatgaatggatagataagctgtagtacatccaggcaacagaatattatttagcactaagaaaaggacctatcatgccatgaaaagatatggaggaaacttaaatctatattagtaagttaaagaagccaatatggaaagaccgtatgattccaatattccaaccatactgtatgattccaagtatatgacattctggaaaaagcaaaatgagcaagctagtaaaaaaagattagtggttgccaggagttagcgggcaggaagggatgcataggtgtagtagaaagatttttaggtcagtggaaatactctgtatgatactacttttgtggattcatgtcattatacttttgtcaaaacccatagaatgtactccaccaaaagtgaaccctaatgtaaactacagactttgtgtggtactgatgagatttatcgattgcagcaaatgttccactgtggtgagggatatccatgtccatagtcagggaggttgtatgtatagcaggggcaacaagagatgtatggaaattctcttcattttctgctcaattttctgtggacctaaaagttctccaaaagggcttactaatttaaaaaatgatttttcccccaaatttgataaaagtaatagactcagggatctgagaaattcaacaaaacacaaaaactaaaccatgaaaattctgataaaattgcttatcacaagtgataaggagaaaatcttgaaagcactcagaaaaagtaaagatatattatgtacaggcacacaagataagaataaaagcagacttttttttttttagcagtaatgaaagccagaaaaaagtgaaccaacatctttaaagcattgaaagaaagaaaaacctatctatatagaattctatatccagagaaaacatctttcaaaaagaaagataaaatgaagccttcttcagaaacacaaaagctgagagaattgatcagtagcaacttgtacttaaaaaaatgataaagaaagtcttaaggcagaaggaaaatgctgctagacacacatgtgagtatacataaaggaaggaaaagcactggaaatgataaagtggatagataaaagacttctatgtttttctctgttatttaaggtctctttaaaaatagagtacagtgtttcaaattaacaagaattagtaataagagttaatattgagttgtggaatttataatatatgtagaagtaaaatgagtgactacaataggacaaatgctggaagaggaaaaatggttgtgtgctacagctcttttactttttataaagtagattaactttaaatgggtttttggtcaagatttgtgaagctggacaccaaatgcatgaactataggaaaaaagtcattaaattctacttcattgaaattaaattctttgttttccaaagacattgttacagaaatgaaaaggcaagttattgactgggaaaaatatcttcaaaacatatatctgacaaaggacttgtatctagactacattaactacattaagaactcttacaactcaatattagtaagacaaaaatccaatttccaaatggctgaaagatttgaacagacacttcaccaaagaagatatatggatattagattagtgctttcaaagttgctcaatatcaatggtacttcatggaaacataaattaaaatcacaagtagctactcttacataccctccagcatcactaatattaaaaagaatacttatttcaagtgttggcaggagcacagaagtggtactcaatacatttctggtagaaatgtcacatggtaagccatttgaaaaagtttgccaatttcttcaaaagcaaaacatacacttaagcaaatgacccagacattctcctcctaagcatttatccaagagaaatgaaagcatttatctatataaagatgtacataagtatttataacagctgaaaactggaaacaatctgaatattcatcaggtggtgaagggataaatgttccatacaataggaaactaatcaaagaaaaaaaagaatgaaattctaaaacatacaacaccatagatgaatttcaaaatgattatactgcttgaatgaaatcagatgctgcttccttttgaaaatatgtaaatattttatgattccacttatataaaagtttagagaatgaaagccagtctataggacataaagcggatcagtagttgcctggagaagcgaggggggtcatagaaggctgcagagatggataaggaacaaagaaacattggtggtgatagacatatttatcatcttgattgtactgatgctttcatgagtgtatacataggtcaaaactaatcaaattgtagcctttcaataggtatggtttcctatatgtcaattacacctcaataaagctgtaaatgtttagggtgccagataagactttcatagagtggggtggtccttctggaatatagctacctgaatacactgtaaaacgcccctgaagctggttagcatctgcgttgggttggactttccaggtttaaaacaagggatgcccagtgagagagtttccttgtagggaatactaagactttctgcttttagcattgttcgggatttgactttttgaagcaatctatagtactatttagtttaatatgcactacatcccaatgctttgcaatatagattatcagaaggaaataaggaggattatttgtagattaaacagcaaggtaacacaatatagctaccaggcactaactttgatagtcatcacttaaatcctagaacatagatgataaagtgtgagaaacaatctagagccaaaaattatgaagaatgcttttctagagccacatataaaattaatctcatttaaaagtatctgagtatgtccatacggagtcacaatatgccagttgatattaaggtggaataaagaacaaacattctgctgtttggagtatatttattttattgaatagcttttgcaaataagttctaaaatattttaataataataattgtaatatcttaagctcttctaagaaaattacaatgttttgttacctaggagaagatactgaggggacagttaagcctttgttccttaactttactagtggaacaaaacttaaggagggacaccttgaattcagcaagtgaaacttgaatgctcttttctttgttttattatgtcccatgtttttcagagtcttcacagttatacatgataatcttaaatcctcacaaaataaaatgaacaaagagcgcctaagaacatatggaaaaacctaagtgacaaatcgcatgtgatcatgaaaattactattaaatgaaccagcataaaactcaacatcaaaaaggtgaatattattttattagtaaagctcactattttggtttatcaacgctttttttttttctttctgcacaatataaagtgaagaaaagaattaaaatgaacagttgaccagttaatttaatcactatacacagttcaggtagttaatctaggtttcaaaacaaattgttctctcccaaagaaatggatggcttgatggcttgtatgagaagtagactgtataaatgtaaaataaattaagtttgggttgtctgaacctgatttcaccagttgttcatttaacaaccaattttgcagaatccacataaataaacgtgttcactgaagaacttacatgcaaaaaagtggtaaaaagtttctttacatgaataaattattttggtaaaaaactttcctaaatggagaataagggcatctgcaaagttttgcttttgtgacggcattttatgggtacagctcttaacattgcaactagactcataacatttttgatactttagacctggaagacatcttatttgatttctatataaaattctggtcttagtttaccagaaggtaaagatagaaggaacagaagactatttgggaggaaagtacattaatcataatatttagaaagacaatttattctgataaactaaattgctgtcattaaaatgcataaactctgacattaaaattctgctctccacatggaaagtatttctgtccttggaccttgatccagttgttacaaaagaatactataaaaggatagtaattacctactatactttgtctcagtgtccattttttcccactgagggaatggctccagtgtcacctgagaataaaacctctcttatttactaatgaagcctgtatttttcccttttgtagttctcccccttacatatgtggcacctcaaattttttatacttccatgctatcctgctgtgagaaagaatagtaattacatctaattagaaaagattaaaatgctatgattcatggaaataatgaaacttgattatgttttatacaaggcataaatcccaaacctacattttacactgaaattagcatacaacctgatcagcagcataaaagcagtgttgtgaatgttcattacattgcttgttttgctaaatgcactttctgtcatgtctcagccttaccatgatggacccatcttcccttaggcaaaaagaaagaggtcagtttgttttttcttaaaacctgggtttgctttataacatattaattttatttatttggggtatgttaagtcaaagtaacatgtgggaactagatatgatatatggttgataaagaaccaacaaacacacaaacaccttcgttttcccgtttagcaggccccaggaccaaaacattgttttcaatttcattaagatcttccaggttaggaaaggtaaaatgcaacctagagacgatagttctcttttaaacatgaggatttttttttctttttctgcatcacggactcagcatgaatgttcatttcaattatagtccagttcacaaagatccctcctgcatgcaggcattgtaggagaacatatgcagttttataatggaacagagggagacattacacacagatagatttgtgccataaacacatacgggcataagggattgtctagatagaaagcgaaaaagaagccaacataaaaacttcaaaaggattgaattgcaactccagaaggcaagaagttctcatttatctatctacctatctgacatgaagatcataactttctgaaatataatgtattaaatgttttctaagtccaacgataagataattctgataataacttggcatagcatgaacattgtcccattaatctcaatcagatatccccttgggaagataagctgcttttactccactgaggggaaggttagaatgccatccttctggaacaccctgagaagtccaggtgagtgggaggtggaatatgcatttctactccttgtttttctttttctaatgtagtgaaattgatagaattatattaactccttattgtcagtaattatgccacacaattatttgagcttaccaacctacatccttgactatacaggacatactctagtttacaaaaaatgagcacactttaatctcccttttcatgaggcagataactaaaggtttcaaaggtacaaaaaatttgaacatgactgaatatttgataataagaaattactgacatttttaaaagaagtgatagcggtattgtgggttaaaaatatttttaaaaagagttcttttaacatttagatgtaactataaaaatacttatgaataaaataatatgacatctctaatttgcttcaaaataacttgaaaatggggagtaagtagaaatatgtgtgagacaaaattgggctatgagttggtaatgaagaaggacatttattataattttctcattgcttttttaatgattgaaatttttacaataaaaattcaaaaaataaaacaggtaaaacacttcctttttctcctgccttagaaaaggttaccaaagtggttggtcaggctctacaagttaatacatgataggatcacaaattcaaagctcaagtaaatccaatgaagtcaaaagtgaataccacataaggttgggaggtgaaggagggaggaagattaaaaatacaaaacaaaacctacctataaattctagatacacattaacttcattattatttgatagtataggagagcaaatattaattcaataagaatgtagatggaactctatgtgccaagcaccatgataaatgctagggatacaaaaatgcttagacaccatttaaaactataataacatgttttacagagtatagtagagttagaataaattgctttgggaacccaagtgaaaggacaattaattctgcaagggttgataataggaacatgaaaaggtaataattgaactagactttgaataagcaggcgtttgctatgtgaaaaatgagtctatttctaaataggtttgtcaagtcatatttgatacagtatctctaaagccatggttctcaaagaagcattctttaccttcctcaatggctcaggtagtctccattgaaccaatgctgatagggacctcaggttgtttgttcacaaccagaatgattgctttgggagaaataggtagaaaaaacaacacggaatggccttttagatgggcaaaatgaaattatcagaaattcaaagggtgacctgttaatggcactggttgaagttctgtatggtcagaacacagggagcaggggtgtgtggcagggggcaaggatggcaggtaaaatgtgaccagactgtgaaggatcacataaggaataggagtttgatattttatgtacggcaaaatagtaaccattgaagatttttaagcaaaggattgatgcagaggttttcatcttatattaagaaaactctgacatcattcttctatcatcattctgagtgactggaaggagaaatactttgaaacaaggagaataatcaacaagttattttaattgacctaagcaagagtgataaaatgagtgtctttggggataaagaagaaaagaccgatggaagacagcatttggaattagaattgataagacttagtcactatatggacactggcggagtggtaaaaaaaaaaaaaaattcaaaacaaaacccatgtactaccctactctaaccagggtggcatgatcagatcaaggtttgggtttcaaagtatcagcatcaactagtcacagttgaatagttcaaaatgcttctcaatgtttggttgtcttaatctgtcatagattccttgagcaaggactaggggatgcattactgtttattcttgccatagtttttcagactccttcctgctgaggactcaacctattcttcaaatgatgggtttttggattgagaactgcctgagaactgcaatatgtgccgggatcttgattttctatctgggacaaaagactgagactgggcctcattcttctctttgttcattcttgatttctttggattatatattatattaaacaacattatcattggctgttgatctatctcattggctgtggtattagccagttgcatagctccctgcaggtgagatttccctgcctgttattctgaccttgttacttgttgaactttacttctagcaattaaatgctgccacatttcctttgctgttcaaggatcacatcatcttgattgctgttgagcctgctaatagcaggctaatatttttgaatgtcatcagcccagactgtagaggacagccactatgagattttcaatgatactgttgcctccttcatcagcttattccattttggtaaatggtgggtcctttagatcttttcaaggaatatagttggaatgtaggtcttttggtcttaggtagttggtctattctaacatgctcctatcaatgagtcttttgatctctttctctatggcctgtcagaacaattcagacatctttatgttttttcaaatttctgagtcgtcctaatagcacatcagaactgtcctgcagggttttgtcaggtattaaattaaataaaataatttccctgaaattgacaaaaatctttgttatccagctttaccttcactcatgatctggcatcccggagatccaatcatggggctactctcctggttcctgttggtggatgataattaggttctgtgggttcttcaacacgtaatttttctcccttcttagcagactcggcttttccgtgttgtgccatgttgttagttgaccgtcttgattgatctaatggccaggaggggacaatagggcaaatcctgcagaggatgaacattgtctcatgagcaaccttgcctcacttgaggcatctgcatagtcttcaagcaaggatgagatgggagaggatgctgtcctctaacaggagtgatggtctacttttgcaggaccaggggattcaagggaatccacggcttaagtttctcaagggcattttcttatataaccctttcctaaatttcagagtccaatttctttattaccagggccctgatagccctcaagataaaagaagtgagggaagtatatgacatagcatggcaagtggctaaacacagatgaagtttcatttggaatctcgctttagctagataccttggggtgctctgggcataagtcacaccttagtgttgttgttacctatgagcacaagggccaagccctggctgtaggctgtcctggggtgggagaagtaacttcttgagtgaggtggctcccatttagtcaaagttaatttcttgaaaagaggaagttgtgagctataagcaaccaagatttacagcagctgagagttgggcgcactggctgggtaaagatagtctggctaggacacaacatcatccatcatccacaatgcttgtcctctgcagaactggccccatcttccactccagtgctgactatcaggtcacagaagagggttaagttacaacatggcccaactcagaagaggtagaccagctatgaaagaagaaaaattgcatattggatgttgaaaaccacattctaggcttcattttttcctgcccttattctttccattgcccaaattattttatccatttcatatttacattatttctaacactttactattacaaagagtactgtcatgaatatttttgaacatatgcatgtgtgtatctttgtaggtacatttgtgagatacattcctagaaatgaaatgttggatcaaatttaaaattcataacattttgccaaagagcccttcatactttgtaacaatgtatatactccacaaacagggtatgagaatacctttttcttaaatcttaactaacagtgttatcatcagattttttaatgacagaagattgatgatcagacttttccaatctgaattagatatatattacatagtatattattttaattagaatctgtaaaattatgaatgattggagtacatttttataggtttaaaagccatatatatttcagaagagagtacttttcagagatttagaaggtagactcacactatcaaatgacatcgctggtgttaataagaggatcagatctgaatccccgtttccaaaatcataaaccaatgtaagatgcatttctgtatttttctcaatatttagctcaaaggccaccccctctatggtaacttctctggctgctctggaaaagtgaccggccccttgcgtgtgctggttatttctgtgcacatctctcctcaaatcctcactacagtgtgggcaggtgtgtcttgttcagtgatttgaaaattaaagcattaacacttgtaaagcaaaaaggcaaatagtataggaacatcaaatgtaaacagataattttcattttaattttctaatcccacctcataatggaatcc

SEQ ID NO: 2237 - DNA, 2816 bp, Homo sapiens
ggtttggaatgagtcgtgttttatgttttgaaagatccccaggggagaattccaaaacctaccttagacaacccttgcttcaagtccccatcttaatggaagtgctctctgccatctaacctggctccctcctgctgctgcagctgaggcctaagtctaccaggactacctggttctcccatctcagtcctgccttctaccctcgtttttgggcttgcgtctattccagccccctcccatccagcccccaaggcaaaaggttcacttactgcccaggtccagggtcttgctcacagcgcccatcccaggggcaggcagaggagccagtgtctgctgtgcgccacccacccctctcctcttccagggctagcagggctaccccgggctgggggctgtgttgccgcagctggccaggagccccacctcgcaacgggtgggcttcagggagaaaagggagggccacatcaaagccgggccggaaggagtccaccgtggggctggcctcagccaccatagcctgtcccagctggaaggtcctggggcagggagccgggtggagacggaggaccagatggttcctgcccctgttccattgcagaggcattgagctgcactctccagtctgggcgtccaggctgaggaggaggaggaggcaggccccagcagggctgaatgtgtagaagcgagagccctcaatggaagccaggatcctgcgatgagtctcagagatggttccaaccgctgggtacacgaataccttaaggccatcgcccctgcactttgaggtatcaaagcaagattcccagttgcagctgccaccatgaggggcttgaggaggtgaaacggcatcttctgggagctctccaggctgggagaagctctgcaggagctctgcatccagccagcggggccagccttgggaagccccgggccgaggtctgggaggcaatgccaggcggagaagggagaagcctcccagcaggacaagcaggagccaggaggctgacagtgccagccacagggactttcttctcctccacgactgcatgtggccacccacagtcagggctagggaagctgggaggcctctgccagcaagcaggaagagcagggcctggggcgggagaccagagctgggaccgacctgctagtcctgtgctgtcattgtacagatgggaagactgaggcccatcgagaccaggccgcctgtctaaggtcagatagtgagtcaccagccaggcaggaggaggccaggtgggacccagcttgctggcctggcccccctgctctcaggactctgccttctcggcctttggacaaccaagccagccttttccctcccagcagggacccctgcccctgggcactgctctggctgacgcaacccctgtccagaatgcagggccgtgtccccctgccctcctggctgcaccccttgaccttgccctcaactgagaggagggctgtctgccaggccatggggaccagtcagagctcccacaggaggcggcttggccagggacaggctggagggagctgggctggtcttcccactcctccccttgcctgagcagccctggctgcccctgtgcccgctggcagacgcttctgggctgtggcccctgtggctggagctaaaattagaccctgcatcccatgtggatcatcggcgtcagctgaggtcacagcctgggtgcagccggtgtccccctgccttggagggccaggagggctcggggtcctgatccttatccactctgccgctgcaccagctcaggaagtgcagcccctcttccccgcagcccagcagctgccttgcaccatctggcttggagctatcacagtgcagaggccagggccgctgtgccaagccccccaaaccctatggtatctcctcccatccctctccagtcggcaactggcccatcctgatctctttccttagcagcagcctggctcctcccctcccagccctgattcgctcctggctgggaggcagggtctccatttaaccccttccaaaccagtttcctcaattgctaatccaaccagcaagtactgcaactcacagctggccatgagttatcacagcctctgtctctcagtcctccagccaccctccaaggcagagatttacctgtcatttcttacagatgaggaaagctcagagaggggatgaactcttcctaaggtgacccagctaagaagtggcagggtggggatttcaatcctgagctcctggtcgttggtcaccccagctgtgggccctgtggctggagaaaaactagaccctgcacctgctgtgggccatcagagtcagtggaggtcagagcctgagtgtgaggaatctctgaatcggcacatgagaaggtcaacaggaagaaagaagatacttggactccaggaaatgatcaccgtggaaacccatctgctgcttcttgtctacggctgtttgttcctccagctctgggctgcctgagtgtctcacagcagaattagcaagtgcggaggctgaaggtttctagaggctctgaggtcacagctctcgcttgagtgcacataactataagccatgatgaggaaactgaggcttagagaggttaaatgacatgaccaaagtgtcaacagctaacaggcaggaaagccaggactcaaatccggcagcctgtttccagagtccacgcttggaaccacggagctgtatttcttaacaaagagtaagcatacaataaatactagcatattgttgttttatcagagactatgtttcacccaccaattttctttctctttttttttaaaaatagtatcttgac

SEQ ID NO: 2238 - DNA, 3318 bp, Homo sapiens
gttccctgccactgaatggaggctctccaggatggcggggccaccggggccctggaaccctaaatgactgcagggagcagagctctgcctccccatcaacccacttcagattcggctatgcctgaaacgcagatgcaagggctggagctctgcagacactgggaccagaggtgaccttgaggatggaagccatgtgttgggaaaatggaacagaaagatgagtggaacttggactatgaatgtctcttgccatacttggactgtctgcctccagacatcctctaaaagaagatttttaaaataacaatatacctttgtcccatttgagccacaactgttgagtttactgatctatactgccaaacctaattccaccaatatacctcacgacccagcaattacgctcttcagaaactgccctagagatgctcacacatgcacacagaggcacaaagatgttcagtgttgcttggactagcaaagacaaacagacaaacgacaatatgtatcttctctatggccacatatatatgaatgtaaataagtaggaaaaggcctggaaggaagcacagcaaattgatgatggtgggtacggctggggatggcggggagtcacaggaaaccatattcttcccctcaggaagatatgttcttattacctgtgaagttaaaacttacacgtcaagttaaaaagataataaaatccaaagggagaataaaagtaaacttgatactgcagaaacgtcacaggcatgacctcatccaggctatcaaggtcgacatcaacagtgatacagtatgttgacggaatgtacccaagatgctctgaaactggaactttctctctgcggtcctcctcccaaaacccatcaccccagtctaatcatgagaaaagcaccagaccaatcccagtagagggtcatcctacaaaatacctgaccagtgcttctcaaaagtgtcactgtcatcaaaatgaaggagagatgagagactgtcacagccaaaaggtgcctaaggagaccggaagaccaatgcgacacctgggaaactgtgacctgccacgacgaaggggaccgtgcagacatgactgcatcaaggctctcagatggggagagcgtcctggaatatctaggtgggtccatgcagatatggttacatcaaggttctgagatgggaagagtatcctggaatacctaggtaggccccagagaatcacaaaagtccttaaagagagaagcgggaagtcctagccagagcaatcaggcaagagaaagaaaaacgaaaaaacaaaaacaaattttaaaaccctaaaaaaagaaaaattaatttttaaaaagaggggctggggcgtggtggctcacgcctgtaatcccagcactttgggaggccgaggcaggtggatcacaaggtcaggagattgagaccatcctgggcaacatggtgaaaccccatctctactaaaaatataaaaattggccggacgtggtggcacatgcctgtaatcccagctactcgggaggctgaggcaggagaatcacttgaaccagggagtcagaggttgcagtgagcggagatcatgccattgcactccagcctggcgacagagtgagactccgtctcaaaaaaaaaaaaaagagggaagcaggaggttagaggcagagagaaattggacagtgctacactgctggctttaaagagggagaggccaagtgcagtggttcacgcctgtaatcccagcactttgggaggctgaggtgggaggatcacttgcaccctggagttcaagaccagcctgggcaacatagtgagacccctgtctctacaaaaaaaacacaaaaattagcagggtatggtggcacatgcctgtagtcccagctactcaggaggctcaggtgggaggatcgcctaagcccaggaggccaaggctgcagtgaactatagatcatgccactgtactccagtctagatagcagagcgagactgtgtctcaacaacaacaacaacaacaacaaaacagggagggctaggattaaggtcatgagctaaggaaagtaggcagcttctagaagctgtaaacggcaaggcacaggttctcccctggagcctctggaaggaacaaggcctgcagataccttgatcttagccttgttgtgttcctttcagacttcagactcccaacactgcaagatagtttttaaaagtgagccatgacatttgtggcaaaattgtgacagcagcaaaaggaaatgaatacagcaactcacactcagtatggagcagcagggtgggctggctcaccacttgccccacacagacccccccacaacaggtgtctagcagaaaaggcagtgtggcgaggtggttaatagtgcacactcaagcgtcgctgcctggatttgaatcccacctgggccgctgtgcaggcacgtgctcacgtggcaggcccgagcccttccaccccacacaggctgctggcaatgctggcccggagctggcgtctgggagcctggattcgggaggcctcccattgctccctaactgacaaggatggctcactgtgcctgagcaatctgtacaagtaatgtggtttatactgaccaccagcttgccttctaagggtctggaatttcagtacctgccaggcagagggtggccacatgaccagcccctagtaaaaaccctgggcactcagtctctctagcgggcttccctgccagatgacatgtcacgtgggttgtcacaactccttgcagcaagaattgggtgactcccctgggagagggctctggaaactggcacctgctttcctctggacttggccccgtgtggcttttccctttgctgatttgctttgaatccttttaccgtaataaatcatagccacgtgtacaaccatatgcttcgtcctgaggcttcccagcaaatcgtcgagcctgcggtggccttgggacccctgacacagccacttacgagctctgtgaccttgggcgtgctactgagcctgtgtcccttctgtataagcgagatattataacgtaactcttcctaggactctagggaggattcaatgcagtaatacatgtaaagtgcttcgaaaattacccggcatataaaagtgcttggcacatttattattgttgttgttataattgttaaatcccagcaaagaaatggacacacaaatattctgtcactttgccatgcacagcagtagggaggggagatggaagtcactgaggggcggtgacgaaagtcagcacaaaaggctcaaataccacaatcagagaccgggcgcagtggctcacgcctgtaatccca

SEQ ID NO: 2239 - DNA, 9096 bp, Homo sapiens
gggtagaggttggaggcagggaggcctggtagaaggctcttgtaaaagcccaggtgagacgttaagacctgaactgtgagatggtggttgatgagatagagaggagggcatcactttgatttcatagtagagtttcctggcagccaaggcaaaaaggagagcataatgaattacatactgttgagcagagaatggaaggaagcatgccagtttttcaagacattcccatacctgcctctcagtacttaatgcatgaaagaagaaacattacagcatctagcacagaggagatgtcagtcgatactttgaagaatgtggatttgtaatggactacgtcttcaatgacagttttttacagcaagtgaagaaataatctttatatagctgtttcttatttgtgctctttggttaaatcccagggcataatatttcctcttacctggtggaaagtgattcttcctaggacaagcgaatgtggtccgcacatgcaactttgagggttctgacttgaggaaacctctttgaggaagagaacttggttttcctaaaggacaaaatgagtagcctgtcccccagcctgtccttcttgaatatttcttcttgatccagatgcttgatttgggctggccacttaagattacattcttctgagtgcttaggaccctggtaacatctgtggctggttaagggcatctgtccccacaacatatgccagaaagttcttactgttgtccagtggaatcttttctggttggcatacaaaggaatagagtttgtatctgtctgaggaagacccctgattgctttttttttcctgtttgccactgaagtgattgggccctaatggtctgaaaatagaaataaataaagttaatccatgccactaaattatcgaagagaacaaggaagtgtgaaaaatgctgtgtcctcacaccatcttctccagagagggtgactctagagcagaggggggaattagggcttggccgagtctatggcagacgaggcaggattgagccgtaagagctgtgggtgtcaattacccactgaaaagtgatggtgaggagtcagtaacagtagttttgttgatatttgtgttcttacccaaacatctagattacttatataacagatggctgctgccttccgtcagcgcagttggcgtatcaaaaataacacttgagttagaaattgtgcttgcctttactttttgttcccaggattagttgttgctgtgtgtatgctaagaggctgttatgaggacagctggtcaagtaaataaggaaatatttaggtaggaaagagacattcagtcatggggcttattaattttctgattcttgatggacttcctgactatagtatcccaaatggttgaagaacagttaagaacatacgtgcagtgtatttccaagtagctttctatttgaaaggccacttggtcctcctaagtgtggatggtcgttgtcatgtggcctttgatgtgacaatgacctgtctgtgctcacttggggaagggccgcctcaccagagccctccttgtgcaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagaggtgggtctggggtatgttgtgaagggctggttccagagtggcagaggcacaggtacatggcagacccccaagtctctgccctcacagccagaggggcctgctgagcattgttcccccaaggtaagtaccagttgcacttgtgtttggtcttttcccataactagtgatgatggttatttgagatttaaaggaatctatggaaatttatgttattaagttaatgtgtgtgtgtgtgtgtgtgtgtgtgtgtgtgtgtattttttttttttttgagacagagtctccctctgtcacccaggctggagtgcagtggcgaatcttagctcactgcaacctccacctcccgggttcaagcaattctcccgcctcagcctcctgagtagctgagattacaggcgtgcaccaccatgcctggctaatttttgtatttttagtagagacagggtttggccaggctggtctcaaactcctggcctcaagtgatccacctgccttgacctcccaaagtgctaggattacaggcatgagccactggatccagcctaagttaatgtatattttataatgcatgctcagagaatgctgataaacaaaatataaaaatacagaagagaggctgggcatggtgatgactcacgcctgtaatcccagcactttgggaagccgaggcagaaggttcccttgggcccaggagttcaagaccagcctaggcaacatagtaagaccttgtctctacaaaaaataaaaaattagctgggcatggttgcacacacctgtagtcccagctactcgggaggctggggtgggaggatcagttgagcccaaaaaggtcaaggcttcagtgagctgttatcacaccactgcactccagcctgagtaagagtgagaccctgactcaaaaaacaaaacaaaacaaaacaaaaaaacagaaaaaaactgaagaggaggactatgaaaggaaattccccacgtctcacccttatctaaactgcatagtttgtttccttactgtgctttttatgtgagtgttgcatacagaatttggggtcttgctttttttttttttaaacatttttggcgtgagtattttccatattatagcatcgtttttgtagtgtgattttagtggctgtatactaactcatcaggagctgtgccattcattcctaggcggcaggtatttaggatgaattgagctggccttgtgctggcatcttgcgggctgctgtgaatccagggtttctgccctggaggagcttatagttcagtggaaaagccagacgctcttcaaacacacagtttatataaacgtgatgggtgcaagggaggaggacatggtgctgtgtgagttcatattaggaggctgcgccctcatccaggaatgcagggaaggcttctcagaggaactagctaagtgatttcactgctttcctgtggctgcacttcgattaggttgttcccaattcttcacttttataaggctgcagtacttacttactttgcacatagactgttcctcatgtttcaaattatttctttagacttccaggaaggtcagtcttgggtcagagggtggcagttgtgacttccactgtgggttgtagccctcacatcttttggtgtgtggactgtggtaaggacaggaccttggggttcacccatttcagtggccctcaaggtgtggccccctggctgggggcttcagcgtcacctggggacttgttagaaatgcagatccatgggtcctgcccagaaactcacattctaacaaatgttccaggcgattctgagatgccgaagtctgagaacgaagctctgtctcctcgggaaccccagacccatctccattttagggttcacaggtcttggcaacatcttaccagaggatgtgggggacagctcttcagctgcattttttttttttttttgagacatggtttcactcttgcccaggctggagtgtagtggtgctatctcagctcactgcaacctccacctcccgggttcaagtgattctcctggattctcctgcctcagcctcccgagtagctgggattacagacgtgcaccaccatgcccagctactttttgtattttttagtagagacggggtttcaccgtgttggccaggctggtctcgaactcctgacctcaagtgatcctcccgcctcggcctcctaaagtactgggattacaggtgtgagccaccacgcccggcccttcagctgcatttaaatgtggaaatctagtgacctctgagagccccacctctccactcatggccacattggacagtctgcccgggctgagccttccgctgaggggagggtgttaaattagggtcacttctgtcctcggcctctcctgggagtcattctgctatttctcagctccctcagagatggggaggctggggagtagagaaggggctgcctctccttagaaattggccataggagagtaatgaccagctgaggattgtacaccgggctggatcctgtgtggccatcttgagctggatgagctatttctggagcaagagactcagtttcttcctcctggtgagccagtgagccctgtgaaagtgttcccttcgttggaacttagtgctaagcaggaggccctcagagtgtccagtgtgtgcccacctgtgggatccaggccttggcttcccaagttttccagaaggttcctttcaagtggttatctggcccagctcacgggcccgcccatccccttgtgtccctgcagacgactaagctaccggagagccgcgggcaccctgccgagcccccagagcctcaggaagcccccctagacctgtgactgtgagggctacctcaaagggcactatgtgggtaaggaaattgaggctcagagagatgaagggacttgtccaaggtcagtcacatgccaagtaaaacagtgaccttaagccctagtttgtgaatgcaggggtcaccctttcatcttattattgtatttcctgaacaacctcttccagtagcaggaggaggttgggagaagtcagtgggactcagtcccatctccaggtctggccaggtgggaaaagtctctactgggagatcctgggacaactgggacaaatgccatggtgtccctctgcccctcctcccaagctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacgtaagagggcccatgtgggagtgtgtgtttgtctgcacacacacaaatattccatggagacttaactccccagatccatccaaatccttactttgggtttaaaggatcaccaggcactgcctgctattggcaaattgtgggacaaaggcatgatgggaagaaatccactcccagtggtcctctgagaccctctgaggcagaagttggaggaccacttgcttggttcctgcctggggtgggagatgagtccagagcacattgtaggcaaagtggcagcctcaacctgacaccacggggcccccacagtagggggcattcctcctcatcacagtgaattttgactcctgtggccgctgccctctgcttggatgagagggcaggtcagagaagccacagagccctgtgagtggtatttctcggcactcccttatagccagattccagtttgtcagggtagctgggtacattcctgggtgatgcctcccctgccaattcctggggcttactgctgccaggggcaccctgggatgtcaagctccagtgggcagaggatcctggttctgaatgtgataaggaggatgaggaggaggagaatgaaggtgccaggtaatgcaccaagagcttttatgtgtagtgccctgcgtcagccctcccagtacccctgagaagagagattgttatcatcttgtgtggcagaggaagacagtgagggtcagagaggttaagtaacttgtccaatgtcacacagttggtaagtggtggagccaggattcatacccaggcagcctgccccagtcatgttcttaacgaggatgcacaatggcctctcacctgccgcctcccacttcgtgcccttggctgccccttttctttctgggactcactctcagtccccctggcctcagagggatgcagtgtgaatgcctggtggctactgagaggggtgctgtgggggccctaatggggcctcctcagagtgttctggggcagagcaaccatgaagccttgctttgatcacaccgctctccctgggcccctgggcccagcgtctagtctgtgggttgtcagagctgtcttccacagcccaatctgaagtggcagggatgtgggggaggtggtggccctggggaggccatcctggcagcacacctgtgatggacctggagggcttcagggagccacggccttccaagtttcaggtggactgaaacaggacatgcagaggttgctcacacactgatcgttcagaaccccttggatccaccccctggagaagaggtacctggatggtcaggcccacctgcttctaggcactccacagataggagactttcctcctttgttttagaaactgggggagtcagggaagccttcccagaggcagtgacttttatgctgggttctgaagagtaaataggagttttccaggcagaagagaaaggaatagttctctttacagaggaaacaacatgtgcaaagggacggagcagtgttggggaccggggagattagtgtggatggtgtgctggaaaatggagctgagaggttgggcagatcacgcaggtctcagatactcagctagggtgtttagaatgtaacccatagataaatacaagtttttaagcagggggatgacatggttggaaaagtgaccctagcacctctaccggaggttggactaagatgccacagaaagaacacagggcataccctgggtggttcccatgggccagaagacacagtgcctcaagatcccattttatcttttggaaaatactgtgtgtgtggctttgtgtgtgcccttgttctgcagaagacctgattttcctcagaagtgtgcatcccaattctgttatggaaatcaatgagaaaacaccatgtgtttcaacatttttgtttgagagccagccttgctgaaacacatccgatctatatagggacggtctgtcttcctgtctcctttttctggagatgagaactaattgactaaagaattaaaagcatacatcagggtcaagtgtatgtgtggctcctttgctctcaaaaaataaaaaacaatgaagaattaaaagttaggactaggggtcccttaagtgattctttaaaagccacagcatatgctgggcgcggtggctcatgtctgtaatcccagcactttgggaggctgaggcgggtggatcacctgaggtcgggagttcgagaccagcctgaccaacatggagaaaccccatctctactaaaaatacaaaattagccgggtgtggtggtacatgcctgtaattccagctactcgggaggctgaggcaggagaatcgcttgaaccgagaaggcagaggttgcagtgagccgaaatcatgccattgcgctgtagcctggggaacgagcaaaactccgtctcaaaacaaaaaacaaaacaaaacaaacaaaaaaaaaacacagcatcagggagtcagttagcagagtggttaagggtataagctgggcatttggcagagagaccgattctggctgtgctctctactggttgtgggtcactgtgcacagtgctgaacctctccgtgcctcagttttctcagctgcaaaaggaaaagcctccttttgcctacatcaaagagttgttgtgtgaatcagtgatacgcctgcctggaaaggcacagtgcctgatacagggacatgcaatgaggtggaagtgcctggtttagacacagcagcagtgaactcccaaatgagtgcctaagcctgctgctgtccctgcgtgctgtgatgtgacatctctttgcccagctttccttctttctttaaaagataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgtaagtttaaagttgattgtttcttttctgaaggcctaagggaggctgttacaggaacgcttctagctgcataagggtgcttgcagctgaagagggatgcgggacacaccttctacatgtgattgtctttccattttgcctattgaaaaacttaagagaagatgattacatggccagaaggctcaaggtgaacagctggaagtgcctcccaaaccaggcaggtggctttgcctgggctcacgcccctccactccctcacataagcgccctcccgcaaaatgtgacacctgtcagggacctcatctgagtgtgacagactgtactcatcaaactatactcctaggccaaatccaagtattttaaattgaaaccccaactaacaaggtcattatcactgctatcaaaccagtttgaatcatcagtgaatgaagggatttctaaaactagtggatgagatcgtctgatgtgtcctaaatgaacttctgtttcactgtcatagattctttgttcagcccagtctatgtcaggatggcgagaccctcacccaaaacctaaatatttgacagagttcttccaggaggtgtgggcttggtgactcatcttttttggttcttaacagggtcagttagcagaatgagttggaagttgttgtgggtggtgggggcagtcagaagcaactcagtcccagaatagactttacttgctgtcctatatagctggtttcatctgaaggaggccttctcggatccttccccttggtcaggaagctcccgctgagtcaagattttgatgcaatcctagttcatactaattctcagttttaactgtccacgtt

SEQ ID NO: 2240 - DNA, 7932 bp, Homo sapiens
ggaaaaacatcgcctcttgataggttacttgatattgctatagtattgaggtctccttctagatcatggttcagtatagcaggtcatcattttttctgactggtgaagagaaagtctagattttcaagtaccttggaagagaatagatatgctaccacctgtggtagtcctgttatttgatcagggcttagctcttttcaaaggaactttccttaagaattctgtctcttaataccacttctcttgatgactggttcaccttccatgataccgttacatcagaggagagcctggaagaattggggtggattttgtgtgcatgtgtgtgtacgtgagcagtgcatgattcttattggcttgtttcctcataattcagctaaaggaaagcgtatggtggcgttgatctaactggtgtttattatctaccttatatttccaagaaatcagaatattctcttgagttccatttaccaaagtaagttttaaatcatcctaatatagagccaaaacatagttacttttcaaaattgcaattccataaattttagctttattttccaagatgagagaaacaatagaggaaaattctcactcacaacctaactcagttatcaacagaacattcaaggctggatctcctaatcaacattgaaaaagtatcccctacattaggaaaatactctggttctgtctttacttcatactgggttattcacagattggaaaggtatataagtatggcgattgaatctattcccttccccacatatccctccctttgtagtgaggtcaagcttggctctttcactgtgttcatgtcagcattttgtgttagaaatttacgatgggtgtgggggcattacagtgcattcaacatttttttcagtgccttctatttggaaatatggtgacatgtgcagccagcactgagtaaaagttttaatgggaggggaaactagtataaggataggaacagagcaacaggaggtgtagccgtcagtccttcaagacacatttgctacagacagcactttttctgtctcaggcagacaacagttaatcttaagttagaagaagaaagaagcagagctgatgcaaaaaaatatatatatatggagaaagttaagctgaatgttgtagagctaacactcaataagtatttggaatgttagcagtacaacctttattagcagctacaaaaatcagactacatagttttttgataacaagatgaccaattcaaggtgatacagaggcttgtgcttggagaaggatgtcttgtagactattgaccaatagggcagaatttccctttgtacattcatccctgttcaggtctaacttgcatccttttaagcacggacacctgacccatcacacccgcaaaagtggataagatcaatctcaagcagtgaacttacactgaccaagcacacaggaaatgcatataaaagtagattcctcaaggccacatctgaccagagtattcattatttgttacagaagactcgggaaagcattgaatggctatcttataattgttttttcctccccatctgaagctgcagacaccatttgaaaagtggctacatcccagcctatgattgttctcaggtggcatttttgtttttattttctaaatcttgatgggtacctcactgttattcccacatatcactcataatatttatattatatactggtaattgaatgtgggttccatattctacattcatttgctagacaaataattgagattctactgtatgccaagcactggagtaatctgttaattggttaattcatttattagtttctttaagacatactgtatttactatgtattggggactatgttagaagcttgaaatatcacagtgaacaagttagaccatggctactttcaaagtgtctatagaagaattgagaaatcaagtgaacaatcacaatacttctgataagagataacacagaggaggtaatagggttttatttttaaagaacaatatataaatatagtggctttggtcttgtaaaatttagtggcaatgtaattgtataaaacaagggaacccaagtggataaggtaggaaatcaaaatattagctagtagtaaaataattaaatgacattctctggtctggaaattttgccaagtcttttcaaataaacgaagaaaacaacaaaaaaaacttactttggtttgtttcctaacaagtcaaaaggaaaaccacaatccaacaacaatgcaagcaacagaaaatctttaaataatgacgctgaaattatcttataactttaataagtaaaagtaaaaatatggaaataaacagaagtttggcagaaagaacagatacaaaaatttcaaaactcaggagaaaaagtcgagatcttcatgaaacaaagctttaaaagagaaaagttaatgttagaaaaccacacaaaagtctaaaagcttagaatgttcagatccctaaagaaataaggagagcatcatatagattttatggggcattttattttcacaatagttgatactgaaagcaattttttttccaaagagaatgtgccacataacaactagtaaaatagcaaaaacaacaggcaaaattggataaaatactccactttctagcagtccaggagttggccctgtaatctgtcttctagtttttaacttagcccatccctgactgtctcatataacaattggtttgtagatgatcccatcattgagtagtttagcgtctctgaatcataggccaggtacagcattcaaacttacctaaaaacatcactcttttggttcttaaaaaatattttgtgaaggagatgccacaagctttcccttagaagccctgtggaaatcatctaactggtgggctattattagacacattatcaaagtttctgcttttttacaagtctcttcttaatacagtactagcacatgatgccaacagcccatgttattatcatgtcattctagtgctttaactaataggtccctggaaggagaagaattcgtttattcctttgggattatatatagattttctttcttaattttatctacagtgtaaacttatacccagatcatgtcttttattttgtattttatgtagcaccctctttgcctttagaaaaggtttagaagagacaatgaggaaagatagtttaagggtggtagaaataagttgaatttgagatttgagatggatgtgaaagggtttggagaggtagttgctgaggaaggggcaaagctgggactttgcctttggagcaggcttcttggacatgcagaacagtatctttgtcagagaacattctggaccaggaaaactgggaacattaatctagattagtacaggactttgaacatagctgtgactacctgacttgtaaattggcatatctgtatttttctgctgtcctgagttagttaacttcgtattttaaaatactcatctgaatatatctgctacttttgcccacccagaacccattaccttttcttcagtgcagcactgttccctccccaccttctttggaaaacgatgctgctccaacctttagggcttttgttttggaagggcagaccaccaacctagatcaagatgtagctgtcgtccaggcctacccaatgaccttattcaatttccatacctacaaagcatggttgagaagaggaaaaaaacccacacttttcagaggcaatcctaggtttgaacttttgaaaaggaggagctctttccactgtggtagttgaaggtagagggctgcctggagctgccagtagccatcttgccactctctgggataagcctgaccgaataaagtccacacagaggaaagcagaactgagagaaagagagggaccaagtccctactgatctcatttgacacactcgatctactgccttctgaacatttcttgagcctatagattactctacctcccttatttcccataagtcaccatgacttgcctttttctgttacaaccaaatcagtcctaggaaataaaatgtttgttttgcttccacacccacagtggggcttgggagcatctgtatttcaaagctgagaattctccacagaatccagttcccttctatcttgttttaccttctgaggagaggaccatgaaggcagcgtcaggcacacgacacaaatggcagctgtgtttcatctcttctgtgcagatagcttaataataaatacctccttccctttttagggaacaaaatagttttattttacatagaaatttcttctgtagtgagtagcagtgaaacgctaatatttattaaagagaaattgccactgataccctttggtgtagcccaagaggatgtaagaaaaaaaggaacaaatggcacctacactctataagctgcctaagtggaatcttaatgtagaatttgttgctttgtagtcttctttttttttttatctagcaagactagtgttacagaggatcacggacattagtcacttgttcttgataacctctgaagagttggataaaagaaagaaactgcccccagtgaaaagggatgatctgcaatatctgaagaattatttctgtggaagacaatgttattacaagacactgggatattatgactattttggtagcttaaagaaaaataaattcataatactagatattaattatattcgatgatatacataatttataatactaggatagaaaaaatctttattaattttcaagtagttacatcattctctcctcacttcttagcatgaaggccatttatgtactggcaggtaaatgtcaggttgagaaggctctaagtcatttcacagtagggaaagttggtttttcaacttggaagcaaattttattttattatttttagaaaattatatatatatataacttaaaatggaaaattgcacaaatcataagtggacagctccgtacattctcaccaagagaacatatcaatgtaatgaacacccaaattaagaaacactacatgattagctccccaatatcctccattcggctactgtctagccaattccctaccaagggcaactgctacactgacttctaacactgtaaagtagtcactggcagagattttgaaaggcagtatgtcctgctgaaatgtgagggaaattccactgatgattttaaacctaaaacgatatgaatatctttagcaacaaaacctactttcctccagaccacataagaacccgcccatgcctatgtcctatttcctctggagcatttttaggttaagttttagatcttgtagtctggtgatatagtacattttgacataacatggagtaaggatgccatgaggatgcccagctcatgtagggggtgcttggctggtctgtgatagtcactgggagaaaggtttaagggaagggctggcatgtcatttccttctccctcttatcctgctccataatgatcaccactgtttattctttaaataagtgaaaagggaaagaaataaatgtgtcatttaaagggttccaatttaagtctcctgctttattcttaagccctgcttaatctttcttgattctaccctaaggagtacaaatctcttttggctgatccactttcctttgaggaaccaaaagtgaacacgagcaaacagattaaaagatagcccaagagcactggtcaacatgtgccctgtgtggttggatcaagtagagggaaaccatgatttgctttaaaagaataacggtcattgcaatgtcctgcttctgttctggggttcagaatgtgatattctgcatccagttaaaggaatctcttggccatttaccacagctaatagtaattaacagaacctactgaaaatgcagatgcaccctcttcaaactagtaagtgttactcatcatgctgggatattgagagagatttgactttgagaagcatggagaaatgatttggtttaaaactagaaactctggattatacagatactcatggcactaagcaaattcagaattaaaagaatgtgccttcagagagacaaatgccacaggatctctctatatgtgaaatccagaaaagccaaactcatagaagtagagattagaatggtggttaccagaaactgagggtggtgatggtggatggagaaaggggagatgttggttaatgggtacaaagtttcagttaggcagtaggcataagttctggtgatctcttccatagcacagtgactgtagttaataataatgtattgtatatttcaaaattgctaaaagagaagattttaaatgatcctaccacaagaaatggtaaatatttgaggtgatagatatgctaattagcctatcagatcattctgtgatatatacatgtattgaaacaaccttatacctcacaagtagatgcagttattatgtcagttaaaaataaaactaaaaaaaatttttaaaagaatgtgccttaaaaaatattttgttcttttcattaaataataatcttagtaacactgacagtgagaatctataaatttagcaatttccaaagcaatcattttaattggatttaaaagggatattatagtggataaaaccctcagaatattttatgtagtagtgccatggtttattaaacagaattcatttaaagtacacatgcaacacatcccgatagtttcttacaaaccttgaaataagcaattattgagaagagttgagagggtgattttctgagtttaacgaagaaggccttacatctagaagcttgcagtcttcttgaagatagagattctgagttggttttggctcagtgtcacccttgcctgaaatagtatgtggaaagccacaataatgggaatgagcatagtgtatctgggggaggagtagacaggtcagtccagctgaatgccgtgtatgtatgtttgtgtttgtgtgtttatacaccaagtgtaaaataaaataaagtacaagtcataaaattggacatgttacggatagttttgtattgtcataaacacatttacactcaataaatgtggaacgaataaatcaaaggacaaaaagctttgaatacctaatggaacctgagggtgttcatcctgaaggtaactagaagatataagttatttctctctttgtggccagaaaggctagaattccttttatagacagagcaatgttactagttttcagacagatgggaattgaaacaacttttatctttaaagacaaaatcctacccaacattgtacatatttaaatttatgtgaagttgcccacaggcagtggaatgagttaatcaaatgataaagaaatgtcaaaacatcttatacttgtatataaacctggtagttcagtatcctataaagtacaaccaatccatctgtccgaaagcctaataccactatttttggtgacactaaatgctttaaattttgtcagcaagatttgaggcaatgtcaaatgctagagtgatcaatatcaaatactagagtgataaaaccccaatattattatatataattatatgtgtgtatgtatataaatatatgccaaaatgctatacaaatctatacacactttatataagtactatatgcacacatacacacacataattattaactaagtttaaaaaattccacgtgatgagatttttttttaactttaaaaagtattagctcattagacttcacttttttttttttttttttttttgagactgggtcttgctgtgtcgcccaggctggagtgcagtggcgtgatctcggctcactgtagtctctgcctcctaggttcaagaaattctcctgcctcagcctcctgagtagtgaggattacaggctaatttttgtatttttagtagacacagggtttcaccatgttggccaggctggtctcgaacccctgacctcaagtgatccgcccacttcggc

SEQ ID NO: 2241 - DNA, 882 bp, Homo sapiens
ggaaattcccctcctggtcctcgccattggaaaatcgcttgagggtgttagccgggacttggagctgctgccagaccgcgtcgtctccttactcccctgaaggaagagaagaaggatcatcaatggcaagcggcagctgcaacaaaacaacactatgagctggctgcatgctcaggaaagaatgcccgcctcctccgtttggtttccagtgctctaaacattcagagaaacttctctagtattgaatgacagaaatgagccctgagagtagagtcttagaagacttgattttgttaagacaacaatattccccaaagcaatatgcagattcaatgcaatccctatcaaagtccccaaatcccacaaattccgttttgctgaagtagaaaagctgactctgaaatgtacatagaattgcaagggatcccaaatagtcaaaacaatcttgcaaaaagaagaacaaggtgttaagactcacatttgccaatttcaaaacttactacaaagctacagtaatcaaaatcatgtactaccaacataaggatagtcatgcatatagatcaatggaatagaattgacaatccagaaataaacgtatgcaactatggtcaattgattttcaacaagggtgccaagaccattcaatgggggaaaagaagggtttcttcaacaaatggtgccaggccaactgattatccacatgcaaaagaacaaagttagacgttaccacacatcatgtacaaaaattaacacaaaatgaataaaattctaaatataagagctaaagccataaaagtctaagaaaagaacagctttataaccttgggtttggcaacagtttcttagaccaaaaacaaaaggaacaaatgaaaaataagttgg

SEQ ID NO: 2242 - DNA, 3971 bp, Homo sapiens
cctcacctggccagaaagataactttgaatgcatctgtgtatctacacatttttatatatacaggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaa

SEQ ID NO: 2243 - DNA, 1325 bp, Homo sapiens
cccctgatgtgtatacagtctgtcactgactgaaatgttattatgtgctgcatgaacgcatctgttaaatgtataaactaaagagttgaaacaaatcccatgtttggccaatgtagaatctaagtagaaggaagacatagaactaaatttttcatccttttataactacaaatggatttaaatataatattaagtcttctgttcacatagtacatggttcaaatgtacatagaaagtacatataaatatctggaggaagattattccaggtggagagaactgcaagaccttgtggcaagaaggggctcagcatgactgacaaatagcaagaaggatgtcagctgtggcactggctaccttgacacatcttcatctgaagaaaaaatacaaagaaggcctgccatgatgacaatttacttcatgaagagaacgggttctgaaacggtcattcttttccatttaaacaatgttaccatctcccaaagaacagctttggggtaggaaagaacagtatttcatttcaagctggactactcatctaccaaaaaaccattctgaccaaagaaacagatgcagaattacagtcacagctgcattctgcacagaacaagttggataatgggtcatccaggctggaatgcaagtgacacaatcacagctcactgcagccttgacttcctcggctcaagtgatcctcctgcctcagcctcccaagtagctgggactacaggcacgtaacgtcacaccttgttaattttcatattttttcgtagagacagcgttttgccatattgcccaggctaatcttgaactactgggctcaagcaatctgcctgtctcagcctcccaaagtgatgggattaccggcatgagccactgggcctggccccactttttcctttttaacactatgggtgtttttctgtgtgtgcttttttgaatagaagtggtgagagggcacgttcttgcctttttcctaatcttaaaaaagttttcgatactaaatatattatctataggtttttcaaagaaatgagaagttgcctcctattcctagtttgctgagggttttattttctcacgaatgggtatgttctctgtacaattaaccaatgaaatcgtctgggtctttgtgggaagattcttagtaacaaattctatttccttaattatgcagattttctgtatcatcttatgccatcatgctaagttgtatttttcaaggaatttgtcaattttgtataagttgtcaagtttactggaataaaggctttaatgatattacctctttcaatatctatagcatctttagtggtattctgctc

SEQ ID NO: 2244 - DNA, 1433 bp, Homo sapiens
ctccacccagtggtcctgcttgcgtctttggaggacggtagcagtgcgctcagtggaggccacgggtgcctcagagggatttctcttggacctcctgccctaccccagcttcggcgttgcacttggagaaggccctggatatctcagggtgctggggagaggagcagtgagcaaacacaaaatccctgcctgtttagaactgatcttctagtggtggtggttggggctgggagcagctggacagtgaattactaagaagggatgatccttgcctcccaccctgtcactgaagaccaggagaagagtgatcccccgaaatgccctcagctcctgaaatgcccactgtcaacattcttggttacagacaacggcaacacctgtttcaagaataaaatggatctattgaatatttgggatcattaggagttgaggggcagggaaagcaaattccaggttaagtttccagaaaaagtgccccaaccgcactgtagaactggcctgaagatgaaaccaccattgcagctactgagaactcaatgataagaacttgtcatttctaccctgtgcactgctgcttcccaagaactgatgctaccgtgtcagcgaagggattcccttgctgagcccagttccttacactgctcacttcatttctaaagcaaaatcttatgcaggtgtgtacaaagacagaactatgtcacaggcctgcattctaactgcaagagaggctggcagtttgagttgtgactacaatggggaggcaagaatgctatcatgagattttcccccattatagaaaggattggcaaagatagagccaaagttccctgtaggagatgtgtacagaaggtctgatgaaaattcgaagtcttattcagaacaaaaggcctagataaccttccagggaccctggaaagaatgatgcctaggaaggtggcttctgtcatgaagtgatcaccaaccatggcaatgtcaactggggaatggcaagggggagtgctgggcatagggtccagctcccaggaaactagaaggagcccaggaagctagaaggcaagcttatgtcagcttggtctttttaacagggctccaccctgccaagagaacaaggcctacatgggaaattatgaagaacacacacacgcaaaaaaaaatctgagtttgctttgtgtagggatttaattactgacttatcctgatgcttatgtatacttgcagcttagaaaagtgaagacatctttctgggacagttctgggaaacagaagcccatgcgcactaaaaggaaccaaggaatgttttccatgtatcctgagctggacaccaaacaaatgtgttcctctttctttgctcacttagaagtcttcttcctgtcctgggttaattgacttcaactttgaaggagatgatgtttattttcatcttcgaatctgac

SEQ ID NO: 2245 - DNA, 1149 bp, Homo sapiens
gccgctgtccccgcgccctgcgcccggtggccccccacctccgccccgcggccgtacctggcgccccctggctcccccggcccccgcgcggcgtggagccatcttccctcacctcctaccggcaccctagcttgctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcagggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggtgagggctggggtgccagggtggggctgtgccttaggcgggggcaccctggccacacccctgcttcccgcaggccacaggccacaggccacacaccatcctctaggtcagacctgcagggggcacctggtccagcagctctgtggggcatgggcccttccagcatctggcaccctggctgagctgggcccccaagtctgtctgagcagagggctttgaggggcagcagccacagcggccttgacaccctcagtctggac

SEQ ID NO: 2246 - DNA, 7616 bp, Homo sapiens
agcccctagcgcagacggcggagagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacaccccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcttcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactccgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaactgat

SEQ ID NO: 2247 - DNA, 9851 bp, Homo sapiens
cctgggtgctaagcccctcattgtcccggggggcagggttggccggccggccgctccgagtgtggggcccgccaagcccacacccacccggaactccagctggcccgcaaatgcagcgcgcagccccggttcccgctcccgcctctccctccacacctccctgcaagctgagggagcccgctcccgccttggccagcccagaaaagggctcccacagtgcagcggtgggctgaagggctcctcaagtgctgccaaagtgggagcccaggcagaggaggccccgagagtgagcgagggctgtgagggctgccagcacgctgtcacctttcattaggacctgctaattggtttcacatgtgtgtggaaccatcccaggactggattccaatatgaggagagaaatgggttatttcactgaaaggtatgactgagttagactgaagaaactcttatatgacactgtactatggctttaatgagcattagtgttaggatgacattttgtttagagagatattgatggtaaaaaagaaaaggatttgaactccagttcaccatttcctaagcatgaccttgagctattcattcactctatgtagtcatttaataaatatttattgagccctatataggccaagcactctgtgaggtgatggaaattctcctgccctcaaaaagtaacagtaattattatttgcaatctacctccctaaggcataacaatgcctatctttcagagttatgtgtaataggatttgtaagtggatttttttttgtctcataattgtctacttggctccaaagttagagacaaataggtgaaaattaggagacaaatagatgattggtaaacaccagtcattaagaggcaaattcattctgctactccgcttaccactgtactcactaatcttgaggggactactgaattgtaaatcttcagcctcagaaagggttctgtgtcttttccttttactctttctcagtgccccttatgcataatccaatggagtattccaaggaaaatatttttaatgactgggggttgcctgcaataagttgagcctgaaatctcatttttcagttggatacctactcatgtcatggatctgtagtattctttttgcttactccagcagtaggaaataatatagggacagaactcaagagagagaaaatgagcaatagggcaatgaggcacactcccattgtctggtagaaaaaagatgcatgagtcttccatatgtcaagtagatactacaaaggtaccaggcttgaactattgtgaagcaagttcatcctagactgtgacttactaagagaagagaccccagcagcaaaagcctgtaaggtgagttatgcaggaaataaggagactggaagaggtctacaggagtcgatttcctatgaaaggaggttgtgcaatgaagagactgcctgctacatggaggacagaggtcacaacaacaactggctggagcagtggaaagagaactatgcacaaggatgaggagaataattgtgattgtgggacagggccccaggagagaggtatagcagactggccttggaaagcctgcagctgcatcaggaaggcaaagcatgcttggaaaaaatgctgactgaagtaaggcagaacctagagggtgggtggatactccataactgtattcaaattgggcactctcttgttgtaaagcctttgcgtaagtgcaactgagaaaatatatggtagaaaaaaaaggctatgttctgaccagctcgaggatgggggaatatcatgcataatatgtgcaaactatgtgaagaaaagtacaagttaatatgatcacaaaaatattcagaaaaacacagagtgaaggaggtaagacaagaggtaatgaaataattagtgaagtatgggctcctgtgcaagggaatatcttgagacagatttttgaagagaagttagatgtgggctgatgaagaggaactgtcactccacattgagggagtggtctctgcaaaggtggtagcttagcttgggttcctaagaaaagagtctgaggttaatcttatgagcacatgctttattgtagagtacaagtccagagaagcaagtgtgacaaaaaaggaaggataggaaacaaaaagtcatgttattgagctctggttataggaaatttaaatggttactcagttacactgaacatctccagagagattcatgaattcacggcaccttagaaaaattctttggtggaaagaagggcaaacaatctatctactggcttctttccatctcctgtttctcatgcttacttgacctaacaaagtgttaacttgcacatcttccctccagacagctgctgggttagtaactaactccaacttagttactggagctgctgctgtttctgctgtgatgagaggtatggaggccatgtcaaagcctggctttttctccccaggatttgcagggaaggctgcaaaaaccagggtgagagatgctgagtcttctgagttttatgaccattggaatggcatgagtcaatcaaccattgctgagctcctctgatcaggactctgggcaagcaacagtctggggctgagggtagatgaggcccaggaggatctgaggaaatgtccaagataggtctggaagagtgaggaaaatggatgatgaaaacttagcatgtctagaaggagtgaggtctcaacaaatgtgtaacttagtgtatgtagtattggagtgacgttctaggaatggccaaaagctaggattccataggctgatttgaatgaatttgagatgtgtgcccattttgttgtgcttattatggctgatcctgtagttttagcaattcagtgatcatctcaactttcttcctaaacagctgagcctggaaagctaaaactaacacttttcagacttcaatgaaattactgttctgaatatgattcaggttctaccaaagagatgtattcatgagaactgaatttagaactgaaggaagtggggagagaagcatgagctgtgatggtagtagctgctgggtaagtggccagcagccactatggtacttcctatcatggcagagacaactggtctcagaggtgcccagttgtgtcttgtggctttggacatttctcctggatgctcaacctagagactgtttatctctcaagtgatttgtaaaccttttaatgctctgtgaaaaaaaaatttaatcccttttgcctaaaccagctagagtggattctattctgaggaaatgaccatattttaaaggtttgctggagaagtctggatggggggtggagagaaagaaatataaaaatagagatagaaatagctaaatggagggtagagatattaattccggctcttagatggtgggcaactcactacccacaattattaaatctgatttttcctctcagcacacattcatatagataccatgtatgaagaatacaggagaaccctgaaggtatccaaatgaaattgacttcccagtcatcattaaacatttaaagaacttcaacaaaacatgctccatgttaaggactttagcacctaaaaataaggaaagatgcagcttttgattttaaacatttattgttttcaagggaaagccttctgtatccctgcacactttaagcaggtaaatgttagattgctgcatcagctcctggactctgcataacttctgatgtccttctggtaaaccttgatcccttattgcatcatgtgacctcctctcccccagctctagctctgcctagccggtaagtaaaaggttattttcaagaagctgcagttagataagtaaataacaacttgtacctaatttcatattttatctgaaggtgtgcggaaggtaatacacccagaaacattaaataactggtttacatctaaacggtttttgactaaaaccttaaagctagacctatcaaagggctcaacagaataaaaagtgtttccctttgaagaattctgtgtccttagaaggcatttaggttatggtagaaatgggttttctttcaataactttaagaggaaaaattacttaagactggtaacttaagactgacactatgtgaaagaagcaaaggtgacatttgaagtaatcaattatcagaggctttttaataacattccagtgaccagtcttgatgtcttgatatttctcaccaaaagcaaggatagttatttgcggaaatctcaacccaaagtaaacttatattggctatgctgaaataatttaaaagatatgaactgttttctacatccgtactattttaagtgtcatcagcaacattcatattacccaggaaactgttagaaattcagtcttaggccccaccctagacttactgaatcaatatctgcattttgacattgccaggtcatttttaagcacattagagtttctaatgtcctgttctagatgctgtaaaattattcataaggtcacttgttgaaatgattgcattcagcacttaaatatgttatggacaatgtccattaaggatcagcaaatacttatttgtgtccatattagtgatattattatatgagtttttaatttatgttatatgggttattaatttagtcaatgtttcttgttctaataaagggctctgattttaaaccattttatccaatggttttcttgagcttcctaaagtggtaaacagtctctgttttcttcttatatgttcttgtagctaattgttttaatcatctttttgttgttacttcagcctcagtgatgggttactatttaaggattctctaaaagccttctaatataccctcaatgtggttctggcagactctgtctacctgacagccatttccacattctcctttgtttacagagccacagtttggttgtgttgtagtgtttttattcctagtctaagaaaatcatgatgatcttatgttcctttgccatatacttaatttttcatttttgtttatagctgagggtgatcacatgactgagatctgaccaaaatggggtttaagtagaggcttatgagaaagtctttgttccataataaaacagacagggatgaaaaagatagcttattggctcctgtgatcctttctttcagcctacacacagacaggatgcttggtgctatgacagccatcttgaagccatgaaatcataaaaacaaggacaaaaagtcaacttactgagaatggtagagaggaagaatagaaagacccaattcctagtgacagcattaagtcactacttatgtcctgaactctgtatccagagttcagattttgtaaaaacaaagcaaaaaagaaaacagaaacaaccctatctatttatgttattattaatttactttgttatttgctgctgaaagcgttcctaactggtataaataagaaggactaaagaacttaccctcgtcagagatttactctgtaagtgagcatggttgttgaatatgtgaccagtctaagtagtgaggcaacacagagtggaagaatatctggattttgttattggctcctgtacttctcagctgtgtacaaagcaaaccttgctttacaggaactttggctctctatttacaaggtcagtgtcaactcctagtgcctttttttaatttttctggcaaaagggaaatgggctaagttctaggaattttcctttatgtgagtatatgaggttttctaaaactttctagggagtcaaatgttttccttgctattggttgcttctgataaattaggtttaatcacagtatattcctagtagtaggtttttgatttttgaaatggtgatttttctttctcttttggggatgaaaaagaaaaatgaaagcttaatgatattttctttcaaagcaaccgtcttctttttcaagataaacaaaatattatgctaaattgaaaccaattttatgaaattatattttaaaaaaggatttcaaaaagccatatctaagtcttttgaggaaaatggaaacattataagaaaaataacaaagcagcatttgtagtattttaggtctagtagacttaggtaaaatttaatgcacgcttttcaacctggttggctttaatagtccacagatatcctggctgaatccaccaaggtttttaacaatttgaatttgctaccaatagttccttttttctcatctcaccttacactgtctccatgtcctgatgtgcttcaactcagaagcactggaactctcttgataccaaagttgtgttatggtgtgtgataaggttgatgatggtgggtgttatgggttgaattgcatcccccaaaaaagatattgaagtcctaccctccaggacctgtgattgtcaccttatttggaaataagttctttatagatgatcaagttaagatgaggtcattggggtgggccttaatctaatatgactgggttcatataagatagaatagaaacggaaggaagagaagatggtgtgaatacacagggagagcaccgtcaacaagtgaaggaactcctgaggctcctgatgctaagagagagagacatggaagacattctccctcacagcccccagaaagaatcaacttctctcatactttaattttggactccaaactctcagaacaatacagttctgttgtttaagccacccaatttgtgctttcttacagcagtccctggaaagtaatacagtggaggaggacccccatgattacattctgcgagaggagttcctaagcattgcagcatgaaaaacagtgcttaaaagcttaagcaatatttttcaaaatattgacctatctcagtaggaactgagataggcaacaaatctgactgacagaatacatttcaaactttcaaaattgtgtcttcctcttactgtgggtccttacccctgaacaaagttcatcacacctggcttcacgttgcagggtatatttttttgatgcctgccttatctggcttccagtcatgccctggaatttgagtgtctctcaaatgtaaaaatcaaaaagtatattgtaaaaatgtctatactatgcaaagtaatatacagattcaatgcaatttctatcaagattccaatgacatttttcacagaaatagaaaaaaatctaaaatttatatgaaaacatcaaagacatcaaatagccaaaacaatcttgaacaaaaagaacaaagctggaagcattacactatttgatttcaaaatgtactgcaaagctatagcaatcaaaacaacatggtactggcacaaaaacagaaatatggaccaatgaaattgaacagagagcccagaaataaattcacccatttacagttaactgatcttcaacaaaagtgccaagatcatacaactgagaaaggacagtctcttcaataaatggtgctggaaaaacttgatatccacatgcagaagaatgaaattggacccttatttcatcccatatacaaaaatcaacataaaatggattaaagacttaaatgtaagaccagaaactataaaactattagaagaaaacctagagacattgacattggtcttggcaaagattttttggatatgaccccaaaagcacaggcagcaaaagcaaaactagacaaatggaattacatcaaaccaaaaaaatagcttcacagcaaaagaagcaatcaacagagtgaagagaaaacctatgcaatgggagaaaatatatgtaaatcatacatgaaataaggaactaatatccaaaatatataagaaattcaaacatctgaacagcaaaaaaaaaaaaaaaaagaaaatttaaaaatgggcaaaagatctgaacagacatttctgcaaacagaatgtatgaaaggccaacaggtatatgaagagatgctcaacatcactaatcattggagaaatgcaaattaaaaccacaattagatatctatcatctcacctctctaagataagcatttgcaaaaatgtggagaaaagaggacccttgcacgcagttggtggaaatgtacattagtatagcctcatggaaaatagtatggaggttcctcaaaaaattaaaaataggactaccatatgatccagcaatctcacttctgaatatgtatccaaaggaaatgaaatcagtatggtaaaaagatatctgcattcccatattcattgcaacattacttgcaatagccaagatagggaatcaactgatgaatgaataaagaaaatgtggtatacataatataatggaataccattttgccttaaaaaggaggaaatcgggtcatctgcaacaagctaagtgaaaaaaaccaggcacagaaggacaaatactgtatgatctcacttacatgtggaatttaaaaaagtttaactcatagaagcaaagggtagaatagtggttgccagggactggggctaggggtgggagcagggaatggggagttatggtcaaagactacaaagtttcaaatagacaggaggaataagatctggtgaactatagtacagcatgtgactatagttaataatattgtattgtacacttgaaagttgctaagagagtagatttaaatgttctcatcaccaaaaatgataaatatatgcagaagtgacagatatattaatttgatttaattgttccactgtgtatacatatatcaaaacatcatgttatacaccatacatatatacaatttttcaccttgccaattagaaataaaaattattcatataaaataaaaataaaaataaaaaataaaattcaaattcataacccaaatttccctagacctctgcttcctctgcatataacatgtttgagtctcgcctaaactcaaattggacctccacagtcttagcaaaactcttttagaaagtgcaataatatttcttaataatctgtcccaggttatcactttccataagaatatccttttttgagttctccttgaaaccatagttcaaaacaaatgtgtttgttcttgcattatttttggtagagagaagaactatgtgataagataaaccttaagataaatccatgtctattggggataaaagttttcagttattctgctcttcacaaactaaccctagttcctctaatcttaaaggttttagctttcaacttttagttatttgaattttgggggaaagatctcacatcaatttctccatgttaagatttaaataaccaaactggaagttaagtttttttttcttttttgacagagtctagctctgtcgcccaggctggagtgcagtggtgcgatctgggctcactgccagctccgcctcccgggttcacgccattctcctgcctcagcctccccagtagctgggactacaggcgcccaccaccacgtccggctaattttttgtatttttagtagagacggggtttcaccgtgttagccaggatggtctcgatctcccgacctcataatccgcctgcctcggcctcccaaagtgctgggattacaagcgtgagccaccgcgccgtgcctggaaatgaattttttacacaccaagtgaaaataagtggtatacattttcacaggaaattttcccacaataaaatttctagatggaagttcaagtccttgtgcctgagctccttagattaaaaagcatagcagttatttaacactcttttaaaaaagaaagtatgaagacatggtgaaactattttgcttatcacattgacattcctttgagaagaaagaaagaaaatgacatgtggttgggaattcttcagtttagccctatagagatttttaaaaatgttttaactttcaaaggcgcttttatagagctataaaattgcctgtctcctctccaggctatgctgtacacaaatgcaattctaatttttatcgaatgc

SEQ ID NO: 2248 - DNA, 760 bp, Homo sapiens
tatggactacctcacactgccagcagcacacactgagctcacgtctcctctacatgttcctggacttttgctccaacttaagtatagaatgcaccccaacttaagtatagtttaacacttgattttcttggtttcaggccatccttctgggtcgttttgagtgctgtttggatctcaatgtgatcatctggggaatgtgctctcttttcattggcgtcatctgaaatagaataagcacgtgcttcttgtcttcatctaagaggtgggagaaaatgagaaacaggacaggaccgagggcagagtctcaggaccagagactgcccaccaggtgcagctcatcaaactacttccttcctcacaacggactttgcgtatgcttagcttccagcagttcatcaacagaggcaagcgccagaacccagagctgcctgaagcagacaggatgcacttggatgttcgagtaaaaagctggaaggtcatcctcttcaagggagcaaggatggacacacagtagctgcgtctggtgacaccgccccaccttcctggccctttcctgcttctcatcttgattgtggattgccagatgaatgagaaacctcagccccagggcttcagcagtccccacagtgaatctacacgtgccttggctgcctgaggattcgatgtcgtcagcagtggtcaggtcaccacctccccacatgtacaagtccttgactacccacaccggtcacatgttccccgccctctagggtcacggtga

SEQ ID NO: 2249 - DNA, 1692 bp, Homo sapiens
taacattgaggttgagagattgtggtctcctgagtggagtcacggggcagccatcttccattatgtatcctggaaaacaaaacagctggtctgctagaagacatgatcagaccacgcagtgagagacagacacacaaggcagccatctgggttcctaacagttctctggttcccagttccatcccatctgatgcctaatgccatttcccactttggaatatcatgagatgactgtgtattcgtctacaaaggaactgaggcaccaagaggttatggaatttaaccaaggtcacacaatcagagtggaggagctgggatttgaactcaagcaggctagttccagagtccatgctcttatcactacgcttcctctgaagtcatacttacaggaaaagagcaactggcaatccgatttgtgtgagagaatggaatatgtcgactctacctcagaagacagccaagactctctgtagactgtccatggcttctgctgctgggatgcactaccttcaatctttcctcccactggttctatggctgctgaactaggaactctttgagaacagtgacatctcctatacctctcgtacatacctccaccactgcatgtatcaccctgacctgtaagttatcccctctgtcattcttgaagtcaggtacttgttcttatctgtctgtgtaaccaaagcatttatgacagcatctggcacgatgcatagttggtcaataaatacgtgttgaatattcaaataatgcttaatgtttgtcccaggttttagggaaggaaaagaaaagataccctattgtttctttctaggttgtctaggctcataaatgaaggaaaagggtcaggaatatggagttgaaaatactatatatgttcttagattatgttcctgtcctgtattctttcaggacactgaaataaaactgctgattacatcaatgaaaacaaatattctagtctgggtggtcaggcttctagaatgctcgcaatgttgatatggatgctgtttacagagatgtgttctacagaaatcgttctaaaggagctatacattcatgatgtgaacttttctgcatatactttatatctcaataaatattcctaaagcaaatgctacaaatccaaaaaatatttgtcctataagatttaaatttagtatcactctaaactgtctttcttttccatcagaatcaagttagtgaggatcttagaggtcacaaagtctacctctgtcctgactgatgcttacatacatgcagagaataggctgaatagtagtacacttgaaatgcaggagagcacctggaaaatatatttcattcatgatagcaaaacattactttgcaaccactagagtaatcaatgattagggcaaatattatccatgaatgctaaaaccactgagtagaagtttagtggtaaatggggtatttactttgtctcagtttttctccctgcaggtcatttattaattacaaagggaaaagatgcctttacagtggaccacaaagtgatcagagttaacatcaccaataatgaaacaaagtgacattatgtgcctcctaataggatgcactggcatgggatagaaactcacctacataatgcttctgacagaaatacatatcctgaatctaatcacaagagaaaaaccaaaatcaagggccattctacaaataattcca

SEQ ID NO: 2250 - DNA, 1856 bp, Homo sapiens
cctgtccccacggccacctccctccccacagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttccgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtaga

SEQ ID NO: 2251 - DNA, 3940 bp, Homo sapiens
cttttattaactatccagaagcaaacttgaaataaaaagatcatattaatgttaagcacaaaaattaaacaatagtacattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaatgtatttacaggggttatacatggtatttagttcagttgctggactggaagtgtttatattctttttaaaagaatagcagtttttattccagaaaaaaatattaaattataggattgtttttgatatctagactcttttgctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaattctgacttattctcaattttccttttaatatatttctgtatccttaagctaaattagtgcaagagaccaaaaaatggattcacctggggtgtttgatctgcaggacctgttttagcacatgtaatcatggtggaattgcataaggcctgggggtgagagtaagggaggtagcttggctctagcaagagaatttagatgtagtaagagaaatgtctgcagtgcttgttgttagtatagtactgactacaggaaataaactttctcctattgcttagaataagtaaacactcagtttagtagcatgtattgtacaagagttaattttgcttcctttagttacttccctgggaaatataatttagactgatccacatcatggatttgtgtatttcaaaaacagaaaagaaaagaaagagagacagaaatgcatgataaatgacctaagcctgatcattgtgtgatctcaggtaatttgcatattggtgaaaggaatctatacactcactgtaaatttagtttaggctcttatttctcaaagtatataaaattctgctgaagagatcaggcaaaacaaagccaatgcaggaactgtgaaaggacttcccttggacaccttggtccctaaaagatacttatagcttccagggacagttgccagtgacccctggattttactggatccaaaatggaattttttgcagcacacaggccttttaaattcatcagtctcagctgaggtctacagctttcctctctattcaaagaaatgacaggttaaaaggtcttcttaatgactctggaatcaaatttttatttgagaagatatttattttaaaatagaatgactaaatacatcttaataagccctaaatatatgctaatgtaaaagtttctttttgaaggggaaaaagggaagtgagaaatagaaaattcagatccagggaaccgtcaatggcattcatctaggagagttaatttaacatacacacattaacacataattttatcttttgttaaaaatgtgtatttactcattttattcctatttgattagagcagagaatttatgtatcgctacctaaaattggttaatagctttcgccctttcaaaaatactcagtgtcctcattttagcttcagcttctttggtttggatgcagtgtgtgattttttttgtgacagtaagccagtagttattatgcatggggaatcctggtagaaatgcagtattttgtgctaattgctaacagaaagatctgtaatactggctgcatgatttgccccttacatgtgcccagccataacaatctgaatttagtactgtgtttgttaatattagacacaaatttatcctgacacttttataggcaaagcctcggaaacatttagtcatgtaaaatataatcatggtcttgaaatatttgcttttgctcctgtgcattttaggcaggatttcactttgtaaccttattagtattgctgaatttggagaatggtttggaaaggttctttgaggtcctgattgtaagataggtgttcatttacactgagccattactgcactttatcaaagaacagttgtttacagaatgtgaatattccatgtctctacacactcttcagattttccctatgatagtaaattacatttggttttaatttgcattccatttccaatgtttgttgccagacactttggactttttgagggcaaataaaagtagcttctggtgtaagtgaaatattttgtgtcagaataaaatagcaaaccattatgtaaagggcactttccccatgtgtttaccttataacttcatgagctagacttgtacagaagctttgaaaaaatccccatggctgtcatattcataagtctctctgacccattcagacagatgttagtatattgcttggagcgtactataaaacttacctttcacttatggaaatgtgcttgtactttgttccccaaaaagcaaatacagataccataagacatgggataataataaacctttggacacagaaacataaaatggaatgtatgagcccttgaaagagcaattaaatacattttcatttcaacagctgaagatgaggaaccaaaacagatgggcaggggatagaataaatgagagaaaaatcagtattcatcatgcctcttggcattctagtacaccgtagcatattacagtacatcagctctagttctgcattctggtccctgatttattcttgtatgaagtaaaaactgagaaaacgataggtactttccttggaaatttctggaaccatctagtaaggagtatctagccatcctgttatcaacaaactgattcaattccttcttggaaataggtaggttatatattattaaataaattaaagaataatttaatgtttgctatcaaaggcacacactgccctaaaaagcatggtgaaacatcctattatcattaccaagtatctttaaagatcttggaggtgaaaaaagagcaaattgcttgcttgcatcctaggaacatctgcccaaaatacatcttcactagaggtcaaatggaacttttaaaacaatgatgaacttgggctcagtgagagaagaaccttcctattcttcataattcctaataaaattataattgttactactgctgtttttaacctatgaattgcagcttgaaagtctctgatctgaatcacatgtgcaaaacttgaaaaagtgtgtcagttatcgattgtatcagttatacattccaaagtttagtagcttaaaacaacaagtgcatacactctcatgattctgtaggttggcaatttgggctgagctcagttggacagatcttccactgtcacgcctaggggctcccagatggcctcaagcccaaattggggcctcaactgccctttcctctctcacgttgcctcccttcctcaaggaggctaacctgggattgttctgaaggcagcaggggtccaagagtgtgaaagcagaaagtgcaaatttcaatatgttgctctgccacattctgttggtcagagtatgttgcaaagctaacccagattcaaggggaagggaagtagacttcacatcttaatgtgaggtgtggcaaagaagtattaaca

SEQ ID NO: 2252 - DNA, 6788 bp, Homo sapiens
ccagggttcacccagcatgcatcgggtctcaggaacctgcgttgctgatggatatgtgaatgaggggatgaacaggcgtggaagaagggggagtagggagaagacagttgtatctttgcattcttcacagagcctggggcagcacttagcacaaacagggctggctacttaaaacccggggtcactcgttcaaaaggcaggaaaaaaagctttttcctttcttcgtgttctctctctggatctttcatagtggtgtgtgtgtgtgtgtgtgcgtgtgtgtgtgtgaccttctatttaatgtcacattcccccaggcactaggatactctcactgccttcaactgggcaggtagaaggcatccatccagcccccatcctccctgttgaggagttgggggagtctcagttgctggtcggggcaggaagtggacagtcaagaacccagcgggatggagcagaaggtgggccaggtgtgagttgaggggtcataccccggcacatgtcccattgccccaccagagttccctcacaaaacacaagttcagagataaaattcttatgacatatgaaggtagcagttacagagcattaaaccccaagcatgaggggctctcttctgagtgagggcctgagcactgctctgctctcgtgttcccgaagcccaccctgagtacgagaagtgagggtcagagccctgcagggtcctgcccatggtgactggcgaaggactttcttttccgggggagcacagccagagctctcttctctgattccatcattagtttctggaaaggccttccctgcccactctatctgatgttacctatccaacttccagccccaagttactttctgtacccccgttttactttatattgtcattaaagcacttaccagtatttggaactgtggtatttacccattttctcacccgcaagaacgcaggccccataggatagggatcccatccctctgtccccttgcacaagtgctggcatgagagaggcacccagtgaattttaggtgcatgaatgaatagtctttacgtgactttgtatccttttaggagcaagctggatataaataaatacatgaagtcaactaacacctccaagtggctcagtcaattttcagtgatttttctctgtccaacaccagactggcttcagtgatttctttcactgatgtggccacatttgttttgttttattttgtggccatgcagcccgatgtcgcaggggctgttggtcctcctgactccctgctggaacgtaagggagagcctcattccaggtctgcactggccccaaactgggccaagactgcacatttcagttcactttgggtttctgatagcagttctctccccagcccccatccctaggattcctaagagctaagggatgtacccaccaatccaagccacctactagcattgaacttctgtgtcttgaaaagggattttgttttgaaccagtcactgggagatgcgttctaaggtgagggcttccgggtcaataaacctgtaggtgtcgcccaccaaaaaaagtaaatctgacctcagcccagtcccatggtggtgcctattccatcagggcagagagtcagcagctggcaagagaggctcaacccccaccactcctgagagccaggaggccctggcattcaaactcaggcttcacagatccacacatctttgttctcagagaggagaacccaaagtgtgtctcccagtgagttctgaggatgagggaattatgaaaggcaccgtgtccacttgtgagataaaccgacccacctggttcctcatagtgggaggtggctcaagtgtcaagtggcccatgctacctggtcttcttggttttcttccatccgcgtccctggagatggttatgtgctttgcttcttactaaatgtatccagaagccaaggcaagctaggaggaggagtgggatctggatctgcagatccagaatagcaccgcaaaattacccagctggggcttagctgactgtccagaccctgacggtggggtttagaattggatagcatccaagcctttctgtgatttcatcagcaccatcatgcaataggttgtttaaacaccgatatgaaaacctgttttccaacgatgctgcaacatttgattaattcttctggatgggatatcaaggtggctaaagcaagcattgcttgcagttatgatgaatttgctgagtgtcagaggaaaattgtcaggccacaaactaatcattcttaggtgcctcatttagcattctgtccatgtttataccaactctacacgagcacacacacacacacacacacacacacacacacgcacgcaaagtattggagaccaccttgaactaaatggatttgacctctatttgtaaagggtgcattagcgtgaaatggaggggggctttctttgagggttcagcaagccatctagcctacatgctgctgtcttagatgccagccttggtcttaaagagcctggtttctaagggaaaattcatttcatggacatcttgttgccaggaatcagtgtgattcacttttcatttcaggatgatgttgagtcctctgtgttattcccagtgtggacgtggagtagtgactgatgtctaattatttggaagggagagagcttctctaagaaggacatgcaatgtcagaagcttccgttgcttggcaacacgtaactttacctatgtttcaccaaaggcagtttaaagggctaaagatgcccattcaggcaatagtagattacaaggaagatctcgaaagctggcccgtcaaaatcgctttccaccatagaaataaacacctaagagagggtttgggacgtgagtggttgcgtgttgcacaccagcaaacagggtgagaaagaaggcagtggtgccatttttccagaatcatactgtgtacatgccctgttaaagttgattcaaattgctcattccttacagtaaaacctccaacctgagactccccttcagaatgtatgcccctgcagcttccccagtttttatgactgtggcacctcactggaacccatgccagccccttcccatccagctagtatgcctcccggcattcggcttcagcctccagccttgtttcatgtcagcagctgagctcatgaaaactcttctttccaatgaaggaggaggctgagaggtgcaccaatggctggatccaggcacacgcaggctccgagttcacagaagcagggccatcatgtcccggctgttgggagttcctgtgaatgttgcaactctcatttctttttgaagtgggtgtgtaagaagcatgtctgttcattgtggcagcctgagttttggaggccccacaacattctttcctatgtggaaagagttttctttttaattcagaaacaacaaaccttctcagcctcaaaccaggccaatcttacagtgtcatggcaaaacaaagaaagaaagaaaaagaagaaattaaaacatgcaaagcaaaaaacaaatagaaaaaaaaagaacacagtgcaacagtcaaaatcaggttaacttaatgaatttgggccgaacttagatttaacatttccttgaagtttggctcccataaatcacctgtctttttcaaacagcagcctctgaagtacaatccagattatttctccccttttgatcaatgcttttcccgggaatcaaacccagctcttaagagcatttataatgaaagctaaagacagctgaccactaactggccctgaacacccaggtaaactctgagtttgcccacaaggaaaagttatggcgtccacatgctccaaaggggactccatgttcaaggtaatctcccaagtccctctgctgctgctggctgtgaggcatcaacatcctcccccaacctggactcaggggctgcagcctcagaggaccagcgtcgtggagttcaagttcagttcagcacttgaatagtacatccttcaggaagccagggcactgaagactgaaaagcagaatcctaacattcatgtatattttaaagccagagttcacaaatcggagaccttaggaattaatataagtacatgtacatgtatttgtggctatgtgtactagttacaaataagagacaagaaaggagatatacaaataggagaacaaagcatattcaaaaatgaatatggcaaaagttcaaatgaatgtgaactaacaacaaaaaaatatagtttctcatttctaggcatattacttctgctttttcaaaaccatttctcaagttattgataataatacgaattctgtccttaaattgctcagtgaaggagagtaaattaatgtattttaagatgatctttctgttttgaagtcctgctgcttccgtcacatttacaccagcagacacggacacttccatctgtccccattcgtcatcactgtgagatgaagctaagagttcgattcactaagttttatatagccagtaccatgtgaaacacaggatttgatttaagtgtgtggtgtgactgcaatgggaagcagtcgaacacacagcagcaatactgcaccatcaccatgacaaccagtggaaataatggccccctttgggaataaaagagatctcaaatcctgttgcagtcagtagcgctggctgtctgcagtagagatggttttcaatgattgtttcagaaattccttatcaacagaaaatgaacgagacggggagttttcagaaaataaatggatttgcagacaacttaacgtcatcatcgaagtcaccaaagaaagcaaagcagcgactggggaagctgaggctgaagtagcaagggcatgccacccaggctgctattccagtcgctgtgaaagcctggtcactgtctttgccacgcagaacacatctctgggaatgctgtcgatctatgcctccatcttttaaaggctttccatttctgtctggattttttctttatgggaggcagaaataatagtgaattgaatgaaatggagtatataagtgtctagcacagtccttggcacatagaaagtgctctgtaaacagtacttcgcatcaaattcttgggatgaatgaaagtgagtgcctggcgctgcacataagaaaagacgtggcagcaaaccatcctcccgacatgacgtgctgcgttggtgcgtttacgtccctgttccttctgaaagactcaaaattgtgttggagctactggtgcacctttgtaagacctgcactaacgaccgcgccactgggaagggcacttctttatgaagtcgccgtattcccagggagactggtcaacccatacaatgtgaaaaaaaaagaagctatgtgaaaaaatattcccctttgtcatagagaaggagaacttggtgaggctgggcagctgcaggagcctcagtttttcagataacagaacagagtagaccttgagggtccatttccctttttgttttaggaagtgctgtagaagggggcaaagagatctttgatatgagaaggtatttcttcaaagcagcatcgtgcctgaaatagcattgttctttacgctgagagaggaggaaatgggaatttggtgttcaacgggtttaaagtttcagttacaagaaatggacaagtccgagagctctgctgtgccacatcatgcctaaagtcaccgagactgtgttgtacacttttttgttaaaaggtaaatctcatgttaaatgttgttactacaattaaaaagaagccctaggctgtgtttgcagaaaggcactaaccatacatgtgctcaagagcccttttgtgttttcttcacttcatgttgtagttcaatttagttttgctttgcaaggatcctcggaaagtgtatcatcagcaatgacttttattttagaactaaatgtgaaccacggggggaatcatgatcgacattgctcgttgtcctttcttcctccctgtgggctgtgaatccaactcgtcctgggagcagggcgctctcgccttctgttcctctccgagctcagtgcacagaagcattctgcttacccagctgggactgctgactgcaccatcgagcacgcaggttgcactgttctcagcagctacactggattatatgccgcctttcttactgactgattatgaacttaaaacaaattcactctgctgctgtgaattatacatttatttttaagcatttatttcaactcgagatgagcggtctctcctgtaaatttctccctgctggatctttgctctggtttctggtgacatagtgtgagtgccggcagccgcgagcctcagaaggaaaattacaaagggaatactcagtaaatgatgtattgcctttcgcatcagtagcctgcttggaaatgttcaaattatcagcccaggagactccagtgctgtggacatgggtctgaacgaattgatcacctaggggctactgagaacgcggtgctctgtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaaggtacagaagctgctctctggctggggcttgggggaaaatgtgttcttttttag

SEQ ID NO: 2253 - DNA, 1826 bp, Homo sapiens
caaggatatggtcaattttagagagtgctttttgcacagatgagaaaaatgtatattcttcagttggttagaatgttctgtagatatctattaggtcaatttgttcaagagttcagtttaagtccagagtttcttttttatcttaagagtatgatcacggtatatgttgtatatggtcatttggcttttgtttcattatttctgcatcaatgatctgtatagtgctatcattggagagttgaagtccccaactattactaggggctattatatggctgtctatctcttttcttaagtctagtcatactttttgttataaatgtaggtgtttcagtgatgggtgcatatatatttaatatagataaatattcttgttgaattgaactgtctatccttatatactacctgatatggtttggctctgtgtccccacccacatctaattttatagtccccataattcctgtgtgttgtgggaaggacctggtgggagatgattgaattataggggtgggtatttcccatgctgttctcatgatagtgaaggggtctcatgatatctgatggttttaaaaacaggagttgccctgcacaagctctctttgcctgccaccatccatgtaagatgtgacttacttctccttgccttccaccaagaatgtgaggcttccccacccacatggaactaaaagtcattattgaagaattatgctactattccttgctgagatggatgagggaaggaaaaacataatcttattaacttttaaaattatatttcatttatgaggtaaggaatttatgaaatgaaacactaagcatcatatttcaggtaaattttgtgatataaatcagttgtatttatagattcaaagctaagcttgaaaaaagtctcagaagctaaggggctgatgaccctataaactgtaaaatgtgttaacaccaataaattctggtccctcagttcaaagggcatttgattatacgctgcactgtcagtgctactcacatcggagctcatcttggaatgataaacaaggcaggcctgtaatgtataccagagaatgacaagatgcacctgtccctacaagttttgagacaaaacagtaggcacttgcagacagctgtgtcatctatgagaaagtctactcataggctcaccaacaggcaagaagaaacacccccagccagtttagactacaacatcacaatgtttgcattggtatatcttttatttctctgagattattttgaatagaaaactatgttggctaaaatctattagtaaaattcctttgtatgtaataaagggctgttgatctctggtggctttcatttctatgcacaacattttaaagtattttaataagtattacgtaaatcaatgttaataaatgttcaattggcagaagaacatgaattattatataattacctttaaataatttgccttatggtttttcatcagtatgatttttaaacattctgagggtttgatttacatctctttaagagggaaaaattttttgccttaatagaaatttttccagtcctgaatgttttactttggtcatttatgcctaatcacgcatctctcacaaagaaccaccccaacaaaacagatagttatttaaaacttattacaagatgattaattgaaatactttatggtcagttcttatgtttaacagctggtacttgtgctggcttgttatcaaaggaatatttattgagcatttggtattacttattatttggaacatatataggaaattattcctgctttcttgttatgtatattctgaagaaaatctgtgtaacctcct

SEQ ID NO: 2254 - DNA, 9853 bp, Homo sapiens
cactgagcactgagacagggtaatgagatctggcattgctgggtggctgctttccattggatggtcagggaggcttcttggaggaacaggatttaacttgaggccaaaacggcacaagggtagagccatataaaactaaggagaaaccattttaggatgagggaacaaaccctgaaggtgtgaacaagctcggtgcatctagacatgtaaggaaggttccagcatgtgaaggagcgaggacggagaagggtccggtgaggtcttacagcaacagagggtccagccacatgaggctgagcagccaagtgatctgcctaggccagctccccttcatcttctgccatgagtggaagcagcctgaggccctcaccagaagcagatgttggcactatgcttcttagacagcctgcaaaactctgggaaagcggaaatctggagaactaaaatatcttgctgaagatcacaatgcagtaaagcatagggcaagtttccaactcgaacatcaccccagaacacttccttttaaacataaattatgttgctaacttttttattgttacttagcaggcagatttcaaactgatacaaatgttgaaaatgatacaaaatgttttcccaccttaaaggcattctgaaacctagcacataacatctgtcactgaagtccatagtttccaatgccatgattggataaagaccctattgagactcatgtgtttgtctctcactgcttaaaacactcatgtgttttaagcaacatgacaagcacaaaagagaacaagtactgctcctgctctccaggaagttaccataaaataaaggggataaggtgccttccaaagaaaaaacaaatactaggagaggtcagaggagaagagagattattccagaaggagagactgaggcagatttcaggagggaagaatataagagtcccaaaagaagaaacaggaacccaggttagagagcaatgggcaaggggtaggaggtgagactaaactcacaaggaagttgcttcaaaacaatagtgccccaaatgccaagctgatgggttggacccatttaggaaaaacccacaaagtccacaggagagcagactgcacttccatgagcttcaagctgtaaacagtaacctcaaataaaacttttcccggatcggtaatttccatcctgaacaatggccaagtcaaggaagctgaggatcgagccccctaccgcatgccacaaagaacctcaagggaccccatgctctggggagctcgcaggaggaccagcacagaggtgtgactgcgttggggcagggtggccacatgtacaatgttgtaccttccaatgttcctccttaggctgtgcttatgaagtcccaacatgtcttctgggctgtgttttcaaccaagagagttaataaaaagtgggatgggcaccaactatgcctccagagacatcaggcagaatatgccacagcgtgccatgtcctcctgcaaacagtcagaaagaaaagatctctaaaagcagattggaagagactatatatacagagcgagtgccggtacagaagttttgctgcaaatacaccctctaatcccttgcaacccactgcaagctcgagagaccagtgcccttggtaaaacataggagagatcattaattaaagcctaggccctttctttgatcctgagggataaggcttgggaaaatgcacagtgataaaagtgaacattttaaaagagcagagtgagtgtgaattcccaaagagaccattcatatcaagacccaagccatgagaaaatgctacaatgcccttgatcaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttgtgaaggtcacagagtttcagagttctaagatcccatgcgagattgctgaacttgaacttgtttcttctgatctcatgtcaataagtgacttagtcaacacctgggtagaaatcatcactaaagtgagaaagcacatggtgagggggatgaatcctgtgcccacatggtccctttcacctgcccaatcctcaggcctctcacctggggtacccctcacacacatggcactttcctgaactcatggacatttcagtttgtaacgatcctcctaagattatctactttcacctatccacatttgaactatacttctttagtggaaaaaaagaaataaagccagtgctgagaatgatcaaactccagaaatagtagactgctgtataatttgtcttgcgtgacaccagatctttcaaggaactgcaagctcaagtgcacagttaagcaagatcaagatctacctttgtctttcagagccttcccttggcgaggtcaaggatatctgctgtgagcctgggctggctgaaccaaagggcaatggaggcggccaagaagccccagccaactgctcccctccccaacccccttctccctggaggtcccttcagctagaatttgccattttctgtcagggttgtgcatttcttccagtcaccatgacttcctgagatagccaaaagcatttgctgtgagcagagccccatggctggctttgcacatcaaacatttcagacagccatatatttcatagaatacaaggggaagataacactggacacacagaactttccaacagcttgagaaaatgtggtgcctggtgactgactaaatatacaatcggacaacagccaggccatagcaaaagatggaactctgatccacaaggtgcagcaactttcccagaaaacaatacccttacccacaaaaagcaaccccggaagctggcctgctctaaatcagacctgctggaagccaaattgctctctagtaactatccaggaagctaaataataacttctgtaacaattgactcaaaatgttcaggactggattaataactgatggcttccctaatttttgtccccgattccaacttaggacccaccagagaaagccaaatatggtcccctgaccaagcacacaggatgttcgcttctagtgagccgcctccagcttccccgcattgataacctccaatcagggcacacctgaagccttcgcctttttccactataaagctctcccactcgtctgcccacctttgagtctctgccaaattgcaaatgatggtgtctgactcccttgctgtagcaagctctgcataatagcttgtgcttattctctttgggtaggtcttcatttcttttcacaccagataggcatcatctttgaaaacatctttactgggtctcttgtctccctcctgcagccactgatctaaatcacagacttttttagaaagagggaaaatagtaaagaaagaaagcgattgagttgatgctcccagccactgtctgtaccctgaattttgtttttctgccatatgtcaggtggcctctcctggaccatcgtcactgtttctcctgcttccctgcagctgcagacacaggagcactgtgtaggtctggccttgagcacccacccacccagtacagagccagcccctgctgttctgaatcagtgcagtgaccacttagaacacagtgcccatgcctctgtgatctgaactgctctttccagttccatacaatgttaagaacccacttaagaatgttttaatcattcagtagtttttcgtggtatataataaaaaagtgatttaaatacaatctattttattttagattatatcattaggggttattttacaaagttacctttaaatactattgtaaataaaattaataacaaataagcaaaattcttacttttccttgtttgacaattgacatggtcaatttaatttcctttaaattaattatgcaagaaaaggatatttcctcaagaaaatttaaaatgatatatatttcttggttgggtgccaaatattcattcagaagaagacggaaatttaaatccttgtttctaatttaaggaaaaaactactttcattattggatgtgtgaaattcacccattttgtgtttatctagaaaatctagtttattgtccaaatgttcttattttccccaaaagcatcagttaggagagaagatttccagctgccattaaaatacaattgtgtgcaatgaatacattttgggtatagatagtttttattctctataaatgaaatgccaaattggatagaaccatcctttttttttttttttcaaaaaaaaaaggcttttggagtatcagagacatcctcttatgttattttaaaataaataattatttgagctgtttgcttcttggaagcagataacaagggggcaggtgagataaaaaaaaaatatatccaaactgaggtgagaccaaagatggccaatctaagaaccaggcagatgtctctgcctgtcctgggaagattccctcaccaggctccctcactggccagaggagcccacttgttgggctgccaactggttcctataaattctaaggcaattagaatcatgtggtgactgtaacgggaatgacacagctgcccaggcattagaaggaaaccacacccaatggctcaagccagtggcgagagataaaaactgagagacatctcccctgactagcagactgggctccctgcttccccattgcttcctttaaacaggccattcacacatttgcctgaaaacttacagtggcccagaccctactccctatacacactgccagttgccatgtgccttgtttctctctctctgcatgatgcttcattcctatctggagtggcccagggacaaaggactgccctcccgactctctgtgccctccctgcccaggatccgtaaattacactttttgaatttgtttcctactgtggtgtatattgcctttgcaccttccatctgaagaccaggggatgccccaggccaggttttacctgggatgcccaagagagcacaaggtttggctcccagcgccagagcaatgggcaggggggcataaactgaacacaggaaaggcaagagccacaaagacatataaacaagtttcccaggcgaggagcccctggtcacaggtcagacaactaggcattgggccatctaccaggtaaaagcagcatcctatgaaaggcacgcagtaaataccatgtccatctccccttcatttccccttagggcggtttgctagctgttctgggactggaacctcagtttagctgggggctctcagaacagacagctagatgaattaaacaatgaagtctctcagccttaggcacatcttccaggacaaggggaaggccaggggagagtaacatcagtgatcctacaagatgtgcttccaggccaaggccaggttgcagttgcagctacttagccatggtacacggtgggcctggagcttctgggtgtgcaaagatgtgactcaagagtccatctgccagcagtgagcagggcaggccagctctcctctcactggtacggtggttccagccctcacaggacattaaaaccacctggaaactgtttatgaaggttcctatattcaggaaaaatccctagagattctgaccgaaggaatttggtgctgcctgggtaccagtatttttaaatttccccagatgatcctaacatgcagtctgagtgaaaaacccaagtttgacggctacaggaatttagagcttctctaaaacatacagggaataataccagggccatacattggaagtccttccattgggaatgcaaagaaaaaagaaaaagatggccaacatctaccattttaaagggattccagcaagcatattattaaatgcagggctgcctctggcatctggaagcagcttgggtgccctggatataattctcttttaaaagtttttttcacagcttttatagaccacttaaaactggccttcatcttgtgccaaaatagcagggctgtgtttgtttagcttcaagattttcaggtccaattgattaaaaaaggtgagtgagaagcctgccaacacacagtgaggctgtcacccaggcagctgctgctgctggcttccagcatccagaagctggaacatcagccagctccaatcacctgacagaggatggatcctatgagaaggaggaccggggcttaaaaccagacgtacccactgaagtcagggcaggagatgaaaatcttaacaagtgaaggaggtatgaaaacaacagattctagggatcagcaaccaatgaatgagggtccattttttgaaaaacaaatacttctactggctgtcttttgagtgccaggcattaaacaaagtggaagaaaaaaattggagggtgactcaacagatggaccagatcaataatgaggggtaatttgagcaggacaaggctggagctggaagtgcatgcaggatgccagcatcagagcagccaggcatcagagagccagccttgactactcgccgggcctcaggggctgagccttcgtcccaggacaagggagtggccagagcttggctggccccgttccagatgaggactgtgataccagtcaggtcaacgagcaccgatagaggtagggcccaatataggaccgtgtctcacaatggtgcagacccgcagtccaacacacaggaaggatgcttgttgctaagtcttagacacgggaactggaggagggttgagggcccccagcagtgggaaggcaggcatggcatgcagacggtggacgcggactcaagacaccaactctcatcactacaggtccgtggtttggaaagtcccagcaccattccagagaaggaaacaggcccaggtttctgatggggatgggtagtagccacagagcacaagtcagccgcacccaccacacacttgctgtagtgccacactctcggccctagagggcactgacgctttcccttcgctctgccccagggccagggccaaagccatcaagtcctgggcagagggcgggagcgttcagtgagagcagcacagaggttaaagagctgctcttttttgagatcttcgctctcacttcctttccaggcagccagttcagcaaggtgggtctggggctgcctcctgggagaagaggcctttcaccctcgaaccctgcaggacctcagtttgtcccagggcaaacctcctacattgggcagttaggtcagacctgcttcaggccttggaagactgtcttctccttggcttctcttactgcactggatccagccaggacactgatcagacctccagggcccaggttaacaatatgtggcccagctctgggagagaagccagcaggtctcccaggcttttgaactcggagctgaaaaccaaacaaaaaaacgaatccaccccattgacaagtggcccagcctagttggccagtcaggagactgcacaggcactgaggccaaagctgccttggattaagaggtatggatgccaccgctgcccttttactacaggtacactggccgggaacctgtagcactgagtgacacctgatcagagagtcacccactggctgggtctcccccaactcagatgcatggctaacaatcactagctaagcatgtattcactctgtggaaagccacgtcacgttcatatatttattatctcatgtattaatatactgatgtaccacattattctaatttactacctcacttaattcttacaacaacctaatgtgatgggcaatattattattagctccattttacagatgaagaaacaagacctgaaaaggttaaacaacttgcccaagatcatccagccaagtcatgataaagctgcacttgaacacacacttctcagattccaaagcccaagtttctctctactaactgtatggcccctgcactcaaaaactgagaaatctctctgccctggaatacaacaagaagtcaaccgtctgcagcctgtaagagggcctctcaccagaacttagccatgctggaaccctaatcccagacttccaggcttcaaagtgatgggaattaaatttctgttgtttataagccacctcgtctacagtactttgttatagcaactcaaatggagtaggactgtatgcaaacaaaacaacccatttttgatatttgggaaaatctaagatctttaatagtagttggaaattttcagcaaatcctaatattgggtgcgtatcagtatatgtgtgtatccacaatatacagtgtcatacacacacccatataagcaccatctgcattatataataggcacacctgtatcctcaacgttggtgtacagatgcattcatattacccatacagtatgttctgaagatagtcaataaactcagacccaagacagtcctcccatcttttaattctacatagaaatcaggacgcacctgataaacagcagaaaatgtaagagaggccaggtgcggtggctcttgcctgcaatcccaattttgacacactgaggcaggaggatcgcttgagctcagaagttcaagaccagcctgggcaacctagcaagacctggtctctactgaaaatcaaacaaatttagctgggcaaggtagcatgtgtctgtagtcccagctacttgggaggctgaggcaggaggattacctgagcccgggagatcaaggctgagtgagctatgatcatgccattacactccagcctgggtgaaagaacctttgggtgagcagagcagaagtcaagcatttctgggtccctggctccgatgctgtcttacgggcaccacttgttcctaacaggaagctctctttgtacacaagttataattacccatcaaacctgcggctctgtgacctttagcaaaatcactgggtgttgttttcagaaataaattagatacagaaatggagaaaatgcacagagtaactccagacatttttg

SEQ ID NO: 2255 - DNA, 1143 bp, Homo sapiens
gtacaaacaatgcaggcccaccacagtctacctccaggaggaagggggtgcaggtgggagcctctggaagccaccaggacctgcaactgatctgggggtacggactctgtgcctttctcagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcaggtgagccagggcggaggggccatctggctctgacgtctcttcctgggctgctgagccctctttcctgagaacgtcggagcggaaggatgaggacgtagagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaagtgcaa

SEQ ID NO: 2256 - DNA, 4586 bp, Homo sapiens
ctcacacagaaccccagaaccccagtgtataaaagaggtgatgttaatataaaagtattgcacaaatgggtaatgattgcttattataaaacctctcaaagaaaacaaggcagctttgatgaaggcagacgtgtggcgttaacggttcccattgctatcgtacatggacctcagaatccatcatattcaagccaagtgtgtgcagtaacgcaatgccacagcttcaaggcttcaccagcaggtcgatggaggggaagctgtcctggagggatggagccctgggctgtctccctttcactatggagactcaaaactcaggacttagccttccttccccatccaccccacccctccctgggaagtagtcacagctaaatttagctgggagctaggctttctaggggaggcgagagtgagagggaaactgtgaggaacaatgccaggcacactaattagtggtttggcagctggggaggacaggagggactgcggtgggccaggccctgaggctgcccaggctcctctggaggaaggcaggacgtagccacgtctgcagggcttggcagagaggtggaagtggtccatctgttgggaaggcatggggctggcttggagggtgcttgtaggaaagatcaagccagtggagtcgaaacgtacccgagtgtgaatcctggtgctgccacttgctcactgtgtgtctctaggatcatgtgaatccaaagctcccagaagccatcttgttgccacataaaagagaaaaaacaggactgagagatgaatgaggtcccagtgacactggatccagctgttcctgaggccacacccgccaccctttggatttccctggaacttaagccaatagattccctttcgtgttaaaatttatttgagtaggccttctctcatacagaaaaatcatggaagtaggctaaagacattctcattggcatctagccagcttgctagagcatttggagccacagctttacctagtaatcaaggtttttttttgtttgtttgtttttgttttttgccagcgccattctttgtacatatactatattttcttgattcaagcacgccatcaataataacatgtgtcgtcaatttaattagggctttttgggaaaaagagagaaagaaaaacacagcataaactgcatttgttgatagtaagatttgttttgatttccaaaaggttaaactattggttagggtgtaggaggggagggagtacatcttgcaattgagaatatatgaaatctccctagggggctttttagaacgagatggcctgaggtagggtccaagtattcctatggcctggtcaaatagcatcttaattccacctaatctattatttccaactctctcctacatgtaggagcttgatgttgttctgagagtgttccccatctggctctggacttgccaatcctcactcgctctccttcttcctcagcaattacctcttctcaatcctttctgggctgggctgagccctgacctgggggtcattcgacaattacccctgaagacaatgggcatggatggctcagcagctgtagaatcccccaccactttccatcagtggctcttcatgctgacatgggaaacccatgaacagagttcccatttaaagaaagtgacctctcaataagaaagctaattagatacgagagagagaaatcttcccagagtaataggaagagctcccaaacccaagcacattcagctagggagaccctctctgccttggccaagaggcagagggagagtgaaagacctacttcctgggcaatgacgggtcatgtgctcatttctggcttaggcattttatgggtgcatctgtgatagtgaaaatacagacagtgcttaggctatgggagaggattaggtggggagagaaaagagaacttttaaatgctcctaatatctcacttgccaggaatcctccacttcccctttgtagaaccaatctgtgatttatttatgattaggtgtaacccatatggctactgcaggctctaccacgcccaggccttgaatgtggtcctgactagggcaaggacatcattagaaggtggagtccaaattagccatgtggccacaggcccaatattatgagtcaagaggagcccatcaagcttgaaccttccttgcactcaccggtttggtatagtgtctatgactgagtttctgcctcagtttccttgactcatgctataggtctcctagcactggaaccttgtcagattctggtcaccaaggtttgggacactgctgagctcaagagtctttcttccatggatggctcctactcctctgatacctcagatttgtattctagcagagcctatgcagcctgcttcccaggtataagcatcaatcatgcacactgttatgatgctatcctctctgccatccagcaatatgctctgtgatgcctgaggtcagaaatgacacaaatagcacatgtgccactattttgctcatccacccccatgcagacatcactaattgatctctgccctcttctcagtgaatctagatgtggtctgaacacatggtttttgtcaaccacaaccaattgactgatattggcaatacaagacaaagtccatttgccctcactaccatatccttctatcagtatatacttggccctcttagaactccagcccatcttggttcatcactcactccatcctgaatcccagccaaatacaaagccaaggtgcctcagtctagagaacctttgagacagtcctcccagacctcatcagggtcccttagtccttaactcagagattaatatcttgcctagaggatggggatgctgtacgttgcacctggagaattctgtgtccccaagaccccacctacacctgcttctattattccaggagcttcaacctagagccgccaatagatcaactgctcctattccaccccatcccaccccagatctcattacctgaccctctcaccaccgttcacctccacactgtttccagaggaacttctctagagtataaataacagataaagataggtgagtagcctgggtttccagagcctcagaaagaaattattctagggcttatcaaacacttcattgttttgcaattgctggttgacaggtttgtctgtcttacttgtgagctcctacaagtcaccaaaagacttggtcctgtttatcttcattttttttccatctaataactagcacaatgcaaggtgggatgaataagcaaatgagccacagttcattcttgggtactaggctcaggaagttcatgctctctgccttctcatcccctataagccaccagccatgtccagtgtggagtcgtaactaccccaaggttccccaggtccaagacagtaaaggcccccaaggagtatgcaagtgctggtgaggaaggtgagtgtcccccagggattccactgccagactctctcaggcatggaaactgtgacacgctcccatctagccataaaaaatgttctctcccggggcagaatgctagctcactgcctctggagattctgcatctagtctggaaagaggcatgccctgtgaatgaccagagcatcctggtgcccacttctggtggaacctaaaaaaggacctttatttaagtcgaagtccagaattgcatccaagatgataagcagaggactggcccgcctcgacctgaagctccctctctgtctccaggactcagacacccctgagcatcacgcctgacctcagcctcatggaagtgacctcagcctcatggaagtgcccactctggggaaagcatacaaggagcacttactcggtcctctgtggatgggaagcaggccagaccctggccatggaacaacaagcttctgagaaacaggagttctgctaagagtcctacagctgttgggatatgggcaatccctcaagattggcctcctctgacccctgttgttgaaccaccttttacccatccaattttaaactaattggtttaaaattgttaatattcagtgttggggagggagtgaagaaatgggtatgcattactgataagaacataaatctccctggaaagcaatttgaagccacataccaaaactctttgaaatggccatgcccttatagatttattctaaggaaataatcagatgcatcccaatgatttatgtataggaatgtttcacgacagcattatctgtcaaaggggaagagtagaaacaatctaaatttaaacacaggggattggctgaataattatagcaatataaatagcataaatatatatatttcgaattttatgcactaatatgcacatatatgcctggaagaataaattacatattaattgtggttatatctagggggtgtgataatagttgattttaattttcttctttgtgctcttgtgaatgtctcccattttcttccatgaacatgtaacacaatctgtaaaagcaagacatgtggtcttgaaaaaagatgagcatatccaaggctggctgtcaaaatgcagtttgagtataaattgtttgactatttgaaaaagcctggagatctcacttaaaccaac

SEQ ID NO: 2257 - DNA, 2836 bp, Homo sapiens
agcagaggaagaaaatgaaaagaagaaggaggagaagatgaagaaagacactaaaaggaaaagtaactgctaatcaaaccaagaaagcccagctaaggggtaatcctgcaacttaaaaatatgtcatttgttattttgacagctccttttgaggtgatagactaggaggagctgctggcatcatcaccgactggctgggagttctacttcttgcttaagacatcagtaaatggataactgcagattgcaaggagtctatcttctaagattcccagcttgagctcttcgtatactggggaagaccaagcagagggaacatggccacctgcagggacatccctaggaccaggtaatgggaaagcagaatctgagctacctaagttcaagaatgggtcaccttggcacgtggaagaaaatggaccaacctgaatggagcagggaggtgcacacggacacagggcatctatctggatcgtggagacccctctgctggggttggaggactcagtatggggagcaggaagagctctggccagaaaggcagattggggctgggactgggccaggcagagacaggcagcaggcctctgttgagggccttctgttggagggcccatgtcgggcgctctgcttgtgtgatttcctgcgtctttgtggacttcactctcttgtcattaattccatgtgtaatcactgcctcaacacgtgtctaccctggtgggaaatgagcttcaagagcccaggggagcttgtcagttttgttcatcaatatctctcctgcccttccggcctagaacagggcctaaaatgtagctacattcagtaaacactgaatgatcgaagaaaaaagtgatttcatttagcagacatgctcccaagcataaagtttattggaggagctactcaaaagcatcttttgggaagatagggtgtgagattgagggccggaggcttggaaagagaataaacgtggcatccagttagagacaagggagttggccacagagaggccctaagaatctagtctgtggaccggttttcattgaccctgtgcttcaaaacctgttagcactcactagctgtgtgtcctgggcaagttactgtacctctctgtgcctcagttacttcatacctaccttacagggccattgaaaagtttaaagaaccgaatgtgtgtctgactcatagaaagcaatcagtaaacaataaagtattgttcttgcaaagactgggactggaatgatatgaaatggaaggaagagatggagttgaaggacactgtgaacaaagaatatgtcgcattcaatggcttgttggaaacagggtgggcgcttctgctcttccacgcgcccttgattggaagctgctgttcgcaaggcacagacggctctgagctccagacaccgatgacagaggcaggcacagaagtcagacaacacacgaaaagaagaagggcagaatcgcccagcgactccataatcagcttatgtcgtggaatttgatgtgagcacgttaggaatgtcacatacgactacgtgggtttttcagcctatttttcctgaatgcggattttgttggcaactgaatgtgtgctaacaccctaagatttagttgcattttggttaagaagtccagaagactttggacttggctttgaaaaaccgaaagtgaattgaatttgcattatttaaggggcttattcagatgaacactgctatctcttcagatgtaaaaattccaagactcaagagttgatatttcagcagcaacaatgacatctaggggctggttgctacaggtttaatcttagctatatatggtctacattttgaaaacgaagagtgctaacatgttgatgcaatccagaatgtctgcttggactgtgtgaacttggttggtggccagggcaacgctgatggatcaaagaaaagaaaaagctgaaagtggcttatgctgtcatctaagaaaattactttgcttctgaaattgcaacacctctcagtttgcttgatatactcattttccccctgaccttttaaccagggatgtggcatccttctcagctttcctgtttaatccaggtccactcttcccatgagtgacagaaccaactttcctgcacggagaggggctggggcctcaggttctagccgcttttggtttttcccatcctttgaagagccggtggagcaagtctttggcggttcatttcatctctcccctatggttgtttgttttgttttgtttttttgacacagggtctctctctgtggcccaggctggaatgcaatggcctgatcctacctactgactcctagctgagcctccaactcctggactcaagtgaccctcccacctcagcctccagagtagccaggactacaggtgcatgctactgcacctggctaattaattttttttttttttggtagagatgggggtcttgctatgttgcccaccctggtctcaaactcctgatttcaagcactccttctgactcggtctcccaaagtgctgggattacaggtatgagccaccatgcctggctcccttatatttttatcagattctttcatttcatttttattttttttgagacagaatcttgctccgttgcccaggctggagtgcagtggcatgatctcagctcactgcaacctttgcctcctgggttcaagtgattcttctgcttcagcctcctaagtagctgggaataacagggcctgtcaccatgcccggctgatttttatattagtggagacaggcttttacaatgttggccagtcttgaactcctaacctcaggtgatctgccctccttggcctctcaaattgtt

SEQ ID NO: 2258 - DNA, 637 bp, Homo sapiens
gggacctcagtcctataaacaccaccaacagaatgaacttggaagcagattttcccccagagcatccagataagaactcagtccactcaacatcttcagctttgtgatattccaggcatattgtgctgaacttctgacttacagaacttcagtcctgaaaggattataaaagcaagaaagaaacatggactctaagaattaacaacagtgtgggaagccacggaggagatttatgactaccctaaattggtttgtgtttggatggatgactatttcctgctctttattactagaaattggcagcaacatctcagattggataatggtactggtggaataattaccagaaagaaaaaaacatccccactaaagtgatgaaaacatgtacagattgtccaaccttttgcttttgtaccacttccccttccagatgtcagggttgtgatttatttctccctaagagtttaaaaataaaactctcatcataaaatttgcctgatactgatgaaaaataagatgtagtaatttaggctttcagactagactcagaaatagaatccattaatatttttttactagggatccatttaaaaacatctaaacatgatgaaaatgaaagaatggagagaaatatgcc

SEQ ID NO: 2259 - DNA, 4968 bp, Homo sapiens
cattgtagcatcaagaagctgcagtttgggaaaatgaatccttcctttaaaatgctttttgggaatcacttaaatttgattttacacatacaaacatcggcaaatttttcagaaactggctggagatgtagcagggacgcatccaaggtaaggagatgcttggacaatcctgcagctgcagctctgggatataccaggccatctgtcctaggatgaggcctcattcacctagaagaggcttgataagactgtagctaagagagtgcagtacaggtatagaacattccaattcaataagaaaacgtgtgatttatcatgaggcaataaaatacatacataagaatctttagattgtatctccattataatatctactagatatctgttacagctcaaatgcgaataaaatgggtataattttatgacattccggtctgctgtcttgtgtcaaaaaaaggaagacaaattgaggcagaggaactgtgaacagctctgctcatagaccttaattatagacactattctatttgcgcttcctaaaaacaggaggcatctgcacttttggtcatacaattgaaagagttaaaaagagagagaaataaaggaagagaataagctcattaacagaccactaagaaacacgagagagtaatttatttcttgattttatattgagtaggaataaataaattttactgaaaaaaatttttgagtcagtctaccttttagagttctgataatttcaccttcattatctaaggaaaaaaaagtctctagttaatttgggacctaataaagagaaaaattttctaaaaaataggcttcatatacacttttaatagaagaatggtctttctctatctgaaaaggccatcatcaccattttatgatgcaaacctaagaaggaaaaagggataatgggaataatctctgaaaaagataagctgaatgcttaaaatgactcttgttgcaaataacttatgagcatattctctcctattttttttctgaaacataacaaaatcttattttctaaaatgtaaacaccagattttgaagcataaatgagagaaaattgttcaaaaaaatttgttctttcctgaacaaatatctttcagcattttataaaacaaagctttgaaaagataagcattaaaaaaaaccattttctcctggattgaacgcataatataaagaagtacatttttacttctgccatgtgtaagaaacacttttttccccaaattgttcaatggcatgacaaaactccatttgtgtatgaatatataaaatagaagcatctaataaactcaaataaccatcagtgatttattaggaaggacttactgcttagatgttttagatatgaatttgtccttctattattctattatccaaattttcaattaattatttgtcagttttatacttttttacttatttagaaatgtaataggttgtttatggcagcaaaacaacaactctgtaacagaaccattcacaattataatataaagacactgtaatgtatttttgaaatataattgtggaaaatgaaatcaactgcaaaataaacagaagacaatatgtgaaaaagcagacagccttggaaatcttatacaaaaggaattatttactctatatgggtaacacagagggactttgcttttattgacagccatgacaactatatgcctagcatacttgttgaagtctctagatcctgtgactttctggtggaaaagtccagaaactctcaagaaggtacctctatgatgtgggggcagcagctaaaaggtgaaaaagaaaaagtcagacagaagaattgctggtgtgtggtgtgtatttctactaaaatttacgtagagcccattctaaattagaccaatttttaaacacatggattttttatgatgttgtaaattctgcatggttgaggcccttgaagagtcatacaggtgtgtttgtgtgtgtgggtgcatatacacatacacacatatatatacacacacatatatatatatacatgcacctttgtgcatgtgtgtacacatatatgtgtgtacacatgctgactcataacataattcactattacaggatccatatctatatatatatcaatgaaaaggaaccagtattgaatttcccctttatttctccattgggctttgttgtctctcaggcaagacggactgatgtcaccatgaaaataatgaaaaaatccactggacctaactttcagggatgactgctcatgtccaagttctagggcatatcttcactatgaaagacccctattttataaagtggctgattgaattcatttccaagggtagtgtccttgcattgtagaatagtagtataaatttagtttagaatgaatcagagacattgctttgacttctaggcagatgtggtttgtaataagaaacatgttaactatgaattttaatttatttgaaagtggcataatttgatatttgtaccttgttcctcgaagactaatagatttagaggtaaataaatgaggttgagagatgtgtcacaacttaggggagtttgcagtgggcgcttgccagagatagatgtagagggatttgcattcaaaatgtagatggctggcataatgtaagctatgataaatggcatgcattgatttaatgaccacatccttgctcttatcaattttcctctaaccctgtgattaagttaggaaacacattctgatgacccttggtagaggttttctctgacattatttgaactctttcaactttaatagttttttccccctgttgttgccacagacattatgagatctgcttgagggtagaaatatctagtcattactcaatctgctaaaaatatattataaagaggagtgggaaaaggaaaaaccttcatcgtttgagagtggctggagtttgacccagttgccttcgaagaatggaagatcttcccttaggagagaacttcatttagaaaaacatcctttcaagtatgaagaagctgtgccttagagcattatgcacagaaaaaaaaagaagaaaaagaataattaaagaaagaaagattttattcaccaaaaggaggaaatcgtgtgcaagttttggctggcaggccaaaggactggaggattcaggaattagaatgaggaaggtttggtgaaagatctacaatggtaattttaaacctgactgcatattgaaattaacaagaggaactttaaaagaatacctcttggttccacttcccaaagattctcattcatttaatatgagtggtcttgcataacaatatttttataaagcattttcagtgactccaattctcgcccaggagagaatcactagagagaaggtgtccatgtctgtcccaggatgggttttacggggaagatggatagtaagataatgtcaagagtggaaataggagcttgataatatttaaacttgaattatttctgttctagttatttcatccttactctgtgctaatgtccttactttggtgaactgtgtcacacgtacccatcttggactgatgggattttggggaatgggaatgaggatccagtcctggtgagaagaggtgcccaaaagagtagcaatagccaaaaatgaaacaagaatctgcagaggtcagctattaggaacaagagctaatcagaagaatgcggtctgcttgatatgcctcaggaatgttgttagggttctggacatcccactaaatgtggcatggggtctcaggatttattatttggaaacaattatctcaaggggctagaggaattggagttcacctcttgattgtgtcaaaattcatgggatatgtgcacttcaaaatatgttaggagggtagatctcacttcaagtgttctatgtacctgtatatacatacacacatacatacacctccaaaacaaaaacaaaaatgaaagagcacaaggaaactttaggaagtgttggatatatctattttgttgattgtggtgatgatagtatgtgtgtctgcttatgtccaaactcattacctttgaaattaagtatgtgcgtcctttgtatatcaattatgcctccacaaagctgataacagtcaatttgtgtttaataaaaattttatgtacctgttcaatgagattagtaaccaccttgactaatccttgttttaaatccaaacttccacctttttaatagccatgtgatcttgagcaggctaattcttctcagttttcatgtgttacacggggataaattgtgcatttcaggttagacatgatgtctgtctgtagggcaagtatgtttccgaaattaaaattttgcccagcagttttctttttagaaatttgtctcaaggaaataagcacttaggtatgcaaagatatatgcataatgaagttaatgatgcattgtttattacagcaactaatgagaactattaatattttaaatgctcaatagaagacatgttaaacaaattgtatgtcaacataatgaaatgctctgtatttatgaataactgtgcacattcatatttactgacaaaatttccatgttacttcccatgttgttgttaaatgaaaaaggtttatgaaatagttcaatcccttgtgtgtgtgagtgggtgggtgtgtatgtatacgcatgtatacagaaaactatcaggaggatatatacagaaattaaaatctaatcatttgtcagttttatatcatttttctttttttaatttcacagtttatttaaggcagcagaacaacaactcggcaacaaactattctgaaataaattaaaacacaataagttggcagtgttttttatgaaatgtgattgtggaagatgtgagtttccccgggtcataaaattttgatgagttagttttcttcttcatttgttttatattgtctgtttttaaaaacaatgagcatgactgtctattatttttataatcaaaagaaacgctgac

SEQ ID NO: 2260 - DNA, 6712 bp, Homo sapiens
gttgactggtgactatccacaggcagggctagaaaagggagtggaacattttacttaggcaggaagcactgaagagaagaatctttttttcagtagacatttgtgggaaataaaaatttgtttagaagaatttaggccaagagataaaatggtcttcttttgactgaggagagataagatagattttaagcagacatctgaagttaaaggtgagagaaggaagataaactgggtgattttgctcacctaagaaggtacacagatccaaagaaaaagagattcgagaggtgtctccagcttctgattttgatgacatctcccagagaggaccgtgttgccatcaccatcccagagtctgaaagtgtccaggaaatatcaatgaaatcatggaattttgaagaagatacaacaattttatttctgctacaacagacgttctgctaatggaacagaagtcagcgaaggacctattaggttttaggtcacttattactcaaagtttatacattctacactaagttatttattgctcaaatttatctcatatttattcctagattgtgtgtattaatacaaggcccagaaaagttgaataatgtacagtatatttcaagtattataattaaaaacttagagatttagcccaggtttatctgaaccaatatcttctgtttttttcactcaaatattttgaggatgagcattatttagcagtgaataggtgtgttcttaggcagaaaatcctccaatgcattcttcttagtgaaagaagccagacacaaacaggatgcaaattgtaagattctatatgaaatataaatccatggagacataactcagattggggggttgttagagtatagagaggaaggatggggagaaacttctaaatgaataagttttactaagctttgtggaaatattttgcaactcgagagagatggtcattgcacaatattgtgaaaatgctgaatgacacttaatcgttcattttaaaatgggtaattttatgttgtgtgaatttcaccctagcaaattatttttaaaatagaaaatacaactgtgatgacaaagaacattagactccagttctaacattatgacagttaatgcatggaaatagatatgactcttttcttcccccacacattacattacaaaagttgatacccaacattaaatcctttcgtaatagagaaaatattgctagacaatgacagtggttccaaggcagctttaagaacagaagtgccacatgtaactcactgtgattcatatctgtgttttgcttagtacctaacaccatacctggcaaaataccctataaaagtgaagaggattaaattttgaaatccaggatcaatataaataaataggtacaagttttctgaaagctactgcctgtatgtttcatagttttgcctttataatcagtcatggttcaacatcttatttctaagtttaactaaagatatattcttcatactttaagggtaggagaagaaagtataaattggattaaaattaaaatatagctttttgatgaaagttgaattctttggcaccagccatcacgttataagcaactttattgacacacaagtaattgcttatacacagtgtaaacatacactatagtttatctcagtcagtggtggctttttattttaaagagctctataaacatgaaaccattttgttatatgtaatcaactacactttgctgcctgattaaaaaaagagattttatctctttcattggatgacactttaataaagaaaaaggtaatgctgttgaatattagaaaacacgggtaataaacagcatcttgcagttgccaaggctttggtaaaaagttagcagtcaggaaaatttccaaatggaaacaagtgttatttgacgattttataaaattcagcagaacacaaagcaattagtcctgtttgtggcttttattgtccactgaagtaaagtaattatagtatttctgatctcatgtcaaacagctttgactctttgagctataatgtgagttctgacattaggactcaaagtctgaatcaaacatcaaacataaaacagtgagggactgcatctttaaaacttgaagatccctcagattttaacctgtaacaaagttgaactgttttatgaaattaactaaatgaaaatagaattattcattcaaggtggaatggataatatttaatggacatgggaaaataaaatgtcccttcaccaaatatatccagacgtgttcagaaatcactttccatcaaagagaatttatttacacccagtatgttgcctggtcctcactgtcagtaatgatttacaaattaaatagtcatggtgaatattcaaacagccttctgcctcctgacatctctcccttcctttcttcattctcaccactcccttccagtttttctttgctttcagcatttggctggccaatctgttttgaacttttggggtagcctgatgtttcagcagggtagttttttaaacagaactttcaaatcttagctatatcccaactttaaaggtcaatgtaaaaataatttaaagtatggagtttttaaaagggatttaaaaaaagtccccaattctgctcagtcatctctgcaatagcgcaaaactacctaataaatagcaaaacttgggaaaggtcaaaatggaaattattaataaatgctaaataacccagagccagtaccggtaatatataaaatgatgaaatgccaatttaaaaccaccatgtgaagcaaaaatatctttatatttaattgaaaatgtccataacaggaagaaataaaacaaatttccaagctaaagccttccaaggcttgattactagattgctgtcacgaggaatatcatttctgcttaggatgtcatggtgcataatggggttttatctttcgcagattattgtactgacctcattaaaataaattaactaattcatcagttgacttgtagtttttgcaaaagatagctaataaataagaaaaggaagaataatttattttttaaaacttgaaagtatttgtctttaatgacaaacttgtggacgttggttgctctcccactcaaggtcattaaccctataatactacatatgctggatagattctgaactttttttttttttttttttttttttggagacggagtctcgttctgtcacccaggttggagtgcagtggtgcgatgtcggctcactgcaagctccgcctcccaggttcacgccattctcctgactcagcctcccgagtagctgggactgcaggcgctcgccaccaggcccggctaattttttgtatttttagtagaaacggggtttcaccgtggtctcgatctcctgacatcgtgattcacccgcctccacctcccaaagtgctgggattacaagcgtgagccactgcgcccggccacgatttttccatagtcaagaaaaatcttaaaatttaatatttaatgcagttatagcctatgaaagcctaaggatggctttcagaaactttaataatcttagaaaatgaccacttttttaaggcacacatctgcccgttgtgagcatatttgtcattagcatttagtaaaataggtacaatccattactgcttatttctaatactatttccgcttgtgtttgcatttcaaagtagccttatgagaaaaaaatagagctttaccatgagttattattgttatttaaaaagatagatggctcatgataatattgttagagttgctttgcccaaactatacttttattttctgaattttcagacttcctttatttctctatttcattcttcattccccctgaattgtttttaatttctggggcaaatcataggaaaaatctccaagatatttaaggctcatatagttagagaataaatgaactttcctatattataaactataaattaggtaactgtaaaatcataaaaaatgcccttggcttgcagaaacaatggtaagtgacagactatgaaagtgtcttcataacttttatctaaatttttggggggctcagtttattattgttctcttcatgcatgacttttctaaaatgagatttggaaggaacagtatttcaggaaaaccctaagttttaatgatgaatgttttaagtaataaggataagaagatttattgtgattatatttaaaacattttccacagtgggtgcccttgggaaaatctgcattctgtgtggtaattaaaattctgcacaagctatattgaatagaacaatgtagaaataattcttggctgtatagatttagcatctatttagtggaatgaaaatctcctgtgaaaaagtagggtgacatcaattaactgccaatttttaatttataatagtgacataaagatgagaagtaaagcaaaagtaaaattaatcaatgcaataatgacatcggacactacttttctaatgcctaggaactatgagaatactgtaagaatattttacattataaaagtaatatatcaacattgctacagtctggaaaatacttttaaataaatataaaatcagtacctagaataatgcctgctaggcagtcaatacatatttttgttgttattgacctatataaatgatctgaacacaagagtattttagacttaaaaagtttacaatattgaaatcagaaaatcatataaaatttatcagaaaataatacaactatttatgcgatggaaaagacaatgttattgaaacaaaagcaatttttagaaaccagatgcactgatgctacatataaatgcagttgatagaactgctagtagaccaaaatacttttatgagtaaacatataaagaatgattgaaagttcatttatcttaggagttatttaagtatgtataactgtccatgaattttattgtggaacatttaaaggaagatgttaataaaccaattttgaatgttgctattcctagacacctcattaaaaatcagaaattagcctatcttatttcataatataaggcagcagagttgtgcctccccgaagtaagaatgtgaagataaaggtatataggtactttaaaatatcttctaaattatatgtaatgttaaaagtaaataaaaatggatgaaataggaatgcatttatgccaattcatgattgatgagaatatatttggaggctttggcaagagatagaaattgtcaagaccagtgactgaggaacagaacttgtttatggaaaagctttcctttctcttgacctcatgtgtacacatgaagtgatgaagggaggagacagccacctttacacttgatcagccagccaaatcaatcacgaaaatcagtggactgtttgccatattgctttcagtccaaagttaggaaggtgttgaagaaatgctgcattttgatggagggcaggtagtctttcaattagtatgtgacaccatgcaagtttagtgaggaaggtgagaattcagcttccttacagtcaggtttactttctggaaaaggcactatacatagaatgacactatatacatgggaaaaactaagaatatactaaatatgataaagctacctgaagtagaagggaatactgtgagaagtctaatggggatattaatgaagaagaataagtccatcttgaaatactgagaaaattaaaagctccctgtatttttcctggtgtattccatgaagagaattaagctaatacagacagagaaaattgcagaagacagaggcagtatatgaaaaaatctacatatattaaaggtaaaggaatatttgagaaaaattattaatacaccatatttcaaagaagagctaatttattaacttttgaactgagtcaacgaggtaactacatattttttttcttttgctctaactcctgtaatttgagacacaattatttgatggaatctttattctattatatatgtattatattccaatttctgatattgactataatatgctgtgattttctctgtgtataggtctgtactggaataatactcatcagtttgcttataaaggctatcattaaaaataataatgtaaaaattaactgcaatacagcaagcttttggaagaatataaacattccctcaatgacccagaaaactacaccaggatcccttcagcatccctctgagtgctgagttgcaggagggatggctgtggctctctgatttgaattgaaactacagacatccatcctctcattctccatcctatggacataagaggcagttgtccccatgtttctgctgcttcttatcgtctacttcagtggcagcctcgggccgtggtttctctggtgtgccaggtcaatgtgtccacggaagagcttgctcctgcaaacccttcctgatgatttctttagacaactccctgtgttcatttctgccctgcgtaagatacctggaataatttttattctctaatgaatgattgaaataaaagtctttcatgaaatatctggattatggaatgaataaagtaggagtaaattctataaaaatgtttgacatcctgtaggttgtaagaaaacatttcaagtttaatttttataaatttctttatattaaataatgtatacttgtaaaaaatttgaaactataaaatataaatgtagtgaaaatgtcgttgtttcctcagatcaaagtaacaagtaagcaagttaacattttgaaatatttccc

SEQ ID NO: 2261 - DNA, 5776 bp, Homo sapiens
cgatctcggctcactgcaagctcccctttccgggttcacgccattctcctgcctcagcctcccaggtagctgggactacaggtgcccaccaccgtgcccagctactttttttgtatttttagtagagacggggtttcaccgtggcctcagcctcctgacctcgtgatccgcccgcctcggcctcccaaagtgctgggattacaggcgtgagccaccgctcccggccctactcctaccaggttttaatgaggcaccctaccctgcctcatttttgcttgaagcaagaggtcacagattgtccctaaggcttcttcccaggaaccttctcctccacacttcttctaaccactgtctcctcccattctgaggaaacaggggttgttattccctcacttagaccagatgcctcattcccatctgcaccatgggactagttcctgtcctgtaaaggtgtttaaagaacctccccaggtgagactggctcaagtcacactgtgctccgcggggggcttgaccttacttatctgtgacaagatgtcacctgtgatttattccttgataaaaagggaagcaggagccctaaattattttctggatgactgctaacgcttttctcttgtctgagttggtcatctacctcttcccaaggatgagatagacatcagtatcataagaggctttcagcttaggactccttttgtgacatggccctttctgaagttaatgatgggcctcccgtgcttcatgtcctgtgagaaatagtgtcgtctccacaaattacttcaccccaaattatttgtatgggcccctatagttttcagcttaaaaaaaaaatctaaatgctttatcctcagcataacataataacagttacatgggctgggcacggtggctcatgcctgtaatcccagcactttgggagaccgagatgggtggatcacgaggtcaggagatcaggaccatcctggccaacatggtgaaaccccgtctctactaaaaatacacaaattcgctgggtgtggttgtgcgtgcctgtaacgccagctactcgagaggctgaggcacgagaatcgcttgaacccaagaggcaaaggttgcagtgagccgagatcatgccactgcactccggtctggcgacagagcaagtctccgtctcaaaaaaaaaaaaaaaaaaaaaaaaaaaaccagttatgtgaaatcagatttccaaggttttatgtggaagcagtctatggaggtaccttcaccctaatgcgttcactccattcccactaacggaatctatccagagtgaagtagccatttccataatatgaaaaaatgtatgtgttcaatagacaataagaaatataaatttataatattggtagtgcaaccctgctatttatagtaaataggatagaaacacgtcagtaactaaagcatttagtagaattatcttcaattttgttgttgttgttgtcataatgtatttgctaacatgtcctagaaatagcatctttcatttggaaggtgtactttataaatatacgttgatcaataagtgcttttattatactttatcccaaatattgtgacatgttcctcttagggaaggtcattgctacttttcctgctaacactcctcctgttgaaaatcgcaatttaatatttaattgctcttcactctcatttagtataaatcttctgtattcatttgaagtctcatgaggttgaatgttatcttgctattcagtggtgtgccatcacttcaccttataggtatttgtgaagattttattcacatgatgctctcaagcttggagttgaaatactacgattcacttaatagattaggatattagggtctattgaacagatgcatagaaatcagtcaccatttcacccgaagttacatccaaatacttagttttattaaatgcatctctactgcttagaatatccagttttgccttacagtaaaattgggtaggctgaccacctactagtaacacatttgtaaacataccagaggaaaaaagcctacttttatttacatagcaaataccttctcttaaaaagaggtaactttttaaagattgtgtccaaattgaagaacttacctgagaataacaaaaaagtacaagaccaatactgcctatctttttctttcacccttagccatatggaggacaagctggctttagcacagctatggcacagactacagagtgcatgagaaaagaaacgatggggtcaccaacagtgtggaagggaaggagcactatagtgagctggagcttggacacatgaaggatccaatgagattcttaaactctgtgtgtccggcaaacgctagcagtgaagagatgttaagttcatatatcttctccttgaagaaaagcaacatcctaagatctcaataaacaaaaaatccttcatttggttcagaagatcctagaaaagttaattcaagatgctgactaaaatcttaaagatgttccctggtagaacatgtttttgttcgtttatttctaagaatcacaaagtcaatccagttccttgcacattgcaaacctctaagagatccctttgcaccctctaagttctgcagtttggattactgacagcatctcctataatcaatacagcataattggattattaccaaaggcaaaataatatatttgctgttttttagtttttaaaagctaatattttaaaaatacaagtttaatcatctttaccatctaggtaataaaatacatatgtgcccccacatgtgtttaaataaccaatatcataattaatattttttccagaaataaaattcttaaatctttataaaaagttttgaacatacaaatactttgtatccctagctattattttcttaacttctgttttcatttagaaatatttgcttttgaccacaatcttcttcactaaacagttttcatctttgtcctcctttgaccttagctaatataatttcttagttctctttacttggtgcagtttttaaaaggtctatttattttgagtcagcttacaatgtcttaaaaataagcaaggaaagaaaaaatagggagtagaggggaggaagaaacaaaaaaaattcagttatgaactgttgactttttctatgctttgtttaaatgtctaatcttaaagggagtatggtggaatcctgctctttgaaccagccattaggaggtgctcacagtttagaacaaactcttcagacctttaagacttgtctagtttttctgttctgtagaactttaattttagaaattttctttcacttgaacataccacttgtaaaaattgtgtagccgacagctctgggaaccaaagtcatccaattagtccaaaaaacaaatgttttatggcatctatcaccacagaacaccaataggccctcagacaaccacatcaggttaaaagaaaaacatgtatttgagaaggaaagccttcttggctattttgctttcagagagaaatggttgatattaactggtgtaaggcagtggtcttcaggaaatgtttccaagggctatatctaattttgtaaagtaaagggcatatttgtattctgaaatatgcctacagggtagagtgtactttcttttcttttattttttttttgagacgcagtcttgctctgtcaccgaggctggagtgcagtggcgctatctcggctcactgcaaccttcgcctcccaggttcaagtgattctcctgcctcaggcatcctgagtagctgagattacaggctcgtgtcaccacgccccactctcacagctgtttattatagacacattcacaccgttactttttcatttttgttttaccattattgctttttatttgctataacagacccagactggcaacttgacgagcctttggcacaagtgtggatatgtttggagcaaagaaggctgaaggacaagtatgcgccatcttttggtgggttttcattggcccctaaagcactgtttggaggagagtaaacaatgttcgcctacttatttataatagaagttaggggttataggtgtttgtacagatagtacaagcatgaaatgctatgcatgaattacttaactgatttaatgatggcttccataatcttgtgtcatttatcaagttcagtgtgacaatcaaatattgacattaaattttaatttaaaattttccatattaaaggaaatcaatgcacaaaatttcaaaattatatgcctgagaaaacaggaagccaacttaactttaaaataattattattacttggagtcaactcctagcaaatgggaacgcttatcttatttcttttcatttctttggcacccaactcataatgtcttaagtcatttgctaggacttaagagaggcattaggcgtgcactgcataatgttgatgatgacacctactggcaggacaggattttgcaccctagttccataagacactgaagccctttgtatatttgaaatctgtatttatgaattaagttaaatttcactagaaaagtcttattggaatatgattatcagttcatataagctaaattatgctgtgccaaaaaaactccctaaaactctgacaaaggtttcattctttcagattattaataatgaaagatgtgaaatgaagattaaatgtcaattctgcctccaaccccaccgttaattactagcaaagagtaaaatcattgaatatttctccccttagccattgatttgtgatgtggtcatgtactaagtctctattttggaacatctttttctgtcatggatttctgtgtttgctaattgttacagcttcatgatgcatttactgtatgagaagacttttactgatatggttttaaaaaaattttgtaattctcacctgattattcttccaggaaaagtttagcattattttgttaaattatcacaaatgacatttgattttatttaaatggcatgaaactacaaattaattctataataattaataacatattgagtcttctcatctaagtattttctatctctccaacatatttgtaattttattcatcttaaatgtgtttttataaaaatttatccttggaatgttatattttgttataacccctaagagttttttacataattttattttcacatttgctatagtatctgcatatgagtatgctactgcttttgtatcttcctcttgtaaaaaataaaataattgtatgcattttccataggatgacattttgcaatttctctaaatgagttactatttttcgtcttgtatttatatctgttagttctgtatgtcttacaacattggctaaaaccttctagtaagaatgttagaggctgggcatggtggcttgagcctgtaatcccagcactttgggaggctgaggtgggtggatcacttgaggtcaggagatcgagaccagcctggccaacatggtgaaaacccatttcaactaaaaatacaaaaattagcacggtgcacacctgcaatcccagctacttgggagagtgaggcagaagaattgcttgaacccaggaagcagaggttgcattgagccgagattgtgccactgcttgggtgacagagtgagaactcatctcaaaaaaaacaacagaaaaagaacgttaaatgctatttagaaaaagcaatagctttttctagacttaatggtagggtctcatgggttttatcattaggaatttttaaaatcatattgattttaagtaattgtgaataaatattttaattatcaataataaatgttttaattat

SEQ ID NO: 2262 - DNA, 1264 bp, Homo sapiens
caggaggctgaggcaggaaaatcgcttgaacccaggaggcggaggttgcagtgaatacaataaaatacacccatagaatggccgatatcgcgccattgcactccagcctgggtgacagagcgagacttcatctcaaaaaaaagaaggaagaaaggtacattctcataatgccttaaattagttacttgggatttatttgacaatgattaggaataactgtttcaaaagatatattttttcatataccttagaaaacaatagatatttgttcaactctctaattgtgggtttgcatttgaaatgtgtattgtgattcaaaagttttctctacctagaaggggaatacaacacatggaaattattattgctggtgacaccagataatattttgcctaaactcctgaggtgagtgctctatgaagaccccattcaacccagacctttgaaatggctcacttcccatttaaactctattaatcttctacctcatggaggcaacaggtggtttagaaaagagccaatagaaagataatttttgtccttcaggatcagtgccaatggaaaaaagtgacctgaaatacagatctcaggcctgacatgatgaaaatctagtgccacagctgttgtctctcagaactgtcactcatcatgttttaatttcacagttttgatttaatcttttctaaatacagcactggataaatacagaacaagataacaagagttcccagcaaaggatccagcttgaaataacacggtgctaagcatggatttttccaccgaatgaggaaattctaattctaattgttagtctctttatcaatgacgccaagtggcaaggaacatcaccatctttggagacctagtggtggagttaaactactacagggaaacaactttacgtatagaggagttgagcttcctagaggaaaagaaggaaaatcattcctaatggaagatcaactattcaagaaagaaagaagagcaatgagaaagctatgtacagcttacagcaatttgataaagtattcttttgtacataaaaatggaaacatttgcttttcttccctacttgatctctccaaaattcagaaactattattttctctaatatctgggtacaactcttcaacaaagaatgagaactgctctgttcctgaaaccctatagccaaagtttgacaattcaatatacattccaagggacaagtctcatgcctgatgtttgagccacacagatagtttgtgagaatgtctgatgccac

SEQ ID NO: 2263 - DNA, 7319 bp, Homo sapiens
gaatgatgacagtggaggggctgattgcttatgaatccttcagtccagctctaattagaaaacagttaagttggtggagaaaatcagggcttgcttagtgcctgcacattccctcctcctctttctcctctccctctttcccttctttcttccttccacccccctccctccctctctctcttcttctctccagttctcccttgtaatttgccgtctagcagcatttgggattacaaggttttttttcttttcttttctttttttccctatcactgaatctgcaactggcatggaagaatgagatactgattcatgctgaagtcttttaagaaaaatcttaatatccacagtcagtagaattttcctttctttctaaataatcaatgactagatcctcatgttaactggtagatatgttgctgcactggagggttttcattgataaggaagaactaaatatttttccaggtgtctaagtgtgtctgtaaatctaaaatcctcattcagactaaagggaccataagataaccccgtgaaggcctcaaagaagcagcatgatgtagatacatgggacgtattattaacgttattatactagtcctaagaggtacagtaaatctgatctttgttaatctttgctactttgtagtaaaatatagagtttagagcaaaaccggtctgagaacctacatcccataggatttatgttaaatactcattcaaattattgcttcaagcaaattacatacacactagcgacattttctttcaagccgggaggaaatcactcaacattcagatgaggaagtgtgatttttcatacgtgttctacggaaatagtaaataatggacttcacctagtctgcagtgtattatggggttcagaataaaatatgagttcaactggcaatttcaaatgcggctttggagagaaaacatttatttgactgaaagatttgcttctgacttgaggcccaggaacattcccagttttaactgtagtgttgcattcctgggaagttctgttccatagcttcctttgcaaattcatgtagatggatttctttagctctgacagtttcctccaaacctttcctacattcttccagggcctttgcttatagacaggggagttacaccaggatggttaggtttcaggttaacaaaaagaaacacttttattgtcaatattaatggcaaacctcgatttttacaaggcttgggtttagcagtgtgagcagatcaaaagcagcttggtttgatttctcaatattctctggagcttagacaattaactgcaattttgctcctaacaaaacaacacaaaaaagttagttacagaaatgttataggtaatcttttggcagagatttttacctgagtacaacatatcagaatctagaaaatttatctactgaacttgagttgagttttgcaggaaaaccccttaagaaaatcttgtgtgaactacgtcctcggttgcaatgccatgagcctgtttcagtgtgtgcattccaggcttgcctttctagctgggtaaggatccggcagactgaggtctccttggtaatttgggtacaccaagtctccagttaatgatagataatcagcctttgggtcattcggtcattctcttattacaaacccctcctgctctctctgatctcctttcaaactaaatttcacacaaacaaataaagcaagacagggacaagttcttaaaaaaagagagagaaatattagaaacgcctgatacagaactctaaacaaggaaaggcaagctaaaagaggataggaaagaacatcttatcaaaatgaacatgttgtgtacaaaacattaaaagaaaaggctctggtttttgttaaagtgacagaaaattaaaataaaaataattgcaggcaccaaagttataaacagggaaggcaggatgctagctggaaatgcgcagcactagggagctaatttgttgttacagattatatatctgcaccctgcttggagaagtgctactttgttccattttccagaagagaatggtttttcttcttaatacttgtgtgaatgcccacttaagttaacacaggccacaactttgaggaatgagaaatggaattgcattctgcttgcgaagcatccaacttcaaacgaagaaattggttgtgtacaaaaaaaaaagtagaatttcattcagaatacgtttggagacttcactaaattggtgtgactgatgcttttttgttttgctgacagaaggcacagatcattcatggggatgtataaccgaaaccagtcctctccaccgcctggggatcttcactttcgcagtctacgactgcctgtgactccagaaagacaaactgcagattggccaaggttaagaccagaggatctgaataaaaaagtagcaggatccttgctctgatctttcctgacatttcccaaatccacaaggcagagggcatggtgcagggttggagagtaaactgttccatactcagctctcaatgaggagcaccggcaagctagtttttgcagatggggaaattgaggcagagaagccaagacatgtgctaaaggtcatgcaggctatgaatggagctggaatgtgaacgcaggccatatgaccccagagcccatgttcttgaacccttagaaagacagcagcaacacacctggtgcagcagctgcttagttggagtggctgacaaggagagaatgatttccaggaagagcggaacacatatggaaggccttagcttatctttagcgcctcatacacccgttctggacttcagaaaggccagtgagtgggattaggcctcagagataggatgtcagtcccagtgagggatggcctagagcattctttaattctttcctttgggtcacacataagaaacaattttccagcactgatgagtgttattaacaatgagatgggatagaatttagttttccctatggctgtgcttcaaaaatagaaaagctgtcttttctctggaatgattgaatgaagctctggggaggaaaaggtggattggcagatctcttaaaggaagcttctccttctaggcactattctaaggcttaatattttaactccctatattaacctagttcaactaaacagtgatctgagtaattttatttttattaaagctcagatcaaaatgccattaacattgattgagaaaatcaaaggaatctttgatgtgagtggttaaattgctgaattatttcagtcccataccctcacagcatgagtacctgatctgatagacttctttggaattccttttttgtttgagacagagtcttgctctgtcgcccaggctggagtgcagcggtgtgatctcaaccattgcaacctccacctcccaggttcaagtgattctcatgcctcagcctcctgagtagctgggattacagatgtgcaccaccatgcccggctaattattttgtatctttagtagagatgaagttttgccatgtgggccaggctgttctcaaactactggcctcaagtgatctgcccgcctcggcctcccagactgctgggattacaggcgtgaggcaccgtgcctggctgggattccataataaatccctctgtgtctatttcttttttcaaatataattttcttcatttccaaacatcatctttaagactccaaggatttttccaggcacagtggctcatacctgtaatcccattgcttggagaggccaaggtggaagttcatttgaggccaggagttcgagaccaggtgggcaacatagtgaaaccttgtctctacaacataaaaaaaaaaataaaaccctaaggaaataatggtgcctcactacctttcaaagcttttgaccttcaagtcagaaaataaattatttttaggaaaggcatctcaaccttatttacaaatgaactatttgtcaagagcaacctctataaggataataggacttcctggtttgaaatgcagcatgaacaattctcagaggctcctggaagactaagaatgaggtttcttgatccgccttccctcggcatcttctcactctcttccctccttctcagaagctgtgtgcagcaatgggctatgcaactggtttcactggtgcctggtagaacttttaattcctccctgtcagcacatccctagtccactttcatagtttggataaggactggataagcagctgaacttctggggacttttccaaatgaaattcaacctttagacctttggaggtttacccagtcttcctcactacccgaagatgagtttggaacaaattttctcttaatggattctatttgtgggtaggagaggtaatgactgccttgctcagagtcatgagcataacttcaaataaggaaaaagagcctcgcaggaatgtgagaatagatgcgatcctgaggaaggtgtgtctgaggaggtgctgggaggttctgatcggctgttgaaggcagatactgtatctcacgtgacagaagtcacctcctgacatcagagttgtgtttgagtggtaatttaaaaaataatatagctgacaaggaaatgtggaaggcattacgttgcaatacagtgaaatgaacatacaacattcaagatcaattaccgggtactgattagctgggagaaaggcaataaaactttaaaaatagaattggtagaaatagcaccctgtcaaggtgggactgactatgcctcctgctggtttgttgcgaggaattctttttttgggaaaatcctgttgaattgtgtggcttgtgaatctggctctagaactgttaatgttataagaattgaaagaggactatttaaaaataccaagacatcttttaaaattcctatttttagaacagctacttgtcattaaaataaatcattccatttctatttgtccaggttactgctttcacagcagggccagggctatggtgaagtgtgggaggtgcccagtccccttcactgcagtcatggctctgtttcatgccacatgtgttattttataagtggttaagccccacataggcatgcaaacatggtacatctctatgtattggttttggtaatgttgtaaataattgggagaatacattaaaatttggtaatagtgctcctttggactcagtctctttttttttttttaagacagagtttcgctcttgttgcccaggctggagtgcaatggcatgatcttggctcattgcaacctctgcctcctgggttcaagcaagtctcctgcctcagccttcctgagtagctaggattacaggcatgtgccactatgcccggctaattttgtatttttagtagaaaaggggtttctccatgttggtcaggctggtcttgaattcccgacctcaggtgattccagttctaattccccaacagagttgtcttggttgcagtgagatatatatatatatatatatatatatatatatatatatatatatatatatatattttgagatggggtctcgctctgtcgcccagtctggagagcagtggcgcgatcttggcttgcagtgagacatttttatccatcctgatcacagcacttgcctccgggctcatgaagcccagcatgttactgctgttctgaacgtctctgctttttgagagacatgtttaatgaattgggagtatctgtgcacattgcattcacttaaaaagggaaaaataccttttaacagttatagctacagaaattcaatttagtttatttaggaggaaatgagagacttgaattgtaggtgtgaaatcttacaatctttcagaatgatttggtttgggggatggttggaactgcatggaattccttcagccaaaataatttttgtgagcacattcccaagctcacgatcatgttttgataagaaaaatccctttctccacaagttctcaggtcccactcattggcccctgccctcatttctggaacctatgttaggcagttatgtggctcagttcttggtgatatgttttcaatttgagtcaacttgatgagagaaaaattactaaaaagtgggaatgagctgtgaggtgaacagggttttcctatcaaagtggaggtatttttaaaagcatttattatttcaaactcaaacatttatagaaagccatgagtgtgaagtgtatgattaccagttgtggcttgctgcattgaaaaattcaagttcataggaaatatttactgaggctctggtttgcaagcagtttgttcaagagaacaatttggtccagaaggcatgtcagccaaaaaagagtttactaatatagtagtaacaggcaattaggattcataagcatcgccatggctgagacatgatttaaggtcttagatggaaagagttctgttattaagataacagaatttaaatgctgtatctgtctaggtcttatgcatgtcagaagtgagaaaactacttcttcattttccatttttatgagctctgatgtaacacagtttttttttttttctgtgttgaaaatgatgaatatagttcttggcacatttgttccatagtaaagaagaatttaacttgcaagtgaaaaacctctgcctttggccatggattaaaaagatgttatatgatgaagtttacttcctaaggaaaggttagttttgtgtggcactttctgaaaatttgtttgggacatatacaattcttttgtataaattctggaggtctgaggaaaattacttaatcacattagatgagaacatttctttttgtgtgaattgagttcttatcaaggttctgatgttttttctcatgtatttgcccttgggttcatctcaatacaatgcatttgtgtactattgaataaaaagcaggctgcaacagtatttatgacatatgatcctatatacacgtaaaatcttgtgtgtgtgtttgtgtgtgcacatgcatataaaaaaaactacattgttaaagttgttaatagttaactcccggtggtgggttttaagtgattattattttctttgtataagaaaaatagtgcacagttttcttttgttgttacgaaaggtgtcatacatttgaaagaggacatatgcacagtttaaataataataacatagtgaatacccactgcttggctgaaaaaaataatttattactctgttgcagaaggcaagccttccttctgcccctgcctctgtcatggaggtagctacttgcttgaattttgtgctaatcatgtctttgctttcttatatagtttagccagctgtgaatgtctccataaaacatacacagttttattttgattgtttttgaactttaaataaatgaaatcat

SEQ ID NO: 2264 - DNA, 39439 bp, Homo sapiens
cccagcactttgagaggtcaatacatgtggatcacttgagctcaggagtccaagaccagcctgggcaacatggtgagaccccatctttatcaaaaatacgaaaattagctgggcatattggttcacacctatagtcccagctacacaggaggctgaggtgggaagatcactggtgcctggaaagtcaaggctacagtgggccatgattgcactaatgcactccagcctgggtgacagagtgaggccctgtctcaaataaataaataaaatccccaagaaacatggattacataaagagacgaaatctgcgactcatcggcattcctgaaagagtaggagagagagtaagcgacttggaaaatatattttaggatataatccacgaaaatttccccactcttactagagaggatgacatgaaaattcaataaatacagagaacccctctgagatactgttaatggtaaccagagagaagagtcagaggtcatttataaagggaaccctgtcaggctagcagcagacctcttagaaaatttacaaagcagaagagactgagggcctattttcagcatcgttaaagagaacaaattccaaccaagaatttcatatcctgccaaactaagtttcataagtgaaagagaaataaaatccttctcagactaagcagatgctaaggaaatttattagaccagctttacaagaagtccttaaggaaatgctaaacatagaaacaaaagaaagacacctgctaaaacaaaaacacacttaagcacatggcccacagacactataaagcaactataccaatcaagtctacaaaacaaccagctaacaacacaatgaaagaatcaaaatctcacatatcaaaactaaccctgaatgcaaacggtctaaatgccaccacttaaaaggtatagagtggaaagccagataaaaagacgagacctggctgggcgtggtagctctcgcctgtaatctcagcactttgggaggctgaggtgggtggatcatttgaggtcagaagttcaagactagcctggtgagacatggtgaaatcccatctcttttaaaaatacaaaaattagccaggtgtggtggcgcatgcctgtagtcccagctacttgggaggctgaggcaggagaatggcttgaacccaggagatggaggtttcagtgagctgagatcatgccgttgcactccagcctgggcagtgatgtgagactccatctcaaaaaataaaaaaaaaataaaaaaaaaaagacaagacccaactgtctgttgtcttcaagagacccatcacaaatataatgacacccacaggcttgaagtagcaggatggagaaagatctaccatgcaaacagaaaacaaaaaagaacagtagtcactattcttatatcagatgaagcagactttaaatgaacaacaattaagaaggacaaagaagagcattacataatgataaagggttcaatccacaaagaacacagacctatcctaagtatatgcacactcaacattggagcactcagattcataaaacaagttcttctctaactacaaaaagacctagacagccacacaatcataatgggagacttcaatatccaacatcccactgacaacattagaattttgaggcagtaaactaacaaagaaattctggactttaacttggcactcaaccaatttgacctaatagacatctacctaatctttcacccagcaactacagaatatacgttcttctcatctgcacatggaacatagtctaagatcaaccaaatactctgtcattaagcgagtctcaataaatacaaaaaaaaattgaagtcataccaagcacactttcagaccacagtgcaataaaaatagaaattcatatcaagatgacctctcaaaactacacaaatacatggaaattagacaacttgctcttgaataactcttgggtgaacaatgaaacaaaggcttaaattaaaaaaactatttgaagttaatgaaaacagagacatgaccaaaatctttgggatgcagctaaagcagtgctaagaggaaagtttatagcactaaatgccttcatcaataagttagattttaagttaatctaatattgtacctacaggaactagaaaaaaactgaaccaaccccaaagctaacagaagaaaagaaataactaaaactagagaagaactgaacaaaattgaggctcgaatccatacaaaagatcaatgaaaccaagagtttcatttgttagagttaaaagaatagaaaggattgatagactgctagctagactaataaagagaagatccaagtaagtccaatcagaaatgagagaggtgacattacatccaatcccacagatatacaaaagacctagagaaaatggataaattcctggaaacaacctcccaatattaaaccaagaagaaagtaaaaacctgaacagaccaataacgagttctgaaactgaatcagtcataaaaaacctgccaactaaaaaaagccctggaccagacagattcacagccaaattctaccagaggtatgaagaactggtaccaatcttacttaaagtatttcaaaaacttgagaagaaggggctcatctctaactcattctacaaagccagcatcggcctaataccaaaatgtcggcagagacacaatgaataaagaaaactgcagatcagtatctccgatgaacatgttgaacaggtatcttcaacaaaatactaacaaactgaatccagaaacacaccaaaaattaataaaccacaatcaagtagattttattcctgggacaaaggctggttcaacatatgcaaatcaataaatgtgactcatcacataaacaaaattaaaagcaaaaatcatatgattatcttggtagatccagaaaatgctgttgaaaaatccaacatcccttcatgataaaaacacttaacagactagtcatcaaaggaacatactacaaaataataagagctgtcaatgacaaacacatagccaacattatactaaatgggcaatagctggaaccattctctctgagaactggaacaagacaagggtgcctactctcctcactcccattcaacatagtactggaagtcctggccagagcaatcagggaagagaaagaaataaaaaacattcaaacaggaaaaaagaagaagtcaaactacttgtatttgctgatgatacaattctatacctagaatacactaaccactctgccagagggtttctagaattcataaacaatttcactaaagtttcaggatacaaaaatcaatgcacaaaaatcagtagcatttctatacaccaataatgttcaagcagagagtcaattcaagaacacagtcacattttacaatagccacaaaaaatgaaataccaagaatacagctaactaaggaggtgaaagatctctacaaggagaactacaaaacactgctcaaagaaatcagacgtgatacaagcaaatggaaaagcattccatgctcctgaattggaagaatcaatattgttaaaatggccatactgcccaaagaaatttatagattcaatactattcctaactaccaatattagttttcacagaattagaaaaaactattttaaaattcatgtggaaccaataaagagcccaaatgtccaaagcaaccctaagcaaaaaaaaacaaaggtggaggcatcacattacctgacttcaaactatactacagtaaccaaactaacaaggtacaggtataaaaacagacatgtagaccaatgggacagaatagagaacccagaaataaagctacagacctacaaacacctgatcttcaaagatggcaaaaacaagaaatgaggaaaggactccctattcaataagtggttctgaagtaactggcttgacatatgcataagaatgaaaccagacccctgcctttcaccctacacaaaattaattaagatggattaaagatttaaatgttagacctcaaactacaaaaatcctagaagaaaacctaggaaatacccttctcgacattggctttggcagagaattcttggctaagtccccaaaagcaattacagcagaagcaaacattgacaagtgggacctaattaaattaagagcttctgcccagcaaaagaaactgttaacaaagtaaacagacaacctacagaatgggcaaaaatattcacaaattatgcatctaacaatggtttaatatccagaatcaataaggaacttaaatcaacaagcaaaaaccaaataaccccattaaaatgtgagcaaaggacatgaacaggcacttctcaaaagaagacatacaagcagccaacaaacatatgaaaaaatacacatcatcactaatcctcagaaaaatgcaaatccaaaccacaatgagaggccatctcatactagttagaaaagctatcattaaaaagtcaaaaaatgacagatgctggtaagtctgtggagaaaagggaatgcttatacactgttggtgaggatgtaaattagttcagccactatggaaagcagttttgagatttttgaaagaacttaaaaagcagagctgccatttgacccagaaatcccattactggatgtatatccaaaggaaaataaatcattctaccaaaagacacattcacttgtatgttcactacagtgctattcacaatagcaaacacatggaatcaatctaggtgcccatcaatggtggactggataaagacaatctggtatatatacgttgtagaatattacgcagccataaaaaaagaacaaaaatcatatcctgtgtagcagcatagatgcagctggaggccattattctaagtgaattaacacaggagcagaaaaccaaatactgcatgttctcacaagtgagagctaaacacacatatgcgtgggcataaagataggaactatagacactggggaatgactaaaggggtagagaggaagggagggaggtgtgggctgaaaaactacttacagggtactaagctcactacctggttgatggaatcatccatacctcaaaccccatcatcacacaatatacccttgtaacaaacctgcacctgtaccccctgaatctaaaataaaagttgaaactattcaaaatgatgataatagtttttaaaagttcagacagacaagaaatatgaagaaaaatgttgatttctaagacatttttgagccactaggtcttaaaattaatttcacttacaaaatcaacctttattttctaagttggaaataatttcaaagcctaggatttgtgagtttgtgtaggagatgttttggctatgaatctctgttcttgttctcaaacatcaggagagtttatttctcagtccctctctaacacattgtggctgccagtgttgagctcttgtatacagtcacatctttggtctcattggcatctttgagactgtccatcacaggttgagaagctgccatgattagtagcaattctcctagtgccacctcctgtggatgtgtaagtctttacaacgtatatgtaccacctgtttgacacttttgctgccttggggtggtaattttgtcatttaacctcattgatggtaaagatgacatgagctcagtgactcccggtgatgaaagcagcctgcagcagtgactgggattctccagcttccctgtcactcacagtgacttccagctcggaatatgcagccagcctcctagactccaccttgtgtacattacccactctctttattcacctagaatttatgcaatcctagaggctggattttattagcttgcctgccattcaacaccgtgtacttccattgggccaagttcgtactagatgatgttaggggcaactgaattccctaactgcctaggatgaccttataatttatcattcaaaccaggacacttttgagcagcaaaaagggtagtgttaataatgatgctgaaacagtagcctaggacttctctggaaaacccaagttgtattgtgcccctacttccaacctatgtgtgggtactgtgtgccatataccactccctgaaccaatcagcagtggccagtagcatgctgattgcaactgagaaggttatcagcagctgaaaatacttatggaggaagaaacatgtctgggaaattcgctatcaagggagaaacctgcacaccaaccctaagacctcccacatccaatcagttgtcaagtcttgctgattctatcttctaaagatctcaggtcatctattcatgttcctctatccccagtatcttcactttggttgctgccaccatcatccttccctctgagtattgcaatagcctcctaaatgtttccctgttccagtcttgccctcctctaatcaatgatctagatagaagacagcaatttttctgaggccaaagccatgaactctgctaggcacaggggattcagaagtgaatgtccaagtcagggtcactccaaggtacttaccttcctgcagcagagacagatgatgaacaagtaaactaataaataataattttagactttgatataagccatggagataagcaagagagagggatgataggaagagaaggtggcagggaagaagcttctctgggagtgattttgcaccaaatttgaaggatgacacaagatagtcatgttgagggtcagggaaaaggcatcccaggaaatgcgaagaaggatgtagaacaccctgagaaaggatacattcaaatgtttttgtttctttgtttgttttgttttgagatggagtttcactctggttgccctggcaaaagtgcaatggcacgatcttggctcactgcaacctctgcctcccaggtagctgggattacaggcgcccaccgccacacccagctaatttttttttatttttagtggagacgggttttcatcatgttgtccagtctggtcttgaagtcctgacctcaggtgatccacccaccttggcctcccaaagtgctgggattacaggtgtgagccactgcgctcggcctcaaatgtttttaagtagcagaatgggatacctgtgtggctggcagtcagtaatcaaggggagagtggtttgcaatcaagttgaagtgcaggcaagggccaagttacctggtgccttgtaggctaaggagtttggattttaattctaagagcaacgcaaagcctttaaatagtattaagcagaggagctaattgaaccaattatcttttttaaaaactgactttgtcttctgtgtgaaaaataggttatgggtaaaaaggacattgaatagaaggctggagttctcattcaggtgggagaggatggtggctatgggaatggagtgaaacttttttaattttatcatactgatggcatttgtgattacttagataaatgtttaaacttgcatctttaaaatctatctaacactccttttattatcatctcaactgcgcaatttgtgtcatatgttgtttatgtcattcagtgtttgtaaaagtattcttttttttttttttttttttttgagacggagtctcgctctgtcgcccaggctggagtgctgtggcgcgatctcggctcactgcaggctccgccccctgggttcacaccattgtcctgcctcagcctcccaagtagctgggactacaggcgcctgccaccatgcccggccaattttttttgtatttttagtagagacggggtttcaccatgttggccaggatggtctcgatctcctgacctcatgatccacccacctcggcctcccaaagtgctgggattacaggcgtgagccaccacacctggccaaaagtattctttgaaaaccagatttttggtcgggcactgtggttcatgcctgtaatcccagcactttgggaggccagggcaggtggatcatttgaggtcaggagtttgagaccagcctggccaccatggtgaaaccccgtctctactaaaagtacaaaagttagtcaggcggtggtggtgcatgctgtaatcccagctactcaggaggctcaggcaagagaatcacttgagcctgaaagatggaggctgcagtgagctgagattacgccactgctctccagcctgggtgacagagtgagacattgtctccaaaaaagaaaaaaaagaaaaacagatttttgatttatgttttttgtatgcatttttatgccagccaactatgaggtatttaattttagagactgtgtactgaaagtctagaaatgcctatagatgtctagaaaatggctagaaaatctatcccagtggatctcaaactcagctcctgacattgatttcaatagagggtgggaaatcctggtgagtctgctagcagtctccagtggcagtggcagtggctttctgattgccaacacaaggaagaatgtattaaattttggagtaaattattgagtgttccaaagccaaggaactatgcttttcagtatctggtgaaatgaggtgccatcatgtcagaaggatggctgtgtgtgtggaggtggatatccatctatctgtccattcatccatgcatatactcagatatacaaatcatgccatggggaagggggctattgcatgtagaggctgtgaaacaacatagagtcctgcctaccttccattatttaaaaagttaaaacctatattctttttatatttgctagttctctccaaaaagtggtgacagttaacttggttgactgaaccctagtttgaacctgtttaagaattgggcatttacttatttgcagagcagcagaaatgcttttctgaactctcttgatataccactctgtgccaggaagacacatgtaattcagatgtgtctgggcccatttcagcatactggctgtcggaagtctgcaggaggaaataccttcttgattaattctccaaggctgacattttttgctgctcagcctgctgaatgatttcacatgtggtttttgcagagtcagaattcttcagtgacgtacaggacaatttttttcttggcagcatgaagttcttttggccaccagggtggggaagttattttaatgtatgaataaggggcaattttatttagaaaaagagacttacctcttggtcatttaaaatacattttaggccaaataatcatgatatgaggaaaaaatttgcaccatcatttaatgaatttcaggtttttacaagggttcccctccaactccccatttttcttcctaatgaatggctctagaatacagttttgaatgatttacaaacctgcatacccagcagccccctagaatttttcctttttgtaagtgcattatattgacgttatctgcagatcatttccttgaactgtatttttgctagatgtggtcctggggaaaaatatagtcaaacaaagaaacaaaacacagtcctgttctagacccacccagaatgatataatactaagtatcttccatattcagcggtgatactgttttgagaactcacagccggtttgagtttagttcagttcaatgttttctttctgtttttgttcataatttcccaggggcctactacttctgtgcttagcttgaaacgtagtgttcttctagcagagaatgctatctggtatatttaaatcaattaggggcactgaatgagaagctcagttatagacaaagataacagattacatttttattaggaaatcttgagttattaagaatgtttttgtaaatcgaagacacgaaaaaatctcattcgttgtctgggcactgtattttgcctaaccgtatcatttcgcttaattctcttagaaacattgagttgcatatttttatccctgtgtcagttgttggtggctctgctacaaataaggtgaccaacccaatcaggacttacagattttcctaggacatacgattttcagtgctaaaaccaggacaagttgatagccttagaaattaccttattagtggcctaaaacaaaatgatcatttttcacaattctgcaggctggcctagtggggcttctgggggcatcacttgggacccttgtgtgactgcttggtggagtctggatggggtaagatatctgggcctcggcagagatggttgggcatctccttccattggggtcttttgttccagacttatttgcagcctggaggcctcagggttccaagagggcaaacacagaagctacaaggtcttttgaaactgctcagaagtcacacaatgtcacttccaccacatttagaggtcaagacacagaggcagcccaattcaaagcatggggaaatagaattcacctttcaatggaaggagtggagagtggacatttttaatccatcacaatccctgttatatacattagcattctgagattcagtaaatttaagtaacttttctaagaccacacagctcctaaatggcagatccaggatttgaacctaggtctctatgcctaaaaaacccatgctctgatgcttccagatgcggtataaatatattatcccagcatccgataatacagagagcaactgggcattttcttgctgttctgggatggggtagaagaaataagggtggagaaggaagaaggaaaagacagagaagtaatgatttgtgacttctggacagccccaagtcatagaaattcgtccaatatgttttcagacgataactcatacttgcccaattctgtacaatgtgtttgggctcctgctgtccccccacccttacttgagtacagctttattccccaaagtaaatgcttccaagggcctcagatttatgcacttcttggccttgatgattatttcatgctcttagacattattctcatgtttgttctactgaggcatttgcgtcccctcctacagttgagagtttgagagacagttgctctaagacagttgttttcaaagtaggcaagtccctgagagctttcagggagtccatggaatcaaaactacttttatagttctcagatattgtttgcttttttctactctcattctttgagtgtaaattggagtttttcagaaactacgtaatgtgtgatactgcaacagattgtagcagaagcaggtgagaattctactgttttctattaagacagacattaaggagatttgaagaaaatctgttttttcttgtttttagaaaatagttatttttctttaaaaatattacgtatgttagcatgtaaaagtttgtgttacaattttaaatgaattaatgcacaaatatttttaaagtttctcagttacttcctattaactgatctatctgttaataaaatgcacataaactaaagctccttggggttctcaaaaaattaaatttaagatggatgaaagcaaaaaggttgagaacgattttcatcatcattttactagctgccattttctgagctcctatatttttctgcacattctcgtttaatcctcacagcaactttatctggaaagtatcccattaatccccaacaccccagaggaatgaactggtgtgcaaaatcattagtcacacagctagcgttctgtggagctagaatttgaaggcagtccacctgactccggagttaaactgagaaataaacaatcatgcaataatataacttgcttttctggaccagaagaaagagatacacagagatctaaaggacttgcatgagtcatttgaggtaccttgggcagccagcggcgatgactttctgctggcctgtcccatgaaaagttgactagtcatagcaacttgtccttttaaagtgcagttttgtgaaaaagaaattcctgcaaattcaagtgctgctcttaacctagtagtggtttctgttcctcttataacaagcatttctactaactctttatgcaaactctgagtactcaacaaaaaagaaacatttgttcatccaattatcacattctaaactgcagaaataaacgcttattgacttaaatttcccaattactttagcgatcagcctgtgtattttgtttgtttgggtctaattggtaatagtaaagcaacatttgctaccgcctattgagcacttatgtgtcaggcactaaaagagagacttcatagactttataatcatgatctccctgcatcctcaaaagaatcacttgaggcgggcagtggtgttatcctctctaccttatagataaggagatggggcttatagaagttaagctgcttgcctgaggtcacccagctagtaagcaggtgactcaggaattgaaccaggtctgggttgttcccaggatcatgttctgaatcattattctctgccagccccgttaaaggcaatctcaatttgtctatggaaaggaggtctccaaagtagacttgaagtagcccagataaattaggaaagaaacaaatgctattttaccttcaaacattttaaggaaaaaccatgagatgcaacccactcatgtaatgagaaaacagatgcaatcatttaattttatccttaacccttcactcacacctcgcagttaaaagtatgcaggcaaaaggcataaaaattgttctcatctctatctggtacaacccagggatattttaaggtgggcaaaaatgccaactgagttttgattttaattgtatcaggcaggccttccttctgaccttccttcctttagttttaaagtgtcatgatcatgtccatggtgtcagaggtgatgggaaagctgaggatccagatgtgtcaacaacagatgcacgcactgctggaacactggaaaaagagagtcgataggatttcccttagggctatgctccaggtgcactaggaggggacgaggacaaaattctctcatgatgtgatttattttgggtgctgagctaaccaggtgctttcagcaggagttccaatggcaaattttggctataacaaccttgacaactttctgattcctgataagcattcagattgctgctactgttgtgaaagcttagagtcttggcacagaaaaggattctctctagtccagcctcttacataatttgaatagcatttataaattgtgcttgagccatgatgcaaaggaattcaatatactgttaagacatatctgaccagagcagcttgttgttgcttagggacctcatattagagacacaaaacagacaatttttgccattctaaatccatacacttaattatctccactctaaattagctccagaaacaaaaaaaaaatgaatgaatgtgtccaaatctggataatgtaagcagatgaccagaaggtggagggttgtgtgcatggacttctcctctgctgccttctgcgcgctctgatctcctgtcccaagatagcaattaatcgatcagagcatgctatgtccagtagtgctttctggccattgtttttaacacagtgacgcgtgggagtatctctttggtgctctgttgtttgagcaattttattgagccccataattctttggaacttttaggtagttaaaaccataatcaaaggcagaatttatgcagtcatctggctgctgtgctagataataagatcagaggtggattcttgtctgtgtcactttaatgcctccaccccaagtgccttgcaaatggtgaataagtaaataattttacaaatagtaacagatatgagctcttactgtgtgtcagatagtacaccaagggatttatctaactcccttaagaggtaggtattactgatatccccattttgcagactaaggcccagtacagtccaaggcccagttccccaggtagtaggccgtagaggccgtgaatttaaccattagtactacactgcttccaaatacttgctgactgaacaaacattttgtaatttttattttctccctctctctctccctcttcacccaccccaccatgagtcttagctgtcggccttccttttttttctccgaattgactggctggcttagaagagcacagggaaatcattttcttgtttacctctgaaatcctcagttactttcaggtttgtcagttgctgtagaatcattattttatgcacagcagctcattcgggttctaaagtatgtgctcatttctctaccagcacccatgtccaggtccattatacctggggacatttcagttttgtttgcttttattactttgctcttctatacctgaagtcaagatgaagtggccttgtttgttcaccttcatatatcccttctcaggtggaggaagcctgggggaagccaggctttttatttttattttttaagtttagttttgtttttgttttggagccatgaataacatttttcaaattctgtttgctaatttcaaatctacttaaattcttaagcactggcaaggcaaacatttcttggtcccatgcaatggctttggggaggagcttggggcacattcaggccagggtaataaggaagcagaggggagcaatggagagtaggtaacacagatacagaaaactctaggccgggcgcggtgggtcacgcctgtaatcccagcactttgggaggccaaggtgggcagatcacctgaactcaggagttcgtgaccagcctggccaacattgtgaaaccccctctctgcaaaagatacaaaaattagccgggtgtggtggcacttgcctgtaatcccagctacttgagccgagattgcaccactgcactccagcctgggcaacagagtgagacttcatttaaaaaaacaaacataaaaactctaaactacacaggatttcaaggaaagcctggagctgacccgttactctccttggttgccccatggcacacacgtgtgcagatactatgagcaaaattcaaggtgatcgctgactccagaaacctcatctgagaaaataagagaattcttactgacagtgacagccatatgacttgaccagtttacttaaacctctattctttcccctgtagaaaggaagcagttaagggctctacatcacagatctgttgtgggggttaaattaaataaaatgtgcaaagcacttggcatgttttctggtccacagctcacaacaaagataggaactttttctcctgctggcctgctctaccatttgacattccaagcatgagagaatcacctctgtgggtttaggcaccaccccttgtactcttctgaagagtatttttaaagtattagtgtttaagtattaatattaagtattaatgtattaatattgagtattaaagtgttcaaatatctatgggtttaggcaccaccccttgtattcttcccaagagtatttttaaagtattagtatttaagtattaatattaagtattaacatattaatattgagttttaaagtgttcagatatctgtgggttttggcaccacctcttgtactcttcccaagagtatttttaaagtattcctttaatatattatttcatattaatttatcagcattaggataggaatcactaagtctccccaggagtgaaaaataaaagagtgactatcatttattgagtatatattatattccaggcaacaagttaaacattctgtgttcaatatatcattaaatcttctcaacaaccttatgaggagctaatttaaagggctgaataacttatccgaggtcatttggtcagaagtggtagaattgagatgttaacccaggactgcctaacaccaaagccaatacccatgttacagagctctatgacccccactggtttgatgataaagaagaggtccggagaataccaaggcaggccaggcctatttcaagttccaaggtaaaggcatagggtcatctggcaggagcaagctgtaagagctccagcaatagaatagcagtgggaagcacagaagagaaagtcaagggaactgcatacaaactgcacttccttaaacacgcttgccttggctttcaagttctgtctgtactttctctgctgcctctcggcctcaactcccacaacctccacctctccctgtgcctctggcctggtccttctgtgcgctatattcctctgggtctttgcttccactgtcctatctgcaaatactttttcaaacacggaccatgtctctcttatacagaattgctccccaatgccagtcctgattcctggcaaacagtggttgaccttttcatctgaatggacaaatgactaataaatgaacaaatgaatgggacttattaggactttatcttgtgctggttctgaccagcttctgtatcaaagatctacaacttacaattgctctctttcttgtgtcttataagctcatttaaacacacctattaatatgttcctgtcctgtacgcatctgttccagtctagtcaaccggacaaaaggaagaagccgaaactgattcttttgcatcccttttccctcctagtagtgcaacttgaagaggcaacaagaaagaactaggctctctattactaagtctcctgtctcagtttccctggacaggattttctacctaaaaagaggcatgttataagtcttcaggaattagtgggatgaaatgctttggattccttgggagatggagtgctctataaacagaaagtccagatgatcctgagtcccatgcactaactgtggaaggtggctttatatcatcccaagtgcatattagatggcacaagataaatcatttagatgttttattctaacatataatttaatatagataactacaaagaaaacaataagtagagcacattctccctatccagataacttctgctacttttaaaaataatatgtgtaaggccacaaatttttcattctaattttgactaacccattttcagatctatattgtatcatacaagagcatcaatttgttaggagaaactgaaattaatttgactaattgttgttgttaatcaaaggttgagtaaagcttaggggagggagaggcagatcacttacattgatacagaactgatgtatatcatatggaccagttctggcttcctgtaaggatagcttataattggctgccaaatgtggtaatagcggttcattttcccagagttatggattatataatatctagaattagtcgagtcatatatgagttatttatgactgtatatcaatattactacaaacttagcagcttaaaacaacatacctttcttatctcaaagtttctgtggatcagggttgggaagactgcaacaagaaaagagggaaagccaatacaaggaagctttgtcaagtcagagcctaggatggacttctagtgctcaattccactggatctcctgaggagctttatgaaatgcacttctacaggaaagaagcagcatatgttcatagtctacattgccattgttcaatggtagctctgcaggcgttaactcccctacaattctgagttgtgcatgtgtgagtgcagatggctcccacagacattccatactaaagcaatagagaagccccaggcttactgggtcctctaccaggctgcaaggaaggtgttgacgaggggcagaggttttatcagaggttcaactagggaaggatccaattacaagttctcatggttattggcagaattcagttctttgtaggatgtcaataagggcctcagtttcttgctggctatcagctgaagcttcgctcagcttcctgccacatggccctccataggcagctcataacgaaagagtttgcttcttcaaagctagcaagggagagtttccttgcaagacaggcattacagcctgtaatcacatacatcctgtaacctttgccatactctactgcttagaagtaagtcacaggtcctgtccacattcagtgggcagagattacaccatggcatgaatgcaaggaggcaagggtcctggagccaccttagagtctgtttgccacagtgactaagagaaggcagaggtattaggtcaacaggaacaggataattggataacctgagctagcataaattcaattttaggcaagcatctttgagtccaagaaagcagtcaagtttttaaaaacctaatatactatcagtttatcaatccctccttaacagaaagtatttttaatctgaaagatccccatctattagttccccaatgctattagttctagcatttagattcccaagagatgaaaattaagtctcttttaagtaagcttctcttctccacataaaattgttccatagtattttccttgactcatcagtgtccagctatttagcataactttaattagacaattaacaaattatagaaatatactagttaggtcaaatcactgaaacttttttaaaatccccaaaaatcaatttcctggttttctccttttaatcagaattaggagagccactgcataaaatagttatttttaatactgtcgtttgcagaagcatgcttgttttttctttgttatgcttaatgtggtacattttacagatgttgagagaatacttcagaaagtcttgaagggacaatgagagattgtggtttaacaacaaagcgtctggcagtgtcaaggcatattggtaatagttgtattgttgaagtgtaagatccttggttagtcttcagaaggaatgtgctcttggcagggtacagctgcatatgtttctgtgcagttcagtgtcctttatggttcattttcccaaaggctcattgtgcttattgcatcatttgtttttatttgtaagagtgttttagaagcttcagaacagttgtagagtcattactgtttctagctgtaaatggttatggctgcccatggaaattatgctgaaggcaaacaaaagtaaataaaagtccctcttccgtacctttcctctttatctgcctttcctactattccacgctaggaaacccaattctgtgggattacacagggacaaggttccacacatatatcacagctcattctgatttatgactaattggtctcccaagaagggctcaatgtgctttaggatataggcaaacgacctgcatttaaaattaaagctggcatattcattttgaaggacagagttgaagtcaacgactctacaaaatttctgatgcataaacttatttttcccctccttcaaatgaggtaacaacccaactctatactcagtcctgggaagccaatgcttctgtacctaaaactgttcatataaaatgggtaacatgcagggtactggaaaagcaattcatcacaggaaatcggaaataattttaactctattagtaaatactgcaaatcactgtcctgagcccagtcagtcaagtgcctgcattattttttaacatgcttatgtttccatttacaataccaaatagaacttgaaagagagatgtcttgttattcaaaaacaatatttttcataatatacgaaaacaatccatggtatctccacaagtaccctgtgtgtagttttctgtgtgcagcacagtaaagttgttattggttgtgctactcatattttttgttgtgttgtcatttattgtcaattaaatatctgttgagtacagcaggcccttagtacccatgggttctacatccttggattcaatcaattgtggatcaaaaatattcaaaaaaaaaagtatggttgcatctgtactgaacatgtacagactttttttcttgtcattattccctaaacaatacagtataagaatgatttacattgtattaggtattataagtaatctggagattatttaaaatacacaggaggatgtgaataggttatatgcaaatactatgctgttttatatcaggaacttgagcatctatagattttggtatccaaggggggacagtcttggaaccaatcccctatggatactgagagataaccatataagatactggagcggatatcatggagaaagaattagagggatcccctttcctcaaagagcttctaatctgggtacagacatgactttgactctctcaaatctttcagtggattccattgtctgagggatggagatgcatcttctagccagagctcataagattctaggttcccagccaccacctgcctctacattagttgtttcaatgattcagaccagtgctatattcccatttggcaggtacagaaactgagacccaaaaagggataagtaagcttacaaacaattgccaggtagcagagggtgattcaaggccagagctattatcttctaactctcctaacctgtgattatatcataacgcaaccaaccaatttttgagatgaggagcagtctttcaaaaatacatatttttgaacttttatagcaggattatatagcagcctcagttgggaaaccctgggttccaaatgagaagaggtaagtcctgttcctgactttgtcaataattagctgtatgatcttagaaaggtcattttgcttcattttctttatttacaaagtgatgaaagttgactaattacttttaggcaacattttccaaatctgtttcaaataggcattgctgtaagctatgggtccatatttggagatgtgcaatgtgcgttagcatgttagaggtaccatgaggtcccacgtgaagaaacctgttagcaaagaccttttaaaacttacttatctctggaacacttagtcgtgcctcacaaagctcatgttccctagcaaataatctgggacatgatttttcaaattttcttttggatctaaaatctgatagatgacatttttgcttacgaaatgttccataccttcaacccctgtgttctctcttagttgtgactttccacacatcacacccctgccccccgcacaggaaatcaacacggtgggcaacaaataaatgtgattgactgatttatttggctcttaaggttaatgtattctaaacattgcttatttaatatgtttggcaaaatctcatctaacacagaactgttctgggatgtgaagcactgtgctctgggaactgggtgtaaacaaccaactctccccagagccagccaaagagatgccagatgacatttcagtaccatttggctatgagagtttcattcaaatgcaaaaacaataaacagattctgtccctggttagcagacttctgatctagccattctgtctgagactggtctatagaaaatcaaaccatttggtgttaagtgccactgagcagtcactctgatgtgacagccatttttctcatcctccttctaatagtttacaagataagttggctctgccagattctcccaggagaaaaccctcctattcatccttagaatgccacttggtgtgtactttagcagtaaattaccatacactacccccatggtttgaaggagctgattcacaatgaaagcaccagagtttccttggaattaatttgactatgccacatttctatgcccaagaaaacaaaataactttaatattcaatagaatacatacacaaaaatggacttttaaaaaagacagttgtttttaatacaagatcttaaaacagcatcatttttcatcttaggaaatcatgtgtgtccaagtgattttgtattataattacattgtttacaatgtaccaaaaagcataaagacacataacaccttgcccagatgtggtggttcacacccgtaatcccagcactttggtaagctgagatggctggatcacttgaggccaggaattcaagaccagcctggccaacatggtgaaaccctgtctgtactgaaaatacaaaaaaaaaaaaaaaaaaaaaaaaaaaagccagcatggtggtacatacctgtagtcctagctactcgggaggctgaggcagaggatcacttgaacctgggaggcagaggttgcagtgatttgagattgcaccactgcactctagtcttccagcctgggtgacagagtgagactccatctcacaaaaaaaaaaaaaaaaaaaaagaagacgcataacactttattcaacctgaacctattttcaaaaactgtcttttatctctgtctttaaaaacaagcaacaaataaagatcctgtgtaagctgtgtaatgagagaacactcaatactataggttcataactaaaaacaagaaaaatgtttttgtttgttccaacttttctaagtgcaagtaaaccgtcaaaaaaaaaagacctcttcttctgagcacattacatagtggtaatattcttagtatattgtggtgttaggtagttgaaatttgcagtgtagaataatgagtaagagtagagaatggactttgaggtggaaccagggtgttaatcatagctctgcctcctgctagctattagcactttttaaaaaatcattgagccttggtttccttatctgtgcatgggaggtataccttttccacaggttattttgaagattaaaaaaaggatacagcccatatcacggttatcctattcctgtcacaaaataagcaggtaatgatatggacaggagacagggaaatactgaaatactgggtagaagagaatgattacccagcaaaagacccaccctcaagcctgtaaatccatggccctaaatgggaacgggcatttttgttttcatgcccaaaaagttgcctattggcccgccactccccccaatcctgtacccatatgagccccaaacatccggctccaggaggagacaagcagaggaactgaagaacagaagagcagcagagaggagaggagagaagagaaggatcgttgagaggagttccgctggggatggtcagagaggagatcagctgctggacagcaaaactccaggggaagatcatcttcctgctccatccgctttccagctccctatccatcccactgagagccacttccaccacccagtgaaacccctgcattcaccatccttcaaatctgtttgtgatctgattcttccaggactctggacaagagttcaggatacagaaagctgtcacactggccctctgcccttgcaaaaaggcagagggtccactgagctggttaacacttaagccgtccacagatgtcaaggctaaaagagcatgctgcaacacatgcccacttgggctccagggagtcataggactctacccctggatgctgctgtggggctggagcccagcgccctgcctcctgcacctgtccatctacatgctccccgtcacataaagggtttgggcagtggtggcaaccaaacagatgagccacatccctgtcacacatcctgtgagggggtcagggaactctcccatttcagtaagaaatagttattgttttacagagactttattggttcatttgaaaggagggccagaggtagggttggcccaggaataccattccctgtgatcctcttggccccaaccctctatttttggcttcttctgagggaaatctaggcccctccttcacacacaatgataaccttctgaaaccttttgccagaggcttctagaggacttatttgacgtatcatcgatccactgtcactggccaagttgagtcacttagtcttttctgaatatatgactggaaaagaggataaaaaaaacccatcaggccaatcaggccacatctgcaactggggacagtgttccaagctatgtgagctgtgttggagagtgtggatcatgtttacaaaaatcagtattgtaccttgaaaaacatgacattaataatgattctaacagaataaaacatgaacaataaaaaagtcagtattgtgctagaaaggaggaagtatagtagggtactgctagacaccgtcaatgtccaccatactagtgctcctccaacttcagcattcatcagatcatctggggatatggttaaaatgcaaattctgattcaaaagttccaggatgaggcatgagattatacatttctaacaagtacactgtctgctgtccttatttgagtagcaagatacaaccaccaacaaatagcaccccagcaaaatacaggctgggatcaacagcttgtaactacaagaaagttggctaatattggtggctaaagaacaaaaagaatgtaactgaccaatgcagaaatcaaacacattacacattgacatctaagtaacctctaagcaggttccattttagccacctgaccaagtcagccatttccatttctaaataaattaggtgagatagtgtccaccacctcatgatcaataccatgaattctggataactcaatgaatattcagttcaacctaatgcctgtatcaggcattgtgctagaccttgaaattaaaatgatgatctaaaccaggagttcagcaaactttttttagagggtcaaatagtacatattttaatctttgcaggccaagagagaaaatcaatgatattatgcgaggacttacatatacctatataaagtgttgctattttaaggcattcttacttgcggatcatacaaaaccatatggcttggcccacaggacttactttgccaacctccagtgcatgtagctatggtctctatcctcatggagcttacagtttattcaaagtctgacatgatgggttggcatttttttcaaaccttccctcccaatcccccttgtcatttgaatgaaaccgagcctaccggtaaaatggcttgtccaagttcacctacctatggacccaaatcccttaaccattgatcaggagctatgtgccaaagaacagctattgaaacattcttctggcatttaatttaaggtcataacatgaaaacatacaagtgccaaatcaaagattcttaagagctcagtataaagggaggaaacattaaccattaaattgtcccttcaaatacttatctttaaatgataatcacagacccatggaaaaagagctaaacagcaccatgtgtgtgtaaccaaatcaccacacctacacataaatgagcttctgcatatacaaagcaaacactaacttagccacagatgtttcccaagagtctatgcaactacatgctcttaagccatattccacagcttgggaaccacaatataaacttctcccagactctcaattccggctggaaacaaagctgctccttgtcagatagagggaatggaagtgaaaggcactgtgctagcacttctcaagggcccatttaacaggtgtgctcactgagtcacaaagtgggaatttgcttcgagagcagggcttagccatatagtttccagtaattctgacttttcctgcagagaaaaagattaagccatccactgcctaactctgaccaccacattgtgtttgcttttgcaggtttatcccacaacgttcctttttttttttttttttttttttttgtggtacttgttggccttttgtgtttaaaatgtcatttgaagtctgaaaaagaatcattttgctatcattcacaatgtcaaaagatggatggcttggcagggctggtgccacaagtcagatagatttagagggtggcatccccttgtggaagtaattcataatcactaaataaaaactttttaaatatttttctgtcccaaagtatatgaacaactcttgttcattttaagctgactgattgaagtcatatcccaaagatctttcacgcttaaagagaggggggaaaaaaatagatcccagaatctcacacccattatctgcttggccttttaaaagtctctttttttcttatagtcaatagcctttaggatctatgagttcataattgtatgtaattatctcagtgagccagctagcatttgtctatttattatttgttgtatgcattagcctatgcaaactcctaacaaaggctgtagaaagcaaaataaatagatgatatgtctatcttcagttagcttttaatcattagagaaatttaaacaaaagtccaaatgatctaaacatataaaatccccaaccccctccacagtgtacccatcattaccccatcatgaaagttctattttctaaaatttctatagcctttaacaatttagattaaataataggccatttgtaattttttctaattgactttcacataaagccttgatgcattttctagaatgtgcattttctgagggtagaaaatttagatttctgaaactcttgcatttgcttgtattatgctaagcaaatggtgggcatattcatttgccttttctaaagatacacatcaagatggtggagttgtatttactggctttggaatcaaatccctgactctcaaagacactagctgtcaccttcgactgtcagttttctcatgtgtacagtgggataataatcacacctatccttgtggtaaggatcatgcatatgaatgcatgtgatatgtgtcatgcttgtcatatgccatacacaaaagtaatgcccagtacatggctggctgctgctgttttcgttcctgctgctgttcctcccaccaccaaggaaaaaacaaacaaacaaacaaaaaaccctcctaaaagctgagtaacaatctgagggtaagacaacttgagataaacaacacagtaaaacctgacattaatccttgaagcaagcctaaaaccagacagtttttcctcattttcagaacacctaaaagggaatagtcccgtgtggtcttgagaataaaaattaaggaaaattgtccattttttcaaaggaattcagcatatgatttctaaaaccggtgtgttctctgggtgcaaagtctgatttacagactactttccagggacagggtctagcttgagccaacacccatgctggtccctggattgcctttctctatccctttctcgtccctgggagggctgccatgcctatgccccaatttatgagggtagaaataggaacacaagagcaagtcactgacccatcataggtccaggcttctagttggtagtggggtactttccggtgcttcttttgtacttgccccttgggctgccaaagtagttttggacatttttctgctgtattctgtaaggtttggtcagccaagaaggaccaatctattggtggctcaataaagtgcttctcaccagtttgtgcaggtcataaacattgcctctgagtgcactaagattcctatggttgcaagagacagaaaactgaatgcaaaataagcttcagcaaaaaaggtgaattattggctcatgtaagtgaaaagtccagggttcaggaggtttccaggacttaagtaatttcaccatgtcttgcttttcttctctcccctctaccttccactgagtctgtttcattctgaggtacaccatggtgcccctggaagctgcaggcttagacctgagtcaattcttctccctaagccaatcaccaaagctagcagaaggcaattttctagtgtgataaggcctaggccaggtgtctacactagtgagtcacttgcagtgtggttaattctgttgaagtacttaaattaagaatacagaaagagttatcccccaaaaggaaaaatggtgaggttaattctaaacaccaagtaacgaagaagtatggtaaggaaaactatttgcttgcaggccataagggtctagagaatgtagaaatatctataagtttttcatgtcatcctgctcattttttgttttcttcacacttatttcctagaatttctaccagtggatagaggtatccacagactaaaattagttttgtgggtgagcctaactttggggaatgggagggaggatattagtggtcagtgtggagtagaattcttacctcaatgctcttgaagttgttctctgtaacttgagaagaaaattccaagaaagtttgttttttttcagagagagggagactggagtctgaacttgtcacaccctgtgctatctgatgaaaatacagaggcaatgactctcaaattttccataatttaacgtcctgtcccaaaccacacaaacaaaatgccacggaaccactacccagagaacaggtgcagaattgtttgctcagtcacaaaggatgatggttttgacccatgcccgtggcaaccaatgacacatgtttgcaagtgtcaccttctctgcaaagtgttttctcatcctatcaattgttttctttttttgttttcatagctgcagcagttatgttaatacagttgacatttattgagttcgtatttgtcagtctttatgccaaaagctttaccactattatatcatttaagtcctacaacaattctgtgaaataggtattatctctattttacaaaatagaaatctgaggcacaggaaagttaaaagtaactcgcccaaggtcacagaaccttacatgatagaatttggtttccaagccatgtaagtgcataaccaaaaagctgtctgccaatgcttgtctccattgtaacacataacaatagctaacagttattaaacacttaccttgtaccaagtaccatgctaacaacataactttagaggtattatctctttagtattcatggtcactctgtgatatacactctagcagcatcctcacttttcaaatgaggaaactgaggcttatagaagcagtataactcattcagagtcacacagtttgagtttaaaatctggcactcaagttcattttcttacctaaaagccagtactgcctattctctttaaatttcatctcactgtttatagttacttgtttagatgccaatttccccactagattgtgagatccttgaaggtaggaactggaccttaatcactgatcataacaggtgcttcataaatgtcttattcatttatttccccagtgtcaaatatagtgtttaacacatataaggtgttctcaatatggaacaagtaaatgaatgaaagaggatatgaatgatggctactgaggttaaaaaaaaataacctatctccatagactggaaatcatgtaattaatcatttagtaggttgaacccatgacctgagctttgcaaaagtcacttcaatccaggtaacttactctcaaaataaaaatgacttggttgtggccagtcttccacaaatattacaggacttcagtcacttttctgtcactgtaatagctcgtattaaaaaaaaatagaaactcaggtattgtataaaatcatctaatacagcaagactcaatcctcaacactgttctttctggtgtgttctttgctgggtttcatcttccctgacctttaacatttctctccacaataatttcacagatgccaccaaaaatgacattaacacaacaactaattcagccttctgagcatcaggctttaagctcccatgaggccatgtactaggcattctaactatatgtggaataaaaccaaataaacaaatatagtttttttccagtgagagagttttttccataataaaataatacaccctgaagcagacaattaaaggagtttatggtttctagccagttggaagatgaagaatgcaaatatgggagttatgtttgggaagaacctgtttgggagcccgaggtaagcccaacatggaatcaagcccctacttgcaaaactcaatggaaacaagttcgtgttcaaacaactgtggtttcttcgagctcaagagacagctgtctggaaaaatgactcaatagagaggtcaaacgtgttgtagatattgccttgagagcatttattcaaatgtgggagtaaattactcaaccttttataagagcaatagatatttacattaaatcaaatgaacaactatgtaagcaaccatccatattccaccactaccaatccatgtaacagcgagcagacttgctcagtttctacttctcggctgacctccacctctcacgttcattctttgagtatcctgggacacacatggtattgttttaaaaggtggcatcctctggcagacatgcttggttgcccagctcttagccttaggtattcttgttcttgcaatcatatccagtgtctttttagaaaacaaagctaacataagagacaactttccataagccaaaggcaacatccaaaaacccaccaagaatgcatgatctaatacaatgattggtaaaccttttcttttcttttctttctttcctttttttttgagacagagtttcactcttgttgcccaggctggagtgcaatggtgcgatcttggctcactgcaacttccgcctccctcgttcaagcgattctcctgtctcagcctcccaagtagttgggattacacgcacgcaccaccacacctgctaatttttgtatttttagtagagatggggtttcaccatgttggccagcctcatcctgaactcctgacctcaggtgatccacccaccttggcctcccaaagtgctgggattacaggtgtgagccaccacacctggttggtaaatcttttctataaagggccagatagcaaataggttcagctttgtgggccatattgtttctgttgcaaccacacaactctgccattgtagtgcaaaagcagtcatagacaatacctaaatgaatgagcatttaggtattcctgtaaaaccttatttgtaaaaataggcagaaggccagactgagtttgcaggctgtggtttgccagcactggtctagagttcccaaaggatgcatccatctactatgaaaaatcctcttatgacttgagccctgtctaactttctgactttatcttgttctactcctaatgtcacctactctggctacctttttgtttacttctaagctttcctcagccctccacttgaggacatttgcgtttcagcttctcttttcccagaatgctatcccctggcccttgttgattactgaatgaatgagatcttgtggcctattgttggcttaaggaaatgttttaaagagttttcaaatgtgtccttaatacaaaaacagttctcttctaattttacagtatactgctctctacaagatggctcattcatgactttcttcagagataaccttttcctatcaaaagcaaaatatgttatccctaaacatgtaactagatgactaatagaaacgatagtaatcattggccacttgccactctgaattcagcaagaagtttaaaaagaacggagatgtgtcttctgattagctttacctaccaaataattcccaacaccacccccgaccccccccaaaaaaaaaaaaaactaaaaaggcctgtttgtctgtttgtcaagtaatgtgctcattagggacttcctttccatgaagaatcaaagcaggtagctctggcccagatacaggtcaaggcctgagcccatatctgctcaaagttcgaattgtgttttgggaaccaggaattgtctgctttattgactaatacaaataaagaagaggggattccaagcttgtgcgaaggattcttttgctttgtaaaatatcatacgtggtggtttttcaactaggagtctgaccatagaaagaactactttactctgcttattcgtaaaccactttagaaaacccataatacagcttacagatacaattcaacacaattggagtagagaggagaggcagcaggggtaggagtatatttgtttggggctatttcctaatgtgggttattactagactttccaaagtttgggatcattttctccacactcccaagtatacaactcttcctcactcatgacaattgcatgcctggctctgggtcacttccctggcctatttcagagcaggaaatctagttaaaatacaatatctggcacttgactaaattttataagaacaaaaaaagtcctctcaaaacctttgactcttccatgaaatttttcccaaatactcgttgtaaaagcccccaatagatagaatggaaacaaaaatgtttcttaaaagggaagaatcatgcagaaggaaatgataatcacaaatccctcaccaatgcttttcttttaattgaactaaaaattattctcacctgagcgtcattctcaagtggttttaaagtctatgctctcagccttctagtgggagcagtgaatctttcttgctcagaaagcagacatctagtcaacaacgtatgtgtgcactttggtcgtttcagctggccacagctaagtcttttgtgttcacgtgacaggggttttgagccacagtggaaaacgctgcctattttggtccagccctaccttcaacagagggagcaaacaaaagtgtctacaaggtaacattaagtgagtgcagggcccaggtgggagttgcattctattacaggcagccacagctagattctgccaagtatgaccacattagaatgtaggcccaacattgccagatcttccaattgaagaaaaaaaaatatcagaaacccagattacccttcaaactttaaaatgttggagcaattttaaaaaggaggaggaggagggaggggggagggggaagaagggggaagtcaacaaagccaaatgtatctacaggccagattgagccaatgggttgtacatctgaggccattgtacgacagtcacagaagtccacacagtgaagccagtgagctgagatgtcctcagagaacatcctcaacaacttccaggcttggagctgggttctcagcatgtccaaagctgcggaggcctaggcttctaagttgctgctctctccttgaccattactaagaaggttctctggtttgctcatttttcaacctttgtggtacacagagtgagagaggagtaaatgaaagtagggctaactatctgacttgtcagcttgttttctattatggttaacaccctgtgggggtgggaaggataaaaacctgattgttatcagtggcgaattcttttcacctctatattgaaatggtagggcttccttgtctaaatttagacttcagctcaaatctcttgcttctttttttttttttttttttttttgtttagaccctggccaaacatgaggttcaaattgatgtatgttttgtttttccattgttattcctggagcactcccagaactagaggcaaaatataaaataaaaatgaagacacaagaatatctattgtttgcataccacacgctttcagttagttagaaaaatgtgtttatttcattacatttcctttaaagagctatgatttaagttaaagacaaatgagttttttaaactgagaacttatgttcaaaatgttttggcacttgtcatgaaactagagtgtgaccaagttctttgtcactaagcctcttcttccaattgctttccactggcagtgccctgtctctgtctcctctctttgttgagaatggaattccctaaagcaaggaccctcaaaaagcagcattttccatgggaggtctcactgtaggggcagcaatccctggaggcatgaaaaagacctggatgcagcacagagtcctttgtgcccatttgacctcactgccctttccccaaccactagaggtccatttgtcatgttttctggggttttttgtttgtttgtttgtttgtttttgttttctgagatggaatcttgctcagttgcccagcctggagtgcagtggcttgatctcagctcactgcaacctctgcctcccaggttcaagcaattctcccacctcagcctcctgagtagctgggattgcaggtgtgcaccaccacacctggctaatttttgtatttttagtagagacagggtttcaccatgttggccaagctggtctcgaactcctgacttcaggtgatcccacctgcctcggcctcccaaagtgctaggtttacaggtgtgagccaccacatccagcctgtcatgctttctgttttgggacagatgcaccctctccagggtacaattatttagcactgcttaaatgttgctcacagtgatgcaatgttgcttttgctatgggttttgcatccccttctagacatgtcttgagtttttaggtatttttttcattattaaaaatatggtaaactatacagtggcaagtggatttccagattttaatctgcatccagaggtagccactgtgatattttggcttatttccttgagacaagtaaacacagacattttttttcctgcttctatgacagcatctgttgtaaaacacaccattgatttaatttgtgttcttcaaacttaatgaggctggttccttcttgtcattttatattaacttaaatgtcaccacctcacataaacctccctgatcaccttttctaaagtaatcatcatctccgcccccatctgttgaactttgtcacatccccctggtctgttttattctgaggaattaatactatctgagattgttttgtgtctccacttgtttatgtttagatattaaactatccccactagaacataatcttgggagcaagaagctgtctgtcttgttcatcgctgtgtcttcagggcccttcagaacagcgttgcctctgttttcttctgaaagcctgctcaaacgataatacattttgaaaggctatcaacttgcaagggtgagaagaaggggagagaagaaaagtgtggtggagattgaaagttcgtgctagaaaacgtaaatttagtgcggatatgttcctgtttggaatctatctttccagccctacagggtcttggtaaatctgtctccccacagtctactccctaactctgatttagtaaccttttatttggatggtgccgatcctgactttggtccaaggatcatgagctcaaatctgttttcctgccagtaaagagataataaaagcttcagtttcttcctttaaccccatctattcagagataacagctttaacatttcaacaaacttctaatcttgtttccatgctttttattttttacataattaagattgcactaatctaaatagacactgaagttgctgacaagcaaataaaatagacttcatgccgtagttgcctggcaattgcctgtttgacctaccaaagagcacacttaatagaaaagtcaataatgttaaaagaaatacagaggccaaatgaaaaactggtagagaaaagtttctattcatttatagttttaatattttatatactttgtgtcttattacaaatgacactcacgtgattagaaacaggttacttcccagtagctcatctcctgctgttatacatttttcatctgaatgtattacttctcagctgcaacacacaagttagcaactgtggaaattattataatatggaaattattataatgtcattgaagactgtggctttagaggggaaataaccagcaggcataaaaccttcagccatgaagttgtggtgttcctgtaagtctcattaagaagaaaaggaggggggtagggcaacggtagactatataaaatgaacccataatttgaactggcttaagccttcttttattgaacacctttgaaactgcagactggacacctgtagggaaacagaattaggaggctcaaactatcacgcagttttgaaataaattagggatagttcagggaaatgggtccaaaagccagatgaatttctgacaacaaaactctaccaaattaaaataacatttcttttatagctttgagtctggtaattgaagatgaaataagtcacctttaaatggttatgatattgctcagtgaagagaaaaatgttaattgatatatttttagagaatggcttgggtttgaagcaatctcatgcattctcaattttctgttaataatggggcatcctgaagtgtctcagctttccacactcataatgagtggtgaggtgtcttctgcttctgggagtgatagaataagaccctacgagatgactttcccatggaaaacaaatttaatcctagacataatacaaaaagttgtaaataatggagagtacgccgagaaagcaggcttggtaaagagtagacactttggaaagggtggaagggaggctatacatgttaggttaccgtcttcacagcttacagcttgagggtaagtgcaggtggtacagtgtactcaacgcagtgggtgtgcttgtgaaacaaaacagtcttttcaagacacactgaaaagtgtgatgaaatcaccagacagaaagatctagagagagtatccccaaattctgtctacctatatctctgacaaactatgcatgcagggtacagactcaaagcagctaactttcagtctttaaatataaagacaaatatgggctgaaagacaaaggagctcaactgagattgtagctgccactcaagaaacagtttggagcttaagttcctacaataattagcagcttaaatgaaagaaacaacacttatcaaagggaggtaaaaacatccagaatttccactacttaatattcactccatataaattaatgtttagaatataatccaaaatttcccaacatacaaagaaccaagaaagtggggcatgttctcaagagataataaaatccactgggtctgaccccagaatgaaccagattttgaaactaaaagattttaacatagcaattatgctaccctaaataatgtatatgatgagtgaaaagacatgaaatctccttggagaaacagaaacaagaaagaatcaagtgaaaagtctagaactgaaaaacacaatatttgaaataagaaattcaccagagggtcttaagagttgaatggagatgtgaaagaaaagagcaagtcaaattgaagataaatcaatagaaattatccaacatgaataacagggacagagagagaaaaaaaaagaatgacttaaaaaatgaagcctcagagatccattaggtaatttcaaatagtccatatgcatgcaaataaaatcctaaaagagaagggagagaatggagcagagaaagtacttgaagaattaatgaccaataaataacaaatttgatgaaagactaaaatgtacaggtacattatgataaatgaaaaccaagcagaataaacataaagaagccctcaccacagatcatcatactcacattgttgaaatccaaagataaaaagcaaatcttgaaagcaggaagagaaaaatgacaatcctatacaatcctatacaaaatgacaagccctatacaaggaaacagtgatctgattaatggtcagtttctaagcagaaactatgaaggctgaaagagaatggagtaatagttccaaagtactgagagacaataaaaaaattgtcaaaccagaatttattacccagcaaatatatcccgcaaaatgaagactaaataatgacatttttgcatggaacaaaactaaagtgagttttcaccagcagacctgaactacaagatatgctgaaggaatttatccttctgaaaggaaatgataccagatggaaacttagatcctcagaaaatattaaagagcactgaaagtaggaaatatctggaaaaacgcaaaagactacttttaaattattttctttttctcttaatttatttacaaaccatataaatgtttaaagtgaaaattataatgttgtcttaggtttataaggtattcagatgtgatacaaataaccactgtagcataaagaaggaagagtggatatggacctacatgggtacaagtctcctatgagttacatgagtggtaaaatactaactggatatagacagtagagaattaaggatgtatattgtaatccctgggctgccacacacaaaagtaataacacaaataaatgcagcttcaaagccaataaaaatatctttctaaaaattatttaagaattcaaaagtataggaaggaaagaaaaaggaatagaaaacaagagagaagtagaaaataaaataaaatcattgattcaaccaaccataacaagaattacattaaacattaaaggactgaacaattaaaaggcagagattttcaaaatggataagtgcaacatgacaacatgctgcctgtaagagatatgctttaaatataaagacagatatgggctgaaagtaaatggatgaaagaagatgttgtactcaaactgtacacataagaaagttggagtggctgtgttattattttaatgtgtaaattttaactcaaagaatgactacaagacatcactcaagaatggcatagatttctcatgttttcctaaggttaggaaatgtttccctatcttggatttttccacccctattctattatctttaacattttacatttttttagcattatgtggtatactgtgccctttcacagaccttataataaaggtaaagcagaaattacccccattttagaaatgagaaaactatgcagagaccaatgaattaattattcccagagaaacattaggtcaaagaatctcatttgaaacccagtctgtggatatatactgccttccactttattatgctacgtctttcctcttctgcaatgaaattttcctattgataactgtatttctcaggaaggcctagttactgggagaaaattgattgtaggtagaatgacattagagacagagtctatacctacaagccatatgcttaggtggaagaatgttagagacccctaatctcatcgattatgctgaattttttattctctcaagaaaattcacaatatttaattaaggaaaagaggaaataatctataagcagggcctctctcaggaaggaggtaaagctatcaaggacctatcccaggaaagctgctttggcccacacattcaataccatctaatacccatctgtttggggtggactttgaggaattttaaaagaattttactgtaaattatcttgtatttacacaaagaataaatttgtttcttctatttcattctttgttacttcaagctggaatacacagaagaattgggggatattctatgcagcaatttggcttaacatgctgagcactcaaatattaaaagagaaatggataacagtagatatcacatctgagctggccactcactctgtttacatgactcaatgctatttggttaggcagatggaggaagatggttgcagaggggatgagtttattgtaatttcaataaattaaagtttgaatgttttcatatttttccacaactctttttttatttttattttattattattatactttaagatttagggtacatgtgcacaatgtgcaggttagttacatatgtatacatgtgccatgctggtgtgctgcagccattaacttgtcatttagcattaggtatatctcctaaagctatccctccccgctccccctaccccacaaccgtccccagagtgtgatgttccccttcctgtgtccatgtgttctcattgttcaattcccacctatgagtgagaatatgcagtgtttgcttttttgttcttgggatagtttactgagaatgatgatttccaatttcatccatgtcctacaaaggacatgaactcatcattttttatggctgcatagtattccatggtgtatatgtgccacattttcttaatccagtctatcattgttggacatttgggttggttccaagtctttggtattgtgaatagtgctgcaataaacatacgtgtgcatgtgtctatagcagcatgatttatagtcctttgggtatatacccagtaatgggatggctgggtcaaatggtatttc

SEQ ID NO: 2265 - DNA, 1780 bp, Homo sapiens
cagctcagagggttgctctaggaaatatctacacgttcttgaagcacaggtttatgtgccaggcactgtactaagtgctggggacacggcgttaagaccaggccctcacggagccctcactctctgaggaggaacaataagtcagagagcgcgcgagtgcagcccttcaggcaaaggatttcaggcccaggtcaggaaggccttgtctgaggagtctgagaagaagtcaattgacaacagctagaacatctaggtcaggcactccaggccgacacgacaaagcaggtgcaaaggccccagggcgggaaccagcgtggcttgttcacagaacaaggaggtagatcgcttgcccttgggaccaaaggaaggctctggattttattctaggggcagtggaagccgttggagggcctcaggcaggaacacaaggtgtcgtggcagaaaggaagaaggggccgggcacggtggcccacacccgtcatcccagcactttgggagggaggccaaggcaggaggatcgcttcaatccaggagttcaagatcagcctgggcaacacagcaagaccccgtctctactaaaaccctaaaacttagccaggcttggtggcatgtgcctaaggtcccaggtcctcgggagactaaggcaggaggattgcttaagcccaagagtttgaggctgcagtgaactattatcacaccactgcactcagcctgggtgacagagtgactctgtctcaaaactaaataaataaacaataattgtgttattctgtctccatttctcgcatactgaatttaaggtggactcagccagcgggttcaggcccagggtctgtcctgcagctacagtcagggttggtggctgcagctgtcatgggggagcggtgaggttgggggaacaggggggctggcctgcatcccccactttcaggtgggctcaactccgtctcgtggcctattgggggccagcatgggcttccttacagcatggaggcctccagggtcaagctgcctctgggatggcagagggctttgtgttcgtgctcccacgcccacagtggaggcaatacaccctttccagatctagcagtacaggtgcgcagcaccacacctctgtacgctctcagcctaagctgtccccagccctcctggcctctggaggaggggacgcagaaactccatcccggacagagggagagccagtgtgtgcacaggcagcttctaacactgcttcgtggtttcacacggctccctcatggagaaggggctggaggaggacagggaggtgtgcagtcatctgggtgacatatgagggtggctgggcttccagatggctgcagtggagaccgtaagaagagtgcacgaggtaaggcttccgaaacgcccagcaggttcctggcagctgcagacaactcaattcttagcacttgccaatagctggggtgtaaacactcccgccgtcgctatttcgggctatgctccttgcctccactgggtctggctcttaaaacagcaagaaagcaactcggaagctgagtcagccccgtctctccaccgtgcccacagatccttccctgttccagagctcccgttggcagccagctgggcttctcagggggcatctccagtcctgtgcagtcagagaaaaccagggaagcatcttgatctcacctagaaattaaggccatcacatccaacacctgcattttacagaaaaccactgatgatgtgcaggagaatcacagctgggaagaaacacaggaggaccttttccttcatc

SEQ ID NO: 2266 - DNA, 2257 bp, Homo sapiens
cacaaagccaaagccttaggcaggctgcactgttgacaatctttgaatgtctcttcatttcatctttctcaaggtgtgcgcagagcagagcacagagggccacccggggagcggcaatgtctctgaagccccaggcagcggtcgcaagaagcccgagaggccggcagccatctcctacgaccactcggaagaggggctgatggcgagcatcgagcgggagtactgccgctgaggacagcatgctccacccccgccaggcctcggaggcacctgctggctggggcaccctctgcttgcacagagctctagcaggagctgaaccacctccaaaacgcagtcactcccggatattcaaagctgccctttcaaatccactttcagaccgcgctgacctgggccagccactggcggtcatggttgctggtgggggcgattagctgtgtagacccacaggtgcgtgggcctgggccgccggcgcctcctccccaacgcggggagcctgcccagttcttctggagcctgaaatgcgtgcccctcttggttgcccgctctccacagtggggagggctcacgaggactaggtgacacaagcgagcccctcctggcatccgcgccacaacacttccggaaggttctgctgtggaaggtgcacccgcgctgctccctcagtctcgggcccatctctccaggggtggccgggtcagcttagtgcttctcaactttaactccctaatgagcagcctgggggtgctgttgacttgcagggcctgaggttctgtacgtctaaccagctcccagcccaggcccgagctccgaagccccaactgcactttgaggagcgagaaccccagctctgatctgccttgcagtgggaggtagagctcgtcactgcctctctgggcctcagtttccctctctggaaaatcagctctggcagctcttggaggccctccccagctctgacaatctggaactgctgccactgctggtcccctgccccaggcacagcagtgccttccctgcggggagccagcgcccaggtccaaccgggagagggtctgcctgatactggctttccagttctccctctcacaggcagcctggccagtgcctgcggggcttttaaattctcttcctgcctgggtggaaggtgggaaaccacagcagtgaggcaggaagagccttggaatgttcctggttgacagatgggaaaactgacctgcccaggacgccctgggaacagggggcggagctccggctagaggggactcctgtgtgggcgggcaggtctggagcctgggcccaggtgtggcctgctgggggacagctccgggggagagctgtggggagaacagcggtctagggaggcaggaggcaggcggcaggctcctccccagcagcctgcagggcatcaggacagagggggaaggaggagacagaagggaaagaaggagatagagggggaaggaggaaacagcgcggcttctgctgaagccagtacaagcctggttatctggcttgacccgcccacacggaggcctccccagcgttttctttttcccgagaagagctccagctcgcaggtccttagaacacagcagagcaggagcatctcaggaaccaacggccagctccttggcgctgtccccagccccacaggcctgctgcggccatccgcaaacgggcatttccttgaacttttgagagtgcctttgaccagctgttcgcagctgggaaactccaacttttgaagtcagagcttggagcggcccccgcaagggcgtggctcaaaccctccccagagctgggagccattgcttatgcaagcccgtttcttttgatgtaaagatggaagtcgttactatattttaataatgcaaatacatcttttaaaataagttaacatttcttaccaccagatggatcaggctttgaatttaaacatgtaaatgtttgtaattttatgtcattttgttaaaatgggacgctttcaattggtttccaagaaagatgatacctctgcattttctggtggaaaaggtgtaatacccttaatgagatcaaagtgttaggggaaaaaaattccaaaagtagttacaagctatatcaatgtcaaagtaaatgcacttcatcaaagctaagaagtcacaggaattgttctcaggtttttaaaaaaatttttcctgaattcaggaagtgtcttctgaatagcagctagccaaataaagcggtgtgtgtgtactgcagctgtaggtga

SEQ ID NO: 2267 - DNA, 5122 bp, Homo sapiens
atttgtaccagggacggagggagagaggagagggaggaggggacacacacacacacacacacacacacacacacacacacacacacagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggctgtggggaggaaccataaacccagccctcacagctcccagcacagggcctccctgagccagtggcatcctgcctgggccccccatggcagtgctgcctcttgtaggtgctggctaagggccaggccaggatgagtttccccatggtgaatgttaccggatggcatctgttctctccatgccctgggtcacttccttttttgggtctcacagacccctccaggggctgacacctagagagaaccatcaccttgtccctcattccttccaccctgaggcttgctgtggactcagagaggagacttacctgatgagagctcaaacctctagtctgggatgagctcacagagccctcatgagttaagatccatccatatcacataggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttcgagtgctttttggcccaagaatctcagagtgcttctaatcatcacagtagtttttgtgttttgttttgttttgttttgttttgttttgttttgttttgtttttttcacaatctcagccagcctgcggtgtgacctggggagaaagttgagtgtcaggggacatgatgagccagttggccctgaaacaggaatggggcaaagagaaaggagagccaggagcatttaaaaatcagcatctgggccaggcaagatggctcacgcctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaacatcagcatctgccccagttgtggccaagacactctgacctcagggctcagcaccttcaccatcaagttcagcctgagccaagctcccagcccactgctgaaaagcccctgggcctccctccacaggcagagttacaaccgggagggctgggcagggagggcagggagattgcctggggaaggcaaagggaatggctgcccctcccaggctggaaacaagagggcaagcggggtcagcaggagaattcgggggcagggtgagtgttaagaaaaaaagagtagagaagagcctgaaaatcagcaacttccagggcttttctgatctggaggcccaagagcaagggtggaggggggcagattgtcaggtcccgaaatgtgtgttgacacacacgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagaagtgttttctaggcctggggctgaaaggaagaggggtggggcagcctgggacgggaactgcctctgtgggctccccactcccagggaggggctccataagctttgctcctgggctggatcttgagaggtgggcagggtcttcccaccagtggcagggtgtgcagttgtggtcccaagccttggagggaatggggaatgggctggcacccggctcagggaaagcagaagcagacagtgccccagcaggggagctgcatgcccccaggagtctcagaaaggcagcccatcactaaggctggatgcctttcagcagagctacagctggagccctccggctgaggccagcactcgcctgggactccctggaccccagggttactaacagcaaaaccattccacacccccttgccagatctaagcctgtcttaggaccgtcagtgcccccaggttagagctcatgggggtcaactaagcgagggagggaaggcgaaggcaaagctggccttgcacctggacagcggcctggctcctccccacacctgccttcatttatgactctgaaacatcccccacctgaccaagggagccactctccagttctctcactccaccagggccctccgtgagccaggaccaggtcacatctctcagccaagtctagaagctctggctagaggagaggaagcgtgcagagggtcctctgccaaagctccctgcctggcccgagcccgggcatgctgggattagtgcaacaccgccccagtgtgcctcctctgccttctatcatgccagtttaaaagcaagaagactcccccttcacatcctgaggaaatccccttcctggtgaccaactgatgcaatgaaagtttgaaaagttcttcattttctagaagttcttgaataaacatggacttactaaatgcagagtctgatgatggacagagtttcaaggggtcactttcaaaacatttaattaatttatttatgtagagacagggtctcgctctgtcgcccaggctggagtgcagtggtacaacctcagctcactgcaacctctgccacctcccaggttcaagcgattctcatgcttcagcctcctgagtagctgggattacaggcatgagccaccacgcccagccattttcaaaacactgctcctgcatacaaaccactcagaggccactgcccttggttctgtgatggctctgagcccatgccatcacatctgatggaccccagagagctgagccgtggtttaagatggggtcatgcgctggtcattcccacagtcttgagtatctccaaaatcccaaagtgatatttcactttcggaccctgaaagtttggagagctggtttcttgccttaatttaagctctctgagaatgtcccctgtagggagaagcctccaggaactcagaatagaactcgttcccactcattttccttgctccaccaatctgacgcctgacagatgtcaccactgcctgaaggatcctgtccccaggccagggcagaatgggcattgcctttgactctccccttcagactcccctcccaccggcctcctgtgtagtcagagaacccactgcccatcgcctcctgctgctgctttgaggttgaggtcctggcttgagcagttaccttgctggagaagaggagcccctgccatctggggagcactgtccctgctcgtgatctgtaacagtggggcgctttttcacaccccttatctcacggcttgcttccagcccccatcaatcctgtgcctcatgtgaggtgagccccagagaaacttaaattgcttgtactgaagttgccaaaaaccaaaagttgcccgttgtcatttttaagactgtgccctgaacacacctctgcccatgcgccatggagcatgtgttaggtgcctgccgtgggtcaggcacttgattctcaaaacactgccgagaagctcttaccaacgtgacagttgaggctgagagaggttcatgagcttgctcaaggccacgggtagtaataagaggcatggccttggtgccaagtgcctcccaaacaaacagccggggccgtggtcctgcctaaactctcacatccacggcaccacgctgggcccaggcaacagagataaggagagccctggctcttgggatggggtcgcgccgattcacatgctgtgccacggagccccggcttccatccatgatgtgcccctgtggcgggataattgggaaacaacctttttctgattcccagagaactaatgagctgcaaaaagagattagacagggaagaattgctttcggggagaagccacttactcggctcgccttggtttttgctaacaacgtctccttaaactgctgtcaaatctttttctccctgtgtaggattcatcaatcttcgtatgcaaaagaacaccactgcactgcactgctaaaaattcacacaataaaatggactttaacttgcag

SEQ ID NO: 2268 - DNA, 2220 bp, Homo sapiens
ttttcccagtttcagaaagttaaactaatttattatctcaaattggatttcttgggagaatttaagatttaggaggaaaaatgccagttgtcagaggaagaattgtaaagttcttttcctaaaacatgcatcatttacaaaatggatttgcatattctcagtattgttgggacagtaacatttggaaacagtcatttccacagaagagctttgagcctgatatccagtggggggtcatttctgactctgaaaatgagtatagctcaggaggcccaggtgctggggagtgacgccatcagctccactgcaggcctgcttgttatttccagccgcatatcacacctgtgaaagggaaagattcttcccactgtttgtccttctgatagccttctctctggactttgcatttccattccttttcattgacaaactgactttttttatttctttttttccatctctgggccagcttgggatcctaggccgccctgggaagacatttgtgttttacacacataaggatctgtgtttggggtttcttcttcctcccctgacattggcattgcttagtggttgtgtggggagggagaccacgtgggctcagtgcttgcttgcacttatctgcctaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggctcccttctcaaagcagagccctgaagacttcaatgatgtcaatgaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtaaagtgaaatactgatagctggattttgtcaaatgctgagtgc

SEQ ID NO: 2269 - DNA, 17874 bp, Homo sapiens
cttgtggaatgggtagcagccattgattggttaggtgtattaatgctggcctgttaaatgacatgcagacgtgtctttgtgctaaatggcagctgaatgggtgccagcgagagaggttattaagcacagataagaggcagcacctctattcactggcaatgtcactttctcccatttgaggagagacatttgttcaagacactttttttctcctctcactgacaatacgtaaggcagaaagttggtgtctacgttgctgcatggctgcagaatagattgtttcgagaaggtgaactctggaaaggcatagccaattcatggtgaatggaagacctgtgtgtcacttctgggctgcaatatttaattacaagtctgaactgtccagaacgatcttcctccttccaaagagatcttggaagcacatgttgcaatagagcttgtgagcttctagttcactgaatgactcattgaatagagttctttcgacaaccagaaaatgggcataagggaaaataaactttttttttctgttaaacatatgagatttgggagctttttataccacagcattacctgacctatctaagtgatagagtgagagtcaataagaatcaatattcataaatcagactcgcctataattttcatttgtcaaactatccttttctagtgtcagataacgttgcactgttttcatagaataatatacattttcatatctttggatgaattttatgatcttggaatgatgtactccttttacatctgctaaatctcaagtgtaaatttttttttttttagtttgtgggaagattttagcaaatgttcatgttgaaggctttttctaactttcctaagttctttgaagagataatgctagtatttcatataaagaagatatgtagaaaagcgatttgagaatggagataaaaagaatcaaatgtttactcatgctgagaaatggcagatccttgggctgcagaaagagaggatgggatttgttcgttgttctctgaccttaccttaggaaatttgtaagacctcacacaaatattaggttggcacgaaagtaattgcagtttttaccattacttttaatggcaaaagccacaattacttttgtgccaacctaatatttggcatctatggggtttaccactgaagcatgacatcttctaaaagattatcattctcaaagcaaagaaaaagaaaaccagatgcataggatctgaaacagtcatgctggcttgtaccttgtgtattccagtggcaatcaatgtgcgcccacactgaaggatcagggggatttcctaaagcaaattgttctaattctctgtaggattctagaaacttgacataatttagaaaaactttttgattacaatagaaatataattttccataatttctgtgggtttactatcagatacaaataaagattgatttaaataaataaaaaatgtgatatttgcacacattaatttctaattgacatacttacatttagatttttattttaacagaaataatgtaaacaaactcctgggaattgctcttcaactttgttcttgaataaatacataagtcaaattcttagaagagaggcagacatatcaggcttcacactgcttagtggcttgtagcatctcttgatatcaatatagaaataatacaaaagcctttgaaatttttagtattcaacaatgaaaagcctgagttctccaggaaaaaaaaagaatctgtcccagagcagttgttgaagaggccagatgagggagcctgtacagagagtcatttcccattgagggaaactttgatgaaatggagggaggagatgagaagcaaatggaggataaattctctcttagaacgccccctgggtgaactgtgtggagatgcaggagttcatacagcttttctcatgatgtctagcaagaccgaaaaatcagatgtgcttcttaagaagtacataactaaaatggaaataaaagtggagtggttgttaagtcaattctctcatgacaatttacgcaacttcctctattttctattttcttacatccatatgatctgctttctctcatggctctcattttagaaacacctcttggcagtgtgcaatgacatttttgcttgttttgaaacaaccaaaaactcaggttgcttaactccctatctcatctagttccttaaattattcagtcttgtagaacttggcaaaggaaaaatgagaaaatggtcctgctcagtagaaatctgttgatttctatccactgaaatccattagtctttgaagttaactctttcttaatgtgtccttatgttacagtaagtatggtgattccatttatggatagatacacattattttgtttccagaaatattttagaaaaataatgtacacttcaatctatattggcaaccaataatccatggtattttgtcgtccgctttcagagaccttgcaatatttgagatttgttttctactaaatttaatttcttactaatatagaccttctgtgttagactcctatctgatttcatatatgagtttgaaacattatcacatgactgaatcaactttgtgagcaaattattccaaaaaaacaaatatttactcatattaatcaccttctcaaaaaattttgatagtttcatatcagagaaaaatttcctataaaccaaagtaaactcagtgtccaagaccccctaacatcaggttccaactaatctttcaagacttacttcatcaaactccattagaaaaacagtctggtcttacagctttttcaaaaactagcaatttagtttaattaattcccatttatgaattttttgttgcttatattttaaggtcttggtcatgattattattattattattttttgcctagacaaatgtcccaaagagtttttctaggctttcttctagtattttagtcattttaggtcctgcatgtgtttaatccatcttgagtgaatttttgtatggtaagaaataggggatcagtttgatgtttctgcatatagcaagcaatccaatttttccgaacaccatttattgaaaagggtgtcccttccccagtgtatgagtttgtcaactttgtcaaagatcagttggcttctgtacagcaaaagaaataaccaatagtgaacagacaacctgcagcataggagaaaatatttgcaaattatgcatcctacatggattaatatttagaatttacaaggaattcacacaaagcaataaataaataaataattccattaaaaatagtcaaaggacaggaatacacatttttcagcagaagacgtacaaatgaccaagagacatatgaaaaaaaacttagtgtaacaaatcatcagacaaatgcaaattaaaagcacaatgagataccgtattataccagtcagaatagttatcacaaaaaagacagaaaataacaaatgttgatgaggatgcacagaaaagggaacatttatacactcttactgagactgtaaactagtaccacttctatggaaaataatatagaggatcctcagagaactaaaactagaactaccatttgatccagcaatcccattactgagtatctacccaaaggaaaataaatcatgatagcaaaagataccctcacttgtatgtttatggcagcactattcacaaaagaaaagatatggaatcaacctaactgtccattagcagaagatcagatgaagaaaatgtagtataggtacactatggaatactactcagatattaaaaaaatgaaatcatgtcttttgcagcaacatgagtgggactggacgtcattattttatgcgaaacaactcagaaatgggcaaataccacatgctctcacttataagttggagccaaataatgtgtacacgtaggcatagaatgtgaaatgatagataattgaaacttggaagggcggcgaggatgggagaggatgagtgatgagaaattacctaatgggtacaatgtacagtatttgagtggtgtatgcactaaaagccataacttcaccactatgcaatatattcatgttacaaaattatacttgcaccccttaaatttatacaaatgaaaaacaagaaaccctagacattttagataaacattttgtgacatttaaatacagtgaattgaagctctcttatctttttcataatatacctctttctttaaaattttactaaaagctaaactagtgttaactttcctttttaattccactcatgccaaaatatttttaaactatttaaacatgaaggaatctttacagtattattcataattataagtaactcttaaataaattatttaccagccctaaaccagagccaataggaaatgagattgtggaagaaacttaaatgaccagaaaagatagacaaaatatactgagagtaaaaaggagcaggttatcaataagtatatactgtataattctatatttgcataaagtaaattcacaaaggttatcatctgcaatttatattttcatgtaatgagaaaaatgttaatagaaacctccctaaaagaaaataattttatgtcatactaagagagaaacattataataattattagttttttggggaggggtagagggatgctgtggtccatgcctgtctctaagacattcattcattaatctgctctttgcctagttctgaatgaaaggcagaaaatatggtgatgcactatgcagatatatgtcggcctgttaataaaaactgagcaataaataattatcttttttcctaaaaataactttaatttttcatgcatgtttaataatgtttgtttctagaagtaacatgtaataaaaagatatatttaatatctttaaatggacaggcatgaaaatatcatctgttctatccttcactttccaagctagactcaatgaaaaatgttagatgaaaaataaacactcagaaatatttccatgtcaatatttttggcaaaaatattaggtcattttgcatgaatacttactggaaatatacataattctgtgggaaaaaatgatgatttttgtgtttatggttcatacctcaagaacatagttattcaattaagcttgcctactcaaacaatataacaggtttactagacattttttaataagtaaaagtatttgatgtctttattatctgctccagatatgaagatcaaatccacactcaacaacacacaatttgagctcagagtctttattgtaattggaaaatacatggcctgcttgccaaaaactaaggagtctctgactatgtgatgtaatttaatgagtgtttaatcccagattttactactgaagagcatcaaatcccttcattagtataaatttattgtgagctgcagtcttagttttcttatttttattttcccagttcttgcatactacttgtcatgtagcacttagcctatacagatttgttgatagacttctccttaagtgtttttaatgtgcacatgcatttcaactagatttggtcattattggctagatgattaatacttgcacactaatataccctccctagccaagggtactaaaaaaaaaaaagggtagctaattgttcatgaaaattagaagatacacagaaaggaaatttctaggaggttgtatgttggcgggcagggagtaaaactaagcaaagcagaaaagactgagaacaaaatgagcagctttgatgaagcaggaagataccgagtttctgagttgaagaaggggagtaaaatgaaaattagaattatgctatggactaaattgtgtctgcccaaaattcatgtgctgaatcccaatcccccattatgaccctatttaaatatagggcttttacagaagtaatctaagttaaatgaagtcataagctagggccctgattctgtagggtgagtgtcctcataagaaaagataacagaaagtgtggctcgctttctctgccatgtgaggacacagcaagaaggcagccatctgcaactctgaaagtggactctcactagaattcaactatgctgtcatcttggtctcaaatttccagcctacagaactgtgagaaaataaatttctgttgtttaagtcaccctgttatggcattttgtatggcagccttagctaagataaagtgtgaaagaaagtaaaagttatttaaagttaaatataccagattaaaaacatatatttgcctcaaattcctttcaataaaatggatgcattttcaaaagaaaaaaaaaagagagagaaaatgttacaactagatgcaggcaagcacaagtgctggctacatacgaaaggtgacaccccagggaacaatgacagaaaccagcaagacattgaaagagctgtgagaatcctggaggaggctgttttgaaaaggtgtgtgtacaagggaggagggatgtgaggggggcagaaagcagccctgccttgtggtgaaagaataaaaataggaaagaacttgttggaatttttgttcctgcctcctcccactctgcatgggaccgacaacgccagcctccacaccagcagtgacacacatttctggtgcaggttttctctagagtaaaatcacagcaacacaaaaaccatgggtagatgaggacttgagaaaaacaggttttttttttttttctttgagacaaaatctcattctgttggctggagtgcagtggcatgatcttggctcactgcaacccccgcctcctgggttcaagcagttctcgtgcctcagcctcccgagtagctaggattacaggcactcaccaccacgtccagctaatttttgtatttttagtagacggggtttcaccacgttggccaggctggtctcaaaccctgacctcaggtgatccactagcctcggcttcccaaagtgctgggatttatttacaggcgtgagccatagcactcggcagagaaaagcaggttttgaaggtttaatgtgccttggacaggtgtttccccaactcttctctatactcctctaagcctggagaacaagaggacaaagttctccctctcacttttgtatctctttttgcttagctagggatggcttcctgagctgaggagctaagacaggattaactatgattttttgctgttgttgctttctatgtttcagtgtactcattctacatcttattattcagggtacaactaggaaaggagaaagcatgttacggcaccaggaaattattataggagtgataccttgaactattttggaaagatctgggaaaagaaattaaggtctccaaggaggaactggagaatcaatgagtgactggcctggtcaccctgagcagcaaaacactgaagtgggactacaaaaaaggaagttggcacagggatatatggaaactgttgactccgaggctcctcagccacatgtttagtgatgggcccagagctgttgttgctcagcaagaccagcattttggaagaagatgtgagcacaaagctgagaagatctggggagagcaaaggcacactggaacccctggttggttacatcatggccgtctctcattgcttctcactataatggcctccagagagtgatagttgctcttttgcttctgtaaattcctcttttgaaatattctaacctagaaccataaagaccagggaggttgtggaatgtcaatttgatctaaacaaactgatgaagcacaaaccactctgctacattttgagctcattggaactgaacttgcttagggcctggtattgccctttgtgtattttctgacagagaagtagacaatcacataacaacaagtgtggggaacagtctcataaaatagctaggcattgtggcattatttcaaatgagagacaatatactgtatgactgatttgctcataggtagaattatttcattgaaggagtcaaaagtttcaaaacaagcctaataataatacaaaaagggataagaaagatacagaataaaaagaaaagtataaacataagcgaaatattaaactaaaaaatacaattgttgaatcgaagaacatgtttgttggaataaagtgtggaaaggatgtatctgaaggataaatgtgtgtattaggaggtaaatggaaatgaagccatgtaaacagcatgtttgttgcatcagcactataatatgttctaatataatggggaaagtgtagagaaatgtgtatctcagacttcatatttctttttttaattgtacattattaagggatacagagtgaaatttcattatctctatacaatgtatgatgatcaaatcagggtaattaacatatccatcacatcaaacatttctcatttctttgtgttgtgaacatttgaaatattctcttttagctttttgaaaatatacaataaattatagttaaccatattcaccctacagtgctgcagatcaccagaactcattcctcttgtattccctacactcattactctactgcttaccatcttcccctcccctacaattcccagcctttaagagccacaactctactctccacttccatgggctcaagttttttgtgtttttgtgtgtgtgtgtgtgtgtgtgtgtgtgtttaatattagctctcatatatgagtgagacattcagtatttattttttgtgcctgaactattttgcttaatatgatgtcatccagtttcacctatgttattgcaaatgacagaatttcattctttttaatgactgaatagtattccattgtgtttgcataccacaacttctagccattcacctgttgatggacgtttaggttaatgccatatcttaactattgtgaacagtgctccaataaactttggataaatatccagtagtgggattgctggatcatgtggtagttctatttttagtttattcagaaacctccacactatttttcataatggctgtactaaaaaacattcccaccaacagtatataagggctccatttttttcacatccttttcagcatctgtttttgtcttttttatgatagccattctaattggggtgacataatattttataatggttttaatttgcatttccctgatgattagtgctgttgagaattttttgtatatttattggccagttatatgtcttattttgaggaatctttattcagatctttttcctattttaacggtattattattatttgctcttgagttgttattagtcccttgttggatgaatagtttgcaagtattttcccctattctccatgttgtctcttaactctgttgattctttcactgtgcagaagcttttagtgtaatatagtcctatttgtctgttttgtttgtagtctgtcactttggagtaagatttcatatttcgtctatctcaccattacctgtgttttcacaaattattagcaaatgtgatttgtgagtctgatttagcaatcatgcagtttatatcttacaatcctttaattattcttttatttaaaaaatacacctatataggtaaacacatatgtaatataaataacacgcaaatttgtatcacgtttacatatagatatgtagtactttgatgaaccctatgcatctatcaacgacagtcaggtgctttacacatgcaacttgaaagccttgagatattactagatgagaaaagcaaattataaacccatatatttagtacataccaaattttaagaataagatatatacggatatacttaggcaggtaagtgttcctatatatttctgcactaaaaaattatggaagtggaaatattttattataatgtctagttatccatgtgtcatgggtttgggagaaataaacttttcattttaaatactttaatattatttggatttttatatctatttttatagctaaggatagttgatgtacaaacaacaaagaagaacaaaaaatatataaacctctggatttaagaatcagaagaactgggttcaggctttagctctgtgtctctcagaaacaggagtgaatttaggtgagttgctgcttctatttgaatattcattataattttttccttaaactttttgttgagggttaacatatatatgaaagtgccttgcccactgctgtgcaaataacatgttaatattccagaaatcctcatttctttaacagataagaggaggaggaggaataattcctttcttttgggtatttttgcttaaagtccttgtgggagtcagtagcattccatgaaacagattttaagtaaaagcaaattagtacagtgctaaagctataactttacttgccacccactatcaaatgttatttgtggaataccattgtataaagattagcaagggaaaatacagataggcagagcaattgattttacatacttctcaaaaatgaaaactacaggtggatctcaagctggcctaacatcatccaagatttatcttacttttgggtggatttgacttggtaaggtgcattgcctgactacagagactattccctattcttccctctctgtcagcagactatttgctagcatgtcaatcatcagttttgtcattgaacgtggtctctaccagtggtaattaggaaagtaaattcaacagtgaaaatcagcaagcaaaactcatcaatcagcagctcttaaaaagagagatcacaatcatagcagcaaaagctgggagatcatgtccctcagggcattaggagttttatataaaaatgtacgtgatgactttgcaatagggacacccactgtgcaaagcccaatgtgtggctctcattttcaattcagatatcgtcagtctgaagtcttataatatgatcacagttacaacagaaagatattcaaatcataatgactgatgagcaacaaaaccaatttattactagatctgtctccccacacactctgaagaattcctggggatgtttacatttgctcatgaaaccatttgtattgctatgctaaaaaagcagaaactcagacatcagcacttgcaaccaatgttgtaaatgctgccctctggaagcccactggtgaggctgtgtccataccacccttggtaccattagtaatatggaggtaagctttaatcttgaaccaaaatgaaaaaagtgctgtgatagcaactccagcagtctccttttgtttagtacttccacaaacagcaatgcagtttctgctaatgcacccaagcctgggtgactctacttcaccaaagagctggtaaaccttcagtattgagcctagtttgggaaactcctgagtacaggctttaagaccacaaagaggccgagttgcagcaaatgcatcttagaatttacacacagccattttcccaaaggcagagcactggtgtacaggggaaggggagataacagagaaaaagtggactgcatattgtgcccaggatctattatcacttcagatctcagtaaatttgcaatgattttcttacattcaaaatgtcagaaagaatttatcttacttcttgccagtgggtctaaaactcacatgcatgttttgaggtgtattctcataatagtgaataagtctcacgagatctgatggttttaaaaagaggagtttccctgcacaagctctcttctcttgtctgccaccatgtgagatatacctttcaccttccaccatgattgtgaggcttccccagctacgtggaactgtaagtccaataaacttctttctttggtaaattgcccagtcccaggtatgtttttatcagcagcatgaaaatggtaaattggtaccagtagagtggggtgctgctgaaaagatacctgaaaatgtggaagtgattttggaactgggtaacaggcagaggttggaacagtttggagtgcacagaaaaggacaggaaaatgtgggaaaggttggaacttcctagagacttgtttaatagctttgtccaaaatgctgatagcaatatggacaataaagtccaggcggaggtggtctcagatggagacaaggaacttgttgagaactggaggaaaaggtgactctgttatttttttagcaaagagactggtggcattttgcctctgccctagagatttgtggaactttgaacttgagagagatgatttagagtatctggcacaggaaatttctaagcagcaaagcattcaagatgtaacttgggtgctgttaaaggcatttggttttaaaagggaaacaggcataagagtttggaaaatttgcagcctgacaatgcaataaaaaagaaaatcccattttctgaggaaaaattaaagctggctgcagaaatttgcataaataaggaagagcctaatgttagtcacaaagacaatggaaaaaaatgtctccagtgcatgtcagagacctttgaggcaacccctctcatcacatgccaggaggtttaggaggaaaaaatggtttcatgagccaggcccagggtccttgggctgtgtgcagcctagggacttggtgccctatgtcctagctgctccagccagggctgaaaggggccaatgtaaagtttgggtcatggcttcagagggtgtaagccccaagacttggcagcttccacgtggtgttgagccagtgggtgcacagggtcaagaactggggtttgggaacctctgcctagatttcagaggatgtatggaaatacctggaatcccagacagaagtttgctgcaacagtggggccctcatagagaacctctgctagggcagtgcaaaagggaaatgtggggtcagagcccccatatagattccctactggggcactgcctagtgaagctgtgagaagagggccaccatcctccagaccccagaatggtagctccattaaaagcttgcactgtgcacctggaaaagccacaggcactctccagcctgtgaaagcagtcaggagaggggctataccctgcaaagccacagggacagagctgcccaagaccatgggaactcacctcttgcatcagcatgacctagatgtaagacatggagtcaaaagatatcattttggagctataagatttgattttcctgctgggttttgtacttgcatggggcctgtagctcccttgttttggccaatttctcccatttggaatggttgtatttacccaatacctgtactccaattgtatctaggaagtaactaacttgcttttgattttacaggttcataggcagaaggtacttgccttgtctcagctgagatgttggattgtggactttagagttaatgctgaaataacttaagactttggaggactgttgagaagtcataattggttttgaaatgtgaggacatgagatttgggaggagccagaggaagaatgatatggttcggcttgtctctacccaaatcttatctagaattgtaactcctccaattcccatgtcatgggagggacccagtgggagaactgagtggaaataagacatataggagaccaacaaaagggatcaagatgtcagatttgataagcaattgataaagagatttagaagtgtggctttagacctgtggctcaaatagtggtttgaaagcagaatcaaggattaatcaaagtgacttcatcatctccgtatcagagaccgtttataatactgtccaaagtgctgaatgcttgttatatggaggcagataatttgatggagctacatctaacttgacgtagagaccacagtgtgtcaccagagattctggcctcctgagctggatgcagaaactgagagaacttggagttgactcccatggggagtgggtaagtattttctgtcatggtaataatgtaatcaagatatttttgataccagaattgtgcctagctttggacagtggaccatgggtggaggaggcgagtgtcgcttctgggcaggaacaataaaaatatcctgcacaatgtttcttactgtctcttcctctcctgagacaatcctggaactctcatgttcagattgtgaaggcataagacagatagagataagattcttgaattcccacatataaggagctgtcctagagaggttactaacttgctgtggggttttcttgaatggaggatgaacctctattatgttacaccctaaaatttggggaattattttttggttttgtagctataatatttatttattgaatatatctatatatctcctatataatgccataatgcaattaaaattaaacgtacacatacaaaaatctatagctcaatggaaaacacctgaaattgggtgatttacttttctttgtaaagtgagaaattaggaaagttattcttatatgtaaatcttgctacatgagaaaaagatgtaagggaaagatctataaacatacctgggaagaatgatatataaaatgatatattagctttacatatatatgcatgtgtatttacatatatatgcaatatatatgtgtatatattttagatgttatttaaaaatatttgtgtaaaatgtttttttgcccaaatgattcattaattttaagcacaaaatatattatgtttctataattagttgcccatgtaatttatcatccaaacaatgacatttttgaatgtgaaataggacacaattaataattatgtcagaacaacgaacgtaaactaggactcttctgggcaaactaggacatatggtcaccccacctagaagttttaatttcaaagctctggaaattcttgccatttccctctcactttctcctcatgaaatacaaaacaaacgaaacatgttccttcctcaccttaaaatacatttgatgaaaatatggacgtccatttcactattggagcttaggactcattgctaaaccagatagctcatcaatttgtttaaacatcctaagagcaagcaggtcatagtgggaagactgccactagtaactagaaatggaggtggatgagcaagagtgtgtgaggatttccacaaagtaaaacaagactaataaatagtaactgaacgcacccaagatgaatcttcacttactttacatgcaaagagctggtcatgtctgaatacatagttcctaaagctaaattatcattaaccttgagagagatttcatggtgcatgctttattgttctcattttatttctaatttcaaactgagatcttctgccaagcaactttcctttctccttcaataattacctgaaatccaaacttctatatgaagttgtccatgattaagtcatttaaagaaattaaacagtcttgagcaataatcagtcagagcagttatccattttagatgagtcatctgaataataatcattaaaaaaatcctcttcaatagcagttttagcctgatttttttctataattgccttcatccctcagcacaattactaaatgtccacacacttcttttacagttttactacccaaatcatttgctcttgctcatcagctttgcaaattaatattttgttaaatgcaccagggtagcttatttgaaaagaatgctaaagtaatttttttataaatgactaataaatatacctgaaatgacatttagtaagtttaaggtttcttatagtagggtaagcttgtgtttcttggtaaattgcacactttccaggatattgaaatttattaagaccaatagcagcagcattaataatgatgataataactacccattgattttgccccaaatatggggtagatgctaggtattttatcaactcttaaaataagactgtaagctatttttatccctattttaaacttcagaccttatgaacaaatccagcatctcatggatgattatgcttttacatatttgctttcaaattttctaacttattgaaacaataaactctatgaaggcagagaagatgtctatgtctattctacttgctttgccctgtccctatcacattcaaggacaatgaaggtatcacacttcagaaaactatgaaaaaataaaaatatatataaaggaacagagctaactccaaaaatagttgtgtttgtgttaatttggtaataattattgtgtgcttcagttctttatacaatttcttgctcatatttcctcatctacaaaagcatggaattattactcaaattttcctttcattcctatatgaaaaaattacatataaaatatagcataaatttagaaatgaagttgacagttttatggcagaagcaaaaactgattgccagccattaattaacactctaatttcctgttaatagatttccaattttgttctataacatttaacccattgcagaggatgtcttcactgaatataagccagtcttggcaaatgggtttcctttgccagatctctcctttcccagtctctcgtgtcactgggggaggttctgggatatgtctctggtcagttatgtgttttgttatgtgaaaaatattcttgatacaatagtagcctccacatatacgagaaggcatgctatacaaaaggctgtggaacagaaaggctcacaaaccaaattaaagtgccccaaatcacagagattataaaaatcagagtaaaacacagtgagaagaaaggggaaataggtgggataagctaacacagaataggatgtaagcaagatagaaggaccatgttacctgaatcttgagtgcatggggtgttcacacatcttgtctttttccctgccacatcaatttttcctgttgattatgtagttatgatgaccagagctgagatttctagcaactgtgccattagacaaaaggtgttctgtgccaggaacatttgatccactggagagacacagggacacagaccaaagtataagcttggcaaacatcttgatgaacagctatgggatgtatttgtgtttctttggcagagaaaacatgggaccagaatgtgtgttatctatgtgtggccaaataagaccccgtgaatattaagtgcccaaatattttgagactcatatattgaatcacgtgtatatttggtatatcataaatatttagtacacaggtgcttcataaagattaaatatctcttggtcctttcatccatgtatatctgtgtttgacacacacctatcctacttattaactacttatcttataagtaacacatcctatgaattctgccgaagtctaacaaactctttgcttactggttacttatctataatgaaacgactttaaatagttttgcctatgtcttaaaactacaaacttaattcatcgaagagaattggatatgctcaaaaggaaatgtgcatttcaaatataaagaaaaaatgtttgaaggcatatggagaatttttttttaactcatagaaaccagacctcctgttttctgcctgctcacttccttccagcttggaatgttggtataaaaacatggctgtggagctttaagagccatcctgcttctatgatgataaaaagtaaataggaacaagttgctgcaagttgtaaaaaaaaaaaaaaaaaagtatgtgtccttgacaacatttttgaggcactgactaaaaggtagaattgtttactttagatattttgtgacataagcaaaactgccctaattatccatatcactattagattttcttttgttttcactcaaatatacttaaatgattttaagacctattaccaactctcaaagttctatatcaggggaagatataactcacagagtgttttgagctaaaaaatgaaaggtgtgagaaagacgcaaaggtattctttaagacatgtcttatcaattcattaccatacataagtgttcagaaagttctagcttattctgtccaaaaaaagtatcaaacaccctcagaggaaaataaaaaactgtctgttcttttgtttaatatataggtgtgtgtgtttgtgtacatgtatgctcatggcaatctaaaac

SEQ ID NO: 2270 - DNA, 32573 bp, Homo sapiens
aatatatataagtaatatatatattacttatacagtaatataaaaatactgacttttccatgctatttcctcttttccccttctctacttcttactcctccactccctttccctcagaaaaattttggctttgacccactaagttgatttcatgactcactggtgggccataacttgaagtttgaagcatatgagatagagagaagttttggggtagggagagtagagctttcaggaatctgaaccccatggaccactagagaacaagagtaattagctggcataggtcactcactttgtatgagatcccttgtttcaacatctcgtctccattctgtttgcctttttggaagggatcaagacccaggctgtaactctgaatgcctcctgtgcttccctattcaaatagtaatttcatcagggtgtcgtccacattgtcttattccctttctaagtatcagtttcttcaccttaagataggaacaataataatcccaactttatgtagttattgtgaagattatatgaagaaacgtaatgaaaggactaagcctatgccaacacctaataaatagccaacaaggcctaaggtgttatcagcttgcaaagattccctggatgagcccccaagatcccagagtttttcaatgtgagtttgcctgacccagtttggaaccacttagaggtaaacaacatctctggacagatcagtactggaatatctgagagaatgtgacttacacacgtgaccatagtgtacttccaaaagcagaaatccagaactgaacaaatgtgcacacccattaaaaggcagcactgagcacccgcaggcctcctgagcaggggcagagtctgcccgtgtataactgtcaggagaaggagcagaacacagggtatcccatgtggaagtcaggcaggtccccaagagagaggaaagggcgagccacatatacatggcttctgcaccctaatctatcatctatccagaccactcaaccaaactttcttcctattgataataatggtttccagcttttggcttatcctggcttttgacatgccttcctcactaagcttaatcatttctagctttcaatttaaagccagagatgtgccactcttcctttcacttgaacacttaaagggctctgtaggactattaattggcctaatttcaatactttgtgtctcagggaatagggaggccagaggagagggagagagatgtggggaaggccagtcagtggagcagtcagagcacacacagtatttattaagtttgccaacttccatggatgcagtttatggcacatcaaaacaaatacaatagtaacattaaaaatcaccaaccacaggtcgggtgtggtggctcatgcctgtaatctcagcactttgggaggccaaggcgggcagatcacgaggtcaggagttcaataccagcctggctaacatggtaaaacaccgtctctactaaaaatacaaaaattagctgggcaaggtggtaggtgcctgtagtcccagctacttggaaggctgaggcaggagaatcgcttgaacctgggagggggaggttgcagtgagccaagatcataccaccgcactccagcccgggtgacagagtgagactctatctaaacaaacaaacaaaaaacagatcaccgtaacacatataatattaacaaaaaatttctaaatattgtgagacttaccaaaatgtgaaaaggagacatgaagtgagcacatgccgttggaaaaatggtgccaaaagtcatgctccatgcagggtggtcacaaactttcaacatataaaaataaaggaaagtacattaaaggaaggtatgcctgtattcagcatttttctgaatgattacagaatcttgtttgcctgtatgtgtgcacatgcacgtgtgcacacgtgtgtgagtgtgtagcatctcaaaggactcttgcttcatgaaacagtttaaaaaaaaaccactatgatagacaattacttctcttctctgactttcactttcttttcactgaaagtcagtgaaatctgactcacattttcagatgatactagtagacccttcaagcagatgccatgttgtcatgagactttccctgctttggatctccaactgtccttgaaataatttaaagctgtttgtatttagttttaggcaagcatgttctaaggaagtatgtgaggatggtagtgtgtaagtgcagatgttatgtataaattttaaggggtggttgcttctccatgatataattggaaagaactggcagctcactcatgcatgagtagctcggcccatgaaaagcaaccattggtggtaatagctgtgactacagcacattccagttagcccctatagaaggcagtataatggacccccaaagatgtccacttcctagttccaagaacctgtgaatatgttatcttacatggaaaaatatactgtgtggatgtgattaaattaagcactttgagatggggggacgatcctggattgtacgggtggtttctggtgtgattacaaatgcaactacaaggggcctcggaagtggaagaagatgcagaatagaagagacggaaggaaatgtgactgtggaagaaagatctgagagggagggagcattgctgactttgaagttggaagggtcccagaaccaagaaatatgggcaacctctggaagctggaaaaggcaaggaaattggattcctctctaggatgttgagagaggaacacagctctcttgacaccttgactttagcctagtgagatccatgttcagcttgcaacctacagaacttcaagataataaacgtgtattattttaagccactgggattgtggtaattggttatggcagcaataagaaattaatatggcttcatagaacaagacccctggctctttctccgtgggatagcctggacatgcctttgcttctgcaccactggaacccatgaaaggaattcctgatttcttctgatcccgagtgtctcagggccccatggactactagattgccttcctgatccctcttctggaatggtgagagctgagattcctgctttctcctgggatagaggctcttccctctcctccattgagggttcaaaaaacgcaaagggcaacatgaaaaattctttaattattctacttgcatctggaaaatttcttttatttggaaagaggaaaaggaaaataatcttctactagagtataactgattctgaataattatcctcagggtttgatctatctatattgccaatctgcataaatcaacatcttccctagtctcaacttcctgcagttcaatcatcccgttagagagtatgaattagcaatataataacgtcaaatcattccttaagccccaagatttcgcagtcacaaacgtaaagtgatatgtacactctacttatatacttattaatttatttttccctgagaacacttatagtgttactcattagaagcctgaggctagattagatcaatgacttccaagtttgtgcccatcatccatagtaagatggacattttatatcacagcccagtatagacacacactcatgaaaattatgaaacattttttacccttgttaaatggaatcattctgatattttccatttcatttaaaaaatactgtttaaaaataatatctaaaaaaatactgattaggccaggcacggtggcttgtgcctgtaatcccagcactttgggaggccgaggtgggtagatcacctgaggtcaggagtttgagaccagcctggccaacatgtgaaacctcatctctactgaaaatgtaaaaattagccgggtatggtagcacacacctgtaatcgcagctacttaggaggctgaggcaggagaattgattgaacctgggagatgaaggttgcagtgagccaagattgtgccattgcactccagcctgggcaaaaagactgaaactccatttcaaaaaaaaaaataataaaataaaactgattataatccagtaaactgatcttaggacccacttatcacttgtgacctgccttttcaaaacaccatattaaatggatcttgggttctcttttttagttctaacactattgtaatcttgaataattaagaatgttaagaatacaactttgatagtctctgtccccatgcctcaacttaaagtgttgatatatttaaatacttcattagtaaagtgtcttcttattgtaagttaaggaattgccccattcttctatgtaactttgttagaaatagtaaattcagttggtgcaatgataatcacattaggatctcaaaaattatgtacttgaatgtatgattaagctcagtattttaatatcaaattacagtttttgtaactaccctgaatgtaattgtgtcttgctgtttataattattttctcagcttaatgaaattttaataaattggacatggaattgatccttcaaggaaacatttttcataattagaaatttttctcaaacttggtggattgatgttattggctttttctttgtgattgtgtttatataaatagaaacattgctctgaaacttcaaaggtcaaatgggtaggaattaaattggttcagtcctaatgtatttgaagagacagattttgaaagtttctaggaaacagcaaaataatattttcactccaactttttcttcgagctattcctatatttctgttctccatctttgtatcccatacctgaacagtccagaatatcagcattaccatgccataaagtgtttacaattctgctctgagctgacatctgttacaaacagcatgttgcttacaacaacattaaaaaaaaagctttttatgtaacacagatagcacctgtatcacaaaggcaaatagtatgcattattcctttgaatgaaagcttatctctgagccaaatgctatacactaaataataatgataataaaaatctacctactggcaatgcataccaaaatacaaatatcttgttacagtattttctattcagataataatgtagacatctcttgaataccttttcttttctgatctgcatacaaatgggagaattattggttttgtctgataaggtgcttggcgtatacaatggggccaaaccaattatcttcttggctgacttatgttagaaaatcctgcagatttgtgcattacatgagggagtgttgaactgtgacgaacaaaattctgatcaatacaatctgatcaagaggacgtctgtttttcttacaacatcattaatttgcaaaacctcacattccagctcaacttttggaagtaccattccactacaaaaagctttcttaaaaagttgttaaaatttgtgctgcctaaacccctggaaaaacaagagagccagttgggaaagaatttggtggagaggaagtagttcacagaaagtcaccactatcagtttctttcctaggatggcaacaggtgtggtgtggcagcttcttctcccagcattaacactgactgacctgatgccccagctgcacttctcagaggcagcggttagagatcacctcctccgctgcttccaaacgaggtgctccatgccctcacccttcaacctctcaatttatttaacctcatctcatcaaattcctctccctttactactgttgggttttgaaaaatgagaattctaaaccaaatgagaaaaagacacagacataagatagggtgtcacatactcaatttataattggtaaagcaggattggaggttgtggctttgacctaagatttaaccatttaaagctttctcttccgtcctctcaaggtgcaggatctatcctggtgggtgagtttgctaattggaagaggcaagagtagagaggggaaggaacatggcctttaggctcagagattctgagggaaggccaaaaagagcctggataatgacccatttccaaagctcacccatcaaaccctttttccttgagaaaaacagagtttgcctgttatttaacatttctgagaagtgttctttttcctccatttaaaataatgagatagatatgtcttttttcttattatagaaactacaacaatattctagatatgagttctttgttggctgtatttattgtaaatatctgattctcatctgtaacttgacatttcactctctcagtggtatctttttataagcagaagttcctaattttaatgcagttcagtttgtcagttttttctttttgacctgtatttgtatattcaatttaagaaatctctgtctatcctaaagtcatgaagttgttcttttatctctaatggtttacatttatctctatgaagaatccgaggttgatttttgtttatgatggatgtagggaagaggatttcttttttttcctctcatgaatatccaatttataaagcaccagttattgaaaatactatcttttttcccattccattgtggtagtactttatcataaagcaggtagccctataggaatgggtctggctggtgattttcttttctgttccattgctctcattgctgatcattgcacccctgtcttttttactgtaactttataataagttttaatactaatagtgaagccatattactctgctccccttcttcaagatggctattcttagcctttaaaattttgatataaactgtagaatccctcctaggatttttattgaaaatgtattgactctaggtcaacttgaggagaaatgatgtctttgcaaaacattttaacatgtatccctctatttatgtcttaatgtctattactaatcattggtggctttctattagggatcttgtgtctctttcctcaggtctattcttaggtatttgatgtttttgaagctactttaaataggattatttttaaatctaatttaaaaattttgagtgatttgtttctaataagcagagatacaattacctttccaaattcgtttattcattctaatagctaatatgtagaatcatttggattttctgcatacaatatcatgtcatttataaatcatagcatttttgtttctaattattataccatttatttcttcttctaacctgtttcactgtccaagatcttgagaataatgctgaaataagtggtgaaaaatggacatccttcttttgtttttgattcaaaattctcaagtatttcactattaagtatgatgtttgctataaattcaatttgttttggtaactattccttatcaggttaaagaagccttccgtctgtttctagtttgtagacagtttttactatgaacagatgtcacatactgtaagataatttttctgtattaattgagctggtcatatgtttcatctactttattcatttagtgaggagaatcacactgattgatttttcgaatgtaaactagccatgcattcctgacataagcccaagatatgctatcttttatatatgtggtcatgatatattgtcattttaatatgtcgctatatttgaagggctaagattttatttagaattttaaaatttatgttcatgaaagagttgaacctgtaattatcttgttttgtaagatgtctttgtcctgttttggtatcaagattattctggccttgtaaaataaaataaattgggaaatgttacttcttttcctattatctggaagaatttttataagatttgtcgtattttgtctttactgtttagaagaattcagtgagggtgtcatctgggcttggagatttttcatgtgggaaggttctaattatgtattcaatttcttcaggaggtataagggacacttccggtttacattttgagatttagagagctggaaaaggtaatgttccactcccttgcaatgaaaaaaatggggcaaactgccaagttcacaactggtttttttttttgttattgttgttattgttgttgttgttttagatggagtctcactctgtcacccaggctgaagtgctgtagcatgatcttggcttagtgcaacctctggctcccaggttcaagtgattcttctgcctcagcctcctgagtagctgggactacaggcatatgccaccacgcccggctaatttttgtatttttagtagagatgaggtttcaccatattggccaggctggtcttgaactcctgacctcgtgatctgccttcctcggcctcccaaagtgctaggattacaggcgtgagccaccgcacctggccaagttcacaactgtttttgaaaactttggagagatgaagccacaacaaactgtcacaaaatacacaaagaaagggctatctaccaggacagataagatgagagctctgacttacccggaatggaaacaaccagacattgactggtaaaaacagttctgctaggatgttggcaaatgggtagaggtcaagcttgccctggagagggtaacggccttagagccacagcaattggtagggtcttcctccgcttgcaggcttttgctgcacacaaacctcactgcatgctcacagcaacactagagagagttctaagaaaataaaatgcaaagagaaaaaaatagtgaacaaaacagagcagagcatacaaaagctatgagacaatataaaataatttaacacatgcataatagaaatctcagaatgaaagaaagaatgggatagaagaaatgctcaaagaaatattggctgataatattcaaaaattaatgacaaacatcaagtcacagatccaaaatggccatagagtatgaaataagattaaaaaccttcccccttaagaggaaaaaaaaacctctaaaactgaggcatattatattcaaactgctaaaagccaaagacaaaaggaaaatcttaaaggcagtcagagaaaaaagatacattatctagaaagaaataaggagagtgatcaattcagcaggcttatcactagaactataataaataagaggacaatgaaatggcattttaaagcagcaaacaaaccaacaaaaataccactgccagaaaaaattctgttcccagtgaaaacatctttcaaaaataaggagaaacaaagattttcttaaaacaacaaaagcagaggaaagttattgccagcacagctactctataaaaaagcctcaaaagattctgacactaagtgtgaacctagattcacacaaataaagaacctagaagtaaaatataagtaaaataaaatttattttttaaaaataaatagatgtacgaggagataactgaccatctaaagcaaaaatagtaacaatgaaaatgtgacatattaaaatgtgtggtatgcagctaaagcagtatttgaggaaaacttatagcattaaaatgcctatacagtagtcatcccttatctaaaggggctacattctaagactcatagtggatacctgaaagtatggatagtaatgaaccctatatgtattatggtttttcaatctgatatatgagatggctaccaagtaactaatgggagggtggtttatacagcctggaaatgctggacagaaggttgatcctgggcagaatggtgcaagatttcattctactactcggaacagtgtacaatttaacttatgaattgttgaaacttatgaactatttatttctgggattttccatttaatattttggactacagttgaccaagaataacggaaacttcagaaattgaaactgtggataaaggtggggagcaactgtattagaaaaaaagaaaggtttcaaatcagtaatccaagcttccatcttaggaaattagaaaaagaagaacaaattaaactcgaagtaaacattaggaaggaaataataaatacaagaaccaaaatctataaagttgaacatagaaaaacaagaaagatttacaaattcaaaagctacttctttgaaaaaaaacagtaagattaataaacctctaggaagactaaccagacagagagacagacagaaagagagagaagatataaattataaacagttttaaaaattttctataaatctaaaatgtgtttgaatacatggtttaaaaaaatatggagatattctgtcatcatgaaagatgactgtattgtatactccataaatgttggttgaattgagttgaattggctgacctggtaacatgtagcagagattgagagcaggaaataaatagtttggtatttgacaaatttgttgcttaaaaggtcaagtaccatttgtgaattaagggttttgtgtacagcttagtttgtgaaagtcagggtttagaatataaaatgatgtatatttttagttatttaataaaaaatattagaattacatatttgaattttgattctgttctttttaccagagaaaaatttatttgagtctaatgtggggccacttaaaaagttagctgggatttgagagtaataaatgagtttggtgtaccttttgaagcttgttggcatcagtaagctttgccaaaatatgcctttgacctgagatttgatgggtgtgtatctaggaaatggtctatttcaattctattacctggaatttatatagctatgtatctcataaattccactctttcacattacctttatacattacaattgcccacatggctgttacagtctcttgaataaaaatgctttctatattcatcattaatttacccaagaaagtaaattattccttgcaaggaattcaattcccagagtctatcaggtccttctgtactgaacaggtgtgggacagcaaaaaaccctggtcctgttcagtgtctttttgttcttgagtttcactgagggaagctcatgttattttaaccttttcctactgtgcccagccatgaagaattctttgaagctggtctgaacgtgttttgttcttccccggtggagtcccattctcccacaatttgtgttctcctatccctttgggagttgccctatgtgtgcatttttctcttcccctattcactctcaagctttatcatttcactttgactttggctttcttccttcaaaccttctgctttcatttgacaagccctccaggggtaagaacagaaagattcaggaaagtaatgactgaaaatagatgttaaattcccaggattgctctgttagattaattagtgctaaaatttttgatggtaaaaaaaaaaaaagatctgtgttttgaaacaaaattacacaagctgtatataatactattttgccttcaaaatgtttgtttctacaaccataagtggaattttccatgcagcgctttctgcttctccattggcagctggcgagttagcttcacttgtctttagttagctttaatacactctttagctagacaaagaaaaggtccgttgagccaaactggatagtactggattgatggaaatctaaagcctcatgtagattcagccttaatgtgttttgctctgttatttggatgagtaccagctttatggggagatagtgaaatgctaaagaagttgaaagacagaggggaaggaggtggtcagcagggaggtgaaagatagggtaaaatgccattccaacactttttaggatgcctgacatcacccaagaccttttagatgaatgattttcagtgttttatatcacagtttacactcagactcacaggggcacatgcaaacactcacacatatttgcaggcacaggactgaaacacaatttcataaacagttattccttttgcctgagaaatgctgatattttctattctatgtcctctgaatttgcttgtcacaaatgactaaattaattttatgacctactgatcagtggcaacctgcagttttcataaaagggctttagagatagggacaactcatttctgtggataaattcttacattttcttttattttaataaacattttcattgccttctttctctcatctcaagcagtggccaagactatttgttaaatggatcatgacttctcatgacccagttaaaggcttggagatgtaaataaagggaagattgaaaccctgaaatctcagggcttaaatatcacaaaagtaaacccacagaccagatctgttgggaacaaatggatgattatgtgacaatgaggaggaagggataaacgctgttaatcacagtcagaagctgaaggtttaatacaagcaaaacccacatctgttctgaaaaattcatgaatttcacaaaataaatattagatttaatctaataaaggtacattgtatagcaggagatacttgcaatccctccctccatgggagagaaatgaactctaataacgtaatcgaacccatccaagagacaacaggggtaggtccttttacaggttaatgtcactcctgagaggtggccccatccctaccccaatcaaaaaacgcaaggcaagtctatattacatatagggggaccactgatcattggcgctatctgaaggggcctcagcaccttaccttctgaagaaaaaactttctgccaaacttggaaaaagcatctaatagtgaagcggttctccacaatgcgctgcacatagaaccacatgtgagctttggaaaaatactgactcagatgaaccatcagggtgagtacaacttaaatgaaaggaagcaaaatgcttgcagtaccctgggggaaacacacatcaaaaaggagatctgagctgaagacccccaactgaccttcaaccttggccctccttttcatcccactcccgccccagctgttctgagaacttgagcaaagggtgtcaggactctagttgaagctctgggaagtccacacccttgctactcaaagtgtagtccacccaccagcagtggcagcatcacctggaagctagttggagagggattcggggtggagcaaatggcagcagccctggatgttgctaaggaaagagtggatgacccctatccccaggggcatgttttagaatagatagactcaaggcagagaataacacagtgccttttccttacccctgcctggctgaggggaagaggacattgtccaacattgggcttttttagataaatcccactataaataaaactgataatgaaatttctaagtcacatgacaggaaaagtcgcagggttattgcttttctatcgtacagtgtaaggtcaaggaaatttgtctgttttattcactgttgtatccctaatacccaaattcatctttatcctccctaccctcatacagacacacattcttgtccacacacacacaggcaaactctttgcatcggtttggataggagaagctatgctgcagtagcaaacctcaacaccttctcattcacatgtaagttcaatgtagttcagcagagcagctccgctaatgatagctacctaggaagccaggctgatggaggcactatctcaacatgtgctttcaaaggaaccatggcagagagaaatcaggttttaagggttcccagccagaatggcataacacttacactcaaatttccagggccaaagcaagtcacagtggtcatgccaaacttcagagggggctgggaagtgaaattgtaccatgaattcagaaggaaatgaaggggaaatatttggtgaaccacagtaattgttactactgctaaatagagctcatgaatcaagttctatgggaacacagatccgagaatagttaaccttcctaataatggtaaacaagtacacctttaaaaacacctttaaatgtggagttccaaaaacattaaagttattttttacataaactcatattaattttataatacagaaaaagtacattttagcagtaagtcatgtttctctgctcttttctcatgtatttctccatgtgtggaatgtcccccttccttcttttgtgggtgtttgacagattcttgtagtatcattatagaaatgctggattctgtaatgttagggagattcatagctggtgaatgatttgaggttgtttggacgatctctagtagtgtgccaaagttttctttctcatttgatgatttttatcatagacctagatgaactcagggaagacatacataccctattttcagataacatgatattgagagggctaaatcataagctggttgaaaaagatcagaattcaaaagatcattattcaaaataatgatgtactagagaggtcgggaaaatcacagggtgatccttactttctgatcacaaaggaaaaaaaggcaatcacataaatactttgtatatttacacatcactttgttccagtacagatgtatggcaacttctaaagacgtatgaaataaaataaggtgacttaaattaaaagtcgttgagatacaataaagaaaataaaagccagggcaaagaaagaaccaaagaaagagttaatgttacccatcaaaatgatgtacttggtatgggaaagtgcataaaaataatattgatacacacagtgttcaagataattgtggatgaaacagagttctttgcagctcaagatggcttcaagacagagatggcaagtagaggtcagcttacgtttcaatcctgagtgattggtgagtagattcttggagcagtgtgatgggagactgggcttagcaggaactaatttagccataaagcagtcattataggagatggggagaggtagcagtgtgctgagtatttgccattccaaggacaaaacccttcatttggtgctagaaaatgtacacaaccaggaaagcagatgtctaagcaagatgatggggagtaaggggcttggctaggatttagttaagtggcgggtatagcaatgagctcatttgacacccagactaatccgctcctttctagtgtgtggaacctattctgggtccctgtttataggacccacagcctcccttgtgtgtgtgaaggtagtttcatggatgctgaatggatttaagtgggttggtatgggaaaggcagacttttccatgccagtctttcactttggaattcttggcactgttggataatcttggttaggataccttctgctcccattctctatcctggagtccctagtcactcatcaatgctaacacagctactgcacaagacagagtggaggattggtctctttcaaaaattatcagagccccagctctccccatcgcattctatctgcaactgtcaccctcagaaatccagaagagggagatgtgtccagcactgtgagtcctgagtctaacttaagttctgggaaggttgtccccttcctcaaaatgtagaacttggggagagatttacatggatcagatagcatgggatgaagatgtgccaattagcttttgtggcatgtgatgtcaccaaaacctagtgtcttaaaacaacaaacatttcttattccttatgattctgtgggtttgtggccatttcttctggtcttggaatattcagctgatcttggcagttagctgctggtttaactatagccaggtggtctaggatagactcactcacatgtcttgttgtttgcttgatctcatttagatgagacttgccgtacagggttcccaagagtagctagagagggcaagtcccaatgtacaaacacttttcaagtctctgcttgtatcttgtttgctactgtccccttggccaaagcaagtcataatggctaagcccaaattcaagaggttaaggtatagctccactacttgattcaagaggggaagatactgactctatcattccaccttaggaagagctactaagtcacattgcaaagaggcaagtatctagaaatgggaggtgtttgtggccatttttgcaatctgccacagaagagaacacctagctcatctaccctgatgagccacgtcaatccttccagattgttctcctatccctgtgttttataattggaactggaatcccaaattcgcattgaaacactttcaaggatctgttatggaagatttatttctggaaactgaatagccattattgttctgctagaaattgggttctgaaccttcaacatatgaaagacctttataaatacaacccacttgtatttgagaactgcctagcttgttggctgaaatgggattgcagaaatgggctagtatttttcttttaattcattctgtactctggcagtaagaatttccttctgaggtggatacagatgataacctcctgatttgagtttgaagtttgcactatttaatttttggctggttatagtcagaaccgctcttttcattgtagagccaaatgattatttatacttctcttggatcattctttatataccattagcaatgacacgcaaagcacaagggactgaatatttacatccaaaattctgaagtgagtattctcccattggcagatacaattcctcagggctgtaagacctggtaataaagaaccatatgtcatggtggattgtatgttgctacagcaatggctttcaagcagctgaagttctgaatccccctgcttcttcctctgcctctcagtgtggctaagggctggctgagtgttgcctattaaaggactctgaaagacaatgaagaaacatgtttttgttcttcctaatgactagcttctcagagttcttgttataaatggtgtcttgctataatctacagcaaggaagtattcaagactcaatacaagaaatatttcactgtttgtcatctagggagattctgagcttgaggttgccctgataatcctggagcaaaacacatgttccctggcctcagtcagcttacatactcatcagggaatagtagaggagcataaataactattatagcagagagaatattctcagttccataaaaatgcaaagagaggaatatgaatttccaaggaagaaaggagcaatattgttcaaaaattccgtccattacacgtattgcatgacatttaataatttatttttcttttccccttgaatgcagagactgaggctctctcagttgtatcacctccagtgcctcccaaagtgcctgccacccagtagaatagatgtcaataaatgtttgcagaaagaataaatagatgactacattgatccacttagcagaaggaagaaaagctttgtggatgtggtaaaacttgaaagacacttaaaataattggcagatagtgaatttgggagagaatgcattagtggtagagggcatagaaagaacagagaagtggcaatggggaaatacaaggcatttaagagaaaaactaatccagtttggctggagtgtggagtatatgtttgggtcttggagcttccaggataaagctgaggtgtgcatcaagccacgtgagttgcctcagttctcttccactcccatccttaagggataagctttggcctgtccatcctgtcctctgatccaactggagatttgggcagggatggaattccccatcatcccagcccatggtgaattaggcatcctctttattcatggtaagtggcaaataatagaaaagtgtgccttccgctgggattttctcatgaatacgtttcctctgtccatttacaattgattgtaagctctttaaggtaaagggtgtaatcatgtacctctttgaattccggaattctgtatcttgcacagggaaggtgagcaacagcactccactgagtatgttggtgtcctttctaacattagcagtgagcttaaaatctgttccaacaaaaagaaaaaagcagattccaactagagatttgggcagagtaaggcagagcagtgacacagcgaagagcccaagccatgtccatggtgcctgagcccctagatggcgaccatcatcatcatcatcatcatgataataatggccccaaactcaatgtgctcacactaggagtcaagctctgtgctgattgcttcacacagtcatctcattttgtcctcccaacaacttgtgtaagaaatgtatcctctctgtacctcaggttccttatctgtaaaatttgaatagtaatactagatcctacctcatagtgttgttattaaggactgaatgaattgttatttgctaaaggcttaagtaccactccgtaactgttgactttgattactattacaatccccattttacaaatggggaaaccgagacacaaaaaagtttaaaaacacttgctcaacatcagacggtgggactcagcatactgacttcaggttagctgttctatcctatgaagaaaccgaccctctcctgggccactgatggtccactgtgattgcatctttcctggtctcatccttggcatagtctcattggagactgatcgagacaaacaatcctcaaggacctgcttttttctttttgttggaacagattttaacctgactcctaatgtcagaaagggcaccaatacactcagtggagagctgctgctcactttccctgtgcaagatacagaaatctggaattcaaagaggtacacgattacaccctttaccttaaagagcttataatcaattgtaaatggacagaggaaatgtattcatgagaaaatcccagcagaaggcacgtttttctactatttgctacttactgcagataaagagggtgcctaattcactgtgggctgggatgatgcggaattccctccctggggcagaggtaagtgtggcaggggttgttgtggggtgtgtgtgtctgtgtgtgtgtgtgtgtgcatgcttgtgtgaagaagcccaaagcattaaggaaagaaaacaaggcaacaaagggtagctggaggactgagtatgtacagcctgacatgagacatagagttagaattgagtctgtaggttaaagtgaaccccacaatctcatctggcacttcagagcacaaggcctttactatttccatcttgctttttcctaagtggatgtaatttctatacaggttccccaaaccaggaactctacgacatttgggacaaaagcctttgttatctccccattgttcatttccaagatgttctatcaatgttaaataaaaagcttctaacatatgtgcatttgggtcagtattcttctaaaggtgaagaataaagggactcagccctagaagaatatcctctaattactttctcactattttgatctttggctttgaagtaaatggcttcccttttggtcatttattgatttcctctttgaaagttttttgttcccatatatcatcattttgcacacatcttgccagactcctgtactcgattgctattataattttttccttcttctcatacattgttcaagccattttctgagttaaaacagataaataagaaactatttatttatttatttcttccagatgtctttgctggacctgaaactgccatttcctaaacttatcgtatttgtatagtcaaaaattatttttaactttgcttggcttgcatttaaattttctttctttctttttttttccctgggaagtgtcctagtctgcttttcttaaatgccttttccataatttaatgaaaagggacaaaagtaaaaacgagggaagacattgaaaaatggccaatggggagcataagaaaaatgccctttacatgtggtgactttgaaagattaacttttcaagtgtgaccatacgtatgaaactattactgtttttgctgctttaaaagcatagggtaagagttctctttgaaatgattattaaaactattaaataattatgtatacccttgttattatgtcagtttaaaggtttattacactgggtaagtccgaggaacatattggctggtaagctggttgttttctggtttcaggtgcaattgaaattcagctacatgttattcagaaaccctagagaacaactaaatgatgctatttaccattacatagggcttctcttagcaaccaattttgtttatgcttctaaagataatgttagtaggagcctcaatgtctggttataatgtattcaaagccagagtacttgagaagtctgtgagtaagaatgatccagttgtctttgtgttagtagcttttatccagggatgataaggaagggaaaggaattaacatgaactagggaccactaataagccaggcatttttacattttatgatctctatactccctacaaagccacattttaccttcctttctttgagttgaagactctgaggctcagagaggtcaagtcacttgctcaaggtcacgcagctagtaaacggctgagcagaggcagactttagatgtgtctgactgtaaggattgccattcttccactggaaaccattgcctccacctgaatggaagggtatcttttttggtaggaaggagatatattatagaatgggggtatgggttgggcagctggtcaacctgagaacaagacttgagagatatttaggcccagaatctctcacttctttcttcctcctcccctgcatggtgacctctaggcctgtcgtttttattttcccaagccctggtctctgggaaggattaacaacactatcagtgaatagccaagtaaagttctgtggacaaaaaaatgccaatcaaaaataattgtgatcttatcatttcaagatgacaaacgcttttttgtttttgaaggtattcagccttgacaaaaaagtcaatctgcacaacatgcattagcaaaacatcttcctgggcaaaacaaaacaaaaaaacaaatattagaacatctctatgaaacgaggcatctgtatagtcctatatagaggatgagaggacacccataactgctggagaaagtagcagaagaccaggcagggcaataaagtgaagccagacagacccagaactctgtgtacaatcgttcaatccatacagcccaggacagtgtgtggtcgtgagtggctggataagcagtgtttaggagctagactgcctgggtttgacacaagctctcccacttacgtcattgtgagtgaagataaacaattgtgcctcagttcttccgtctgtaaaatggcagtaataaaggtacctatctccatagagctattctagccaaggcacttgggacagggcttgttacatagaaagcactgtgcacaaattggctttcaagcatgctattgaactgctttctcaactaatcagtatccagtctttggaggatacaagcactcattatgatcctatttgtgacaataattaggaagaactgctcattgaaaatggatttcaaaattgcatagcaattatttcatttatctttcattattttgatgaattcttcagtggacaagataaagtgaaagttgtaactatatttgttttcagcacctaccaccgtatatggtgtaccatctgtggatttataaaatattagtgaattattgaatgagccctaatattctgacaactgtttaaatatcgatgttttaaagtactgtcattgaatacaaatacaatttagagtctttctctgctttctctctccccctctctcttttctggccataaatcattgtctattcactgggtaaacaacatctgaattccctggagctcagcagcccactgatttcactaaaaagttgtctcatccaactctgaatatggagtctggtttctgaatggctggtaagatttattttccctggtggttggagctggtatattttaccaaggcaaatccccatgtgacaaaggaataaatacacagggaagaatcatttgcataaagtaagtgaaccccatcaataaactccatttattttgttatcagagaaatagccctgtgcccttatccatcagcagacagtctctctgacctttctcacttcagttcatactggattgcactgcctcaccagcagccaatctactctgaaatcaatgtcctggtttcacacccagaggtgttgacctccataagcaacagacttgtgtggcagaggaggctgccattaaagggaccacgtcatgcagcctggtccaatcagctgctagcataagcttcttgcttacttacttgctttgtgttgtttaattcagagttggcaagaaggtttaaggaaaaataagggttggcagggaggtttaaggaaaacatagatagagcagagtttaaatcttggccttgtcaatttctggctgtgacaatgtgagcaaaagttttgactcatctgagcctcagtttatacattggtaaaatgaggataaataaaattgactgcatagcattttgtgaggattaaaaaaggcaatacaagtagtgtctaaaataatacctgccacatggcaggtgttagtcaaatgctttttaccttgtctcctccttttcttcccttttttcctcccttccttctttccctctcttccttcctcatatgtgatcttctatttgcccagggcttcttgtgtgattctaaattatagcatctagggcttgtatcaggaaagcataccttaggtcccagaattttgaacatcaacctaaaattttcccatcagccttcagcctctcttcctagccatgggaagctcctcagtagagatgaagtcattagctcaattctttagggctcatctttctctgaaacttagtgatcaatttactttacccctgagactacccttgtcatctttgggcaaaatcaccagcaagcagaaaagtttggcctcttccgtagatgctcaatacatgctagataagttggaactatcatggccatgtcccaggagctcagagagcatgatatactgattctgggaactaggtgttttaggaatcatgctaatcaaatgtaacaacatacctggcttccagaaaggcagctaaatgtcaggttaagagcttgggctctgaaatcataatggctctgctctgtatcctccaacaaatttcttaagctctccaagcccaagtctccccatctgtaaatgactaatagtaaggtggttttggagtaagttagaaatggccctcaaggctcttagcacagtctgtcaatacagtaagaggaacaaatattggccagttctcagatgatctgaaaaccacctgttaatgggctgaattatgccctcagattcatatatcgaagctctaacccttgtttcctcaaaatgtgactatatttggagataggatttaaaaagggtaatgaagtcatatgggcgggccttaatcttgtatgactggtgtttttataagaagaggagattgaaacagacacacacagggaagggcactatgaaaagacacggagaaaaagacagccatctgcaagccaaggagagaggcctcagaagaaactaaactgccgataccttgatttcacatttctagcctccagcattgtgagaagataaattttggttgcctaagccctgcagtctgtggaacttcgttatggcttcccagcagactcatgccccgccccatgctgagaccctttctcactagctgtgtgatcctgagcaggcctggcattcagataggctccattaaggagagtctcattgaatgtaaccaaccaaatgtcctgctttggccttttctcctaatttttttttttttaatttacactccccttgaacaacatcgctaagccacaggctggccatgtcataagcaagcttcctgcttcaccatgcggaagcctcttgctggcgttttttgaacaccagtatctcaattcactctccgtttgccttgatttgcttctttatttcctgaggactcaagtggcctgggctcttgactgttttctcgatgatttggccatctcttctggtttgccggaagctgggactttgtggctccatctgtcttcttggattctgaccctccgcttagctgaccgagatttgtcacataagcctgtgtgctctctgagcttccatgacttcagcattttctatgattgagagcaagtcaagagtacacactgtacacacccaaagttagtcttgggtatagttagcatagctgtattcatgctactcgtgagaaagttaaggcctggtcagagtcagtgcctgaaaagccacaattagaaatttggtttgcttctctgcagcagcaagaccttcccattcctatacatcgcccttcactttgccttcctggctctgacctctgttgtttctatgacctccagaacccaccagattattctaatagattgttctgtattacccgaacatgatttcttgctttgtgcccatacagggccctattggccagccccaatccaaggaacctctgacctattgatagctataactcgagggtggataaagaagggcagcacaagcttacaagctccaggagggagttaaaatgggatcactttggccgggcacagtggctcacgcctgtaatcccaacactttgggaggccgaggcaggtggatcacgaggtcaggagttcaagaccagcctgcccaacagggcgaaaccctgtctctactaaaaatacaaaaaattacctgggcgtggtggcgagcaccataatcccagctgaggcaggggactgtaatcccgggaggctgaggcaggagaattggttaaacccgggaggcggaggttgcagtgagccgagattgtgccattgcactccagcctgggtgacaagagtgaaactccatctcaaaaacaaaacaaaacaaaacaacaacaacaacaacaaaaaacgggatcactttgctatttcctggatattgtgagctgctcacacctgcctctcctgtgtaacaagattaccaggatgcatactaaaggtctgtaagtggcagagaggagtttttgtcctgggatctaagaattcttaggtgtccttgatcaatgatggctaagccatgtgtcctgtgtaacaatagatttcctcttggtgcagcatgctcagtactgtgtgtgaaagtggcttataagggtaagacaaggaattagaacttgggcacttgaaatacctctggaagtataaaagtagactggagccaggaaaatacctcagagtcactaggcaagtcagaatggggaatcacttgggcagttgaaagtaggaacatgtgtgacaaaagcaagtatgcaacctggacatattgttttattaactttctgagaagtcatgcatcacttcttgcctcagttaccctttttaaaaataagaatagtttggatcagccagtctctaaattctcttctatttctagaatgctaatctgttttacttattaagtaccagtgtcagagcacattagcagtcctgctaacagatacaagataccagtaacatgaagttcttgacatctgagaccaacttctcttctgagagggaaaattctctgtatggtttctgcaaaggctggagcagatcaagtctgggtgcaagtgcaggtctttgagaacacctttagaagcagaaggtgacccatgcctaatcattctatagtattgtagtaatttcagaattatcagacctcacagcagtgagtcagcagtgcctttgaaattcggggctaaatttaacttcagcaaaccctgaatcatggttctaggataattttaaaatagaagatggttatattcatggaattttctgctcatagaatggcagaggggaactgactgtatgggaaacaaaaaatcttcctgaaccagtcagatgaagtatagccacacaagaaacagtgagccattagcttgggacacagcagttaccacctaccagatcactcccacctctggtgttggctggagagatcccccttcctaaatcatccttctcaaccatctcagtggttccaaaatctaagggaggacattgcacaagacaaaagtagggaaagcatttgtcacccacacccttagtatgctcctcccagtgcttttcaattccagccatgtgttgcatcagattagatatatactatctctctcaggaccagctatgtaacttgttaggcctgatgcaaaatgaaatcatggggccccttgttcagaagttaagaatttgaagatggtgccagtacagcattaatccaagtacaggtcccttttaagcacaggactgtgggtgactctgcaggttgcacacacatggggctgaccctgatcttttcccgcagtcttctgctcctctgctttcctgctaaagatgcctgttcactcagggtactggttttagactctgagtggttcaacaaatccacccaagcaacttgcatacatcattctttctcttgtgccatcttgttatgaaccacaattttattgacgtgaggaaaaggcatcagaacaaatctgacaatgttcattggctcacattttccagagagacgcatccttggggtgctgagatcctactagatatactgagtctaaaccagaggttcttaatgaggagtgagctcaggcttacctgagatgcccagggattctaaatctgtaaacctactttatttatgctcttgaaaagtcttctcagtaaaacaatggtaaagaagcatttgaaaacaattccatttatttgttattttatatatcttatgacttcttttatcattatttgattttttgagacatacatgcgtatccgtgcatgtgtatgctcccctccccaccagcttgatgttagaatctgtttaaatggactttttttgttgttattgttcagagtgttttaaacttcagtgtggcttgcaagttctgtttggtgatgattatccactttgactccgggtgaatttatttgtggctggatctagcagaggccacaaactaattattgcaaccaaccaagaaaaataaagagaatgaggaaatgccagaagtattgacaatatttattgtagcatatggctaatgtaaaaagaggtaatagaacgatgtatctcaggggatcattcaaaaggaaaattacttacattaacttttcaggcagaccgaattatgcattacacccctcctgtaatgctatacaaagtcaatgtttgtgaagagtagaactggcggctataaatcaagcctttcagaagaactgttgtgtctgcagggattttttttcctttgcttttttgacatttagatgaatgaagaattttctcagcaaattattaattactccttcttgcctatagaattgagttcactgtagttatgtaggagtcaatggtattcaaactgcagcttttgatgaagtaatcggctgcttctggggcctctttcagctgccctgggcgtgcttcacatgtaaacgactgccaaatggattctttcgacattccagccaattaaaatacatttaaagtgcagctggtggagaggcaaaccacgcgattgtgcggcgaacttcagggcagtgagacaaaaaacaaactttgcggaacccagatccagcagcccagcaaggcattcgttcgggggcagtagagaaagtcataaaaagaggctatctttagcccccgtcagaatcaaagatgacactttgagcaccaccttacaggacacaaaagagggaagcatgtttgtcagggtgtcagttttctctccttgcctcttgaaactctgtgtgttggctggttgcccaatgtggtgccgcatacaaatgttgacagaacacagcggtgtttgttaaacccggcctggggaaaccagtgattaaaactcttgaaggaagatccgaaaaccccaggaactctcctcaatagcattagaacattgatcgaatgaaagagaaagcaatgagtgggctaaagtgaaacattcagcatccctgtctggtatgccttctcggttcatcgtgaagaataaatgagataagctacctcaagtgcctgtaccaaaatagactcacaatacatcaggctttgcagagtttagagcatattctacccaactggccccagatggaaaatactgtcttgaaattggatggctttttaagtgtagctctccacagcctgctcaaagaaaaaaaaaaatgaccctggaaacagacgggggattcttataagtcacaaaagaaaataaataacttcatccatggagggaaagagacagcttgagaaaagggactttggaaaaaggctgtctctagacagcagtcttgtggtaagtactaaatattcatttaccactctatatgttttggctttgaatgcattattctttgactgttatttcctgaacgctgtgcttttgaaacctctcttccagttacaccattagcaacatcccttgagattttgtttcatttattttttacaaactcaaaagccagcaaattattggaatgtttgtatagtgtcttaataggcaaatgtcataatctgtcaacattatatataattacattaattacaactgatgtagacttcagcctatacaaaaacactactgtatagctgatgccaaatgctaagcctacgtatagttgttccatcccccatttatcttaaccttgggggtaagttgaacaagaattcaatacaggttcaaatattgaagagcagaggaagtcttggagaccttcttaggtatgtgcattagttcagttgtctgtaaactaactttctgagagttttaatgctgatgaatattattcttaacaacctggttgggtttgctatccggtgtgaaaatctgcttagtccagtgaaacagactaattcactttagactaagtctgatggttggctattcttctgcagtctctgggccaacatgtgtgggtcaccttttctgttacgcaatgcgtgtgaacagagcaaggaatcaaatcaagcaaacttgaaatagaaagcaaactttctgaaatagagatttagcttggttccttgtgcacattttatagggatgtgctttattcacttgtatatgctcagcacctgtcctggagtctagcagagtgggggttcaatgaactatttgttggtttgatttatccgttatacctttcaaactttgcagctgtaggtcttgctctgtcacggacagattagttatttacctcttagcggctgaggctctgcctcacaaattattcatagatgtgagtttctgggacttgagaagaggattgtgttaagcatttatgtcaagttcttctctccttagtcagaatcaatgtctgtgtctatttggtctgtgcattgaccagcatacctttagaggccaactttggtgtatttcaggttctcctctccgtagatctgaccccatctcacctcctacgtcttgctaactccaggttgaacgtggtgacattggtgtgtgagtgtgtctgggtgtctgtgtgtgtgtctctgtgtgtatatgtatgtgtattcccttttcaacttctggggaaacctgggataaagagataatttctcagcctctcctttgcagaagaaaaacactttttacatatcagcatgccaatagggtctgtcttaggcctaggctaaggacagagacagccgtagggtatgatgtgagcagctcaagaaagattctcttaacccagaaatatcatcggtattggttggtccccaaagccatagatttctgcctcagatctcaagttttatgcaaataccctataaagttaaacataataagctattgtctttcaataattcatagtagcactcattaataaatggccttggatcactgccaaatgtcaaaccgatgagcagaattttgttgtgggaattggtaaaatagaagaaggcagagcccagatagctgcgaaggcagggatagggcaggacaagacagggcagggggacgtgagtaacccccaatggggatcgtaggtacttgcagatcggaaaaagggaaacagtgtcaatgctcatatttaaattttgcctaaagatagcttgaaaatgggcataagtaaaatcctgtcacattaccagtctagctgaaaaccctaaattgagcttgcattctttctggcatatggctgtaccctgaaacttgttgagggctgcaaatatgtttcttgacttgctggcatagaagaacgctgtgaaaatgagaacttgtttggcaccacctgagagacttaatcctgttaagtctccctgtgtcatgcttaggagagcttttacactagtgaaatcttttccttgtttcctagaggcagactgtgttacatctgcatgcccagattgggaaaattctgaaaaaggatgtcctttcctatcacagtgtgtaggggggtgcttaaatgcttttcaacattatagcacttaggccaagttactacaattttgcccccggttatagtattatgttctcttcttcaaataagatgctacttctgggagaatagcagctagagtattctttttgagttgattctttgggaatgggaaccattgaaagcaccttgaatgaattccaagtatcagaaagaaagctagaccagggatgagatcaaagatgcctggcctgtgagggatctgaactcaagatgttgccctcttcttcagctttatgctgaagccacacaaattactaggcaagaagcaggtagggaagattctagataagggctgctgtgaaatacaagaaaacaacaagaacaacaaacctggcattacagtacagttttcattcccaatgcatgctttttattttattttttgaatctagaatgctaaagtgaaaatcggttatctcgtctcctcactttgcagactgcttaaggcccagagaggttatctgctcttcctgagctcacacgctaggattacaccaaaagtagaacaacctgtcacttaagttctttatctttcattatatactatcccaggaacagaagatgtccttgtgggaaactgaatagaggaaagagaaacatattacgttcttaagtcttaaaattccattgcaataatcgtcatgacacatatttttgagagttagggggcccagaggtaatttccactttcagattttacaggaaaatattctcataatgtattgcaagaataaggtgctattaacttcattacactttttattttatataatcaaatcattgaagtgttgagtagaaattatagctcccttacaatggcttttacatttttagactggaggaatcacagaataaagaaactcacagtccaaaaactgaaaaaagctccaattggggaaaacaagtttgtggtccttagtcacgtggcatgggggagggtttgagtgtatgtgtgtgcacacatatacatgtccatgtgtgtgtgccctggtaacacactgaaatattcattgatggtgatttttttactttattattcacccttttaaaggagaaagtgatacgtaagtgaaactgaaatgaaaaatatgtttcattgtgggggttaaaggcccagagagaaagacaagtgactacaagtttgcctccaccagtaggagtgtgcggagtagccgtatatacgttcacggcaagtacagtctactctctgataacgataaaaatcaccccagaaatcgagtcctcttcttgacccaaaactgttcagcccttcccagggtgctttttgatcagaaaaagtcatcatttcacactgtgctcttttatttgcaagactcattcccgggctgcccatgtagctgtttgacacttgtagctgtggtagtatttagctgatgagcatgctggagcatgagttatctttcttaccagctcacatttaagtaacaaacattctctttttaatttttgggaaatacatttagcttttaagcacagatgagagtaacagtatgaatttcttcctggtaccctcttttcttctcccccacaaaaggaagaaaaaacgtttgccacactgccacactaaatcctcagttccgacagcagtatagttttataagcttgtagaggaaaaaaaggacgtgcacacatccctgaattcaaccttcagcctcttgactgtttgtatccaaatcgttatagtaatcaagacttccacaacattcataacacaatcagtcaacaagcactattgaaaaccagctatggggatgtgctggatggtttccattttccctccagatccactctttttccttctctacctggccaatcatccctggaggatgcaccacatggacttgccttttggcatctggttgggtttagccaatgggagaaagaggtcctacttgtctcctagcaggagatcagaggtcgaggtgtttgttctcccactctcaccctgcttggtcatggaccacaggaactgggcacctttgcctaaagttgcagcttttgttggacaaccctctccccagaactccagctatagttagaaccactgctctatctatgttctggcaccttttcttttcccataccttaacgattcttcatagtaatggttcttggttgttgttagcccatcttttgttggtttgacttagctctgtccacaattcagtaaacagtccctttaccaaactctcctcagttagatgctttgagtgtgccatctctttcctggaaggtctccctggctgatacagggggataggcttcctcaagtgcttctagtttatctagggaagctgtcctaataagcaggaaaaatatcatcacatggaaatgaactgtgtggcactgacagtagtagatgctgaggtcactctgggaagatgtgag

SEQ ID NO: 2271 - DNA, 1350 bp, Homo sapiens
tatcactactcttgggctttgagcctttttaagtaaattaaggatcacctgaagccaaccactcagataccaccacaattgatctggtaacacacagaactgctaagtgactaacaggtggggtggtttctacagcgtggagatgctgaacagagggggcattcacatccagagcaggacacagtgggatggcctgagatttcatcatgctacttagaatcatgcacaagttaaaacttgtgaattgcttgtttctggaatttttcatttaagatattcagactacagttgactgcaggttactgaaatctcagaaagcaaaaccagggctaaaggggactactgcatgcctcctgccttgttaatatacagctcccctcatagagtttaattctccacagtattaattacttacaccaggagaatataacaccttcatgggcaggtgcctgaattcttttcctattaccatatagaataatatttacattgtgctttgaaaaatacagttgtctagcaaaaacagtgttattacttcaacaacaattcaaaaatataaatttaatgaaagagagaatgagaagttccactcataatatttggcaacatctgaggtttaggattgaagccttcaataaggagagggtgatgatgagttatccatttttaattatttttgtgcatttttttctgaggtataaactttcaaccactgtgactagaaaagagcaagctgtaaatgtgtgaattattttctgcctcagcacatttcattcctcataatattttaaaaatctaaaatttaacttacatcaagaaaaaaattcaataaaattacacatacacaaaataactggttaattttcacatttctctctcacctgtgcagataagttttcattctaacctgaatgtttttgttctctaatacctgaagccaaccactgatataccaccacagttgatctgataacccacagggctactaagtgattaacagatgccagcatgaagtgatcatggtaaacaggactgatttcatctcctatgcacctttgtgacctgatacactcaccagtgactgcttaggttttctcatcttctcccatgtttactttgctgcaggacaggaattaattacttctttgttataaaacttttaactcaaatagtgtctgcctacttatttgtcaattcagaattttaagaatatgtgtatatctgaaatataataatgaaaaggggatttgaacctgatttgtggaaaagattgagtcaatttggagtatcatgtgcatatggattggtttaaaaattaatttttaaaacacctcacttactaaataatac

SEQ ID NO: 2272 - DNA, 12602 bp, Homo sapiens
aacctcccaaaatgctgggattacaggcatgaaccaccgctcctggctggccatttttaaataatgatctaattactgatccagaaacagccagtttagtaacatgcgtaattaacctgggacaatttcagcaggctttacaaaagtttagaactcaaagactccccacaccaggaactaaccagcaacccaaaatcaggccaggagataaagtacttgttaaaacatggaaggagggatcacctgctgaacaattacaacccaaatggaagggactattttcagtggtactggccatgccttctccagtcaaagtactgggaatagttagttggatatgtctttccagggtccagcctgcaataactgaagcccccagacctggaacctgaagatcccatcagccactaaacctgtgaacctgtagaagacctgaagtacctgtttaaaaggcagccaaaagataaagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctcatatacaattatcttccttctaacttttcttgccagaaataccttttataactttctttacattgcttttatttaacgattacttttaccttgtttcataagttttaaatagccttgaattagataaaaaattattttcctttaaataagaacacatttctttttttagaaaaatatttttctgtaattttttttttttcttgagacagagtcttgctctgtcacccaggctggagtgcagtggcacaatcttggctcactgcaagttctgcctcccgggttcacgccatcctcctgcctcagcctccagggtagctgggactagaggtgcacaccaccacgcctggctaattttttgtatttttagtagagacggggtttcactgtgttagccaggatgatctcgatctcctgactatgatctgtctgcctcagcctcccaaagtgctgggattacaggtgtgagccactgcacctggcctaatattttaaattggaaatgacccagatgtttaatgagtacctattatttaacttaatataattttagattctaaattatataacaagtttaatcacaagcatttattccattacatttacctaattaatttttttaatagtttactcagattacttttgaaaactgagagttatcattgaaagttatttcccagttaatcatttttatagactgcgaatttcaggttttcctaagtaagaaacttaaggttagataaatggtttctttttttttttttttgccaataacttaggatttagctgttttcattaactaaacaatattaaatgccttatttatgaaattttacatagagataattttcctttgggctgcattcattgttttataaccctcatgccaaattttggcatctagcagagataaatatgaaaccactgttccaataaatttaaacaatagtgtatgttgacaattctgaagccattctaattctaattttatttcatgactactttcaaaaccagcttatttattaaagatatacttaagtcacatgaacttgaaaagacatttggcttaaaatctctattttctctgatacagtatttgatttaaagcccctttttttctttaagccaattaattagagcacttttacatgtttctagtagtgaaacatcatatacatgacacataaatacatagatgtattatacatgcagatagaagtagagcttatcatttcacaagacctctttttttcctccagttctagacttctaatttcttgatcttattaccctaggcagttgtcagctaagataaccctaaatttgcatattaaaggaactcttagatgaaaaaaatcagatagtgaaatttacatctcaaggtacagagagaaagagtctggtgctagtgtttccagaatttattccttctggtgggttcttggtctctctgacttcaagaaagaagcctcggaccttgcagtgagtgttacagctcttaaaggtggcgtgtccagggttgtttgttccttctggtgggtttgtggtctcacttcaggaatgaagctgcagaccctcatggtgagtgttacagcaattaaaggtagtgtggacccaaagagtgagcagcagcaagatttattatgaagagcgaaagaacaaagcttccacagcatggaaagggacctgagcgggttgatgctgctggctgtggtgaccagcttttattcccttattcgtccccacccacgtcctggtgattggtccattttacagagcactgattggtccatttcacagagtgctgattggtgcattttacagagtgctgattggcgcatttacaatcctttagctagacacagagtgctgattggtgcatttttacagagtgctgattggtgcatttacaatcctttagccacagagtgctgattggtgcatttacaatcctttagctagacacagagcactgattggtgcattgttatagagtgctgcttggtgcatttacaatcctttagctagacacagagcactgattggtgcattgttatagagtgctgcttggtgcatttacaatcctttagctagacacagagcgctgattggtgcgtttttacagagtgctgattggtatatttacaatcctttagctagacacagagcactgattggtgtgtttataatcctctagctagacagaaaagttccccaagtccccactcgacccaggaagtccagctggtttcacctctcactagtaggaggagattaaaaacgaatgccaaatcaaacataaaattatagaaatctatcataggattatattagaagactgactttatttatataagtagttctaaatttagtctgccttttaactggatctctgagctctgggcagagcccacactgaattccgggtctccaaaaagagaattattatgaggctaagaccatgtgatggttttatgagtgcactctccttttttttttttttttaacaaaaatgtttctctaagtgtctgaactactctcttcctaactttaaacacccaacagtaacctctgttgttactctttgactaaaataattattttagttaaaaaaaaaaaaaaaagaagaaagaaagaaaccaggtaacactatacaaaaggaagcagtgtaagatctgagacgaaattttctcttttacactctttgagttccataaggagaaacagaggttgctccccaaaagggagtctagtgccttctctgttttctttaaggaatcccagggtgttagaaactattttagattcctcatgcagcacagggtagcaagagaaagaagaggcagcagaagtaaaatgaagaaaacagaatttggttgacggagaagaaaaaaacttttgctcaaaaagttgaaggagagaaataaaaaaggccttaactacacacacacacacacacacacacacacaccttggatgttagcttttatttaagcttttagccactaagctccttaaaaaaaataccttcaaatctcattactgtattttagctagtacaaactgctgatatttcaaaagtaatgcaaataccaaaccagaaagggcttgatttaggaaccaaacttaggcagtcatgatgaaaataaggacagaatcttagtttccaaactgcagtgctgggggacaaccattgctctttcagtttggcctggttagcaaaagatggccttgttatgtaaataaagcccctaaggtagtcaaaatcaaaaaaaatttttttttccttttgctagctgtttttttcttttttctttttcagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacagttaagtgaaacaaacaaacaatcacacaatttatgtggtcactgagtgctctaatagtaaggagaaattaagaccagctggctgttagtcttaactctagccaagacaaaactccaattcagctacttacctagtaatgagtctcaggctgaagtctgctctctcccatcctagaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaacaaatttggggagatcagggattctctgggggtggggtggctcccaggcctcagccaattgtcctattggtttcagccataaagacagctcaggctgctaccacgcactgataggagatttgtcaaagatcgaggcatcttcactcagaatccctctgtgattaccaattgtgaacacaaaatatctgatatgggtctcagtcaatttagaaagtttattttgccaaggttaaggacacatccatgacatagcctcaggaggttctgttgacgtgtgcaaggtggttggggcacagcttggttttacacattttagggagacatgagatatcaatcaatatatgttaagacatatatcaggtggtccaaaaaggtgggatgactggaaacagggagggggcttccaggtgataggtagataagagaaaaacagttgcattcttttgagtttctaataagcctttcactgaatacacaatttacaggactaatcacttaagccttagcctggctcagtgaaacaacagggcaaaggaagcaatcagctatgcatttgtctcacgtgagcagagggatgactttgagttctgtctagctatcttgtttaggaatataatgagaggcaggtttgcgtgcagtttccagattgacttttccctttggcttagtgactttgaggtcccaagatttattttcctttaacatttacaaggagaagtgaagaaataagtaaattagagagctagaaggatggaagtttacagttagagagagtgggatgttgaaggtaatactggttgcatatttcttatccaaaatgcttgggaccagaagtgtttcagatttcagatgttttcagattttggaatatttgcattatacaggttcagcacccctaatctgaaaacgtgaaatccaaaattctccaatgattgtttcctttgagcatcacaatggtgctcaaaaggttttggattttagagcatttcaaatttcagattttcagattagggataataaacctatatctcagaaacggtacatttctgaataatgacaaattgtcattatttgccatgagaattgtcattaatgtgggtggagatggggatgattgtaggtcaagagactgaagcaatagggtaggcttgggtgttagtacggcccttcatgggaatgtgttgatgtcatccagggtcacgggaggcttctgagtgggaaggaagctgagagcctatgattacggtcttcactgatgaaggcagacagtaggaggttggcagatggtgggcactgactagactggaagtgccaagaacttcagtggagcaaggttttacccaagacacagaggttgtggtctagagcagcccagggatgaaggatcacccattggagaggactgtggggaaagcagagtcctgggagatgaaccaagcatcagttgaggctggaacagttaaaatgtatacatcaaattctctccaaggacactgtacccttggctgaaaattccctccttagtctacttcccatcccaaattctacccatccacactgtggcatcctaggtctctctagcagctgaacaggcaggcctctgtaacaactgtttcagcgctgactgagtggttaagttaaatattaaaagttgaaagagccagtaaccttatacaaaggctggaatagaacaaaagcccaccacaagtttttgcctaagtctttcctgtgccttgaaccatgacaagaggaggaaggaattcttaaccagacccatttaggattaagtaagtttttattggctgggtacggtggctcacacctataatctcagcactttgggaggctgaggcaggcagatcacctgaggtcaggagtttgagaccagcctcctggccaacatggtgaaactctgtctctactaaaagtaccaaaatgagccaagcatggtggcgggagcctgtagtcccaactactcaggaggctggggcaggagaatcgcttgaacccagaaagcggaggttgcagtgacctgggatcacaccactgcacttcagcctgggcaacagagtgagactccatctcaaaaaaaaaaaaaaagaaaagaaaagtttttactgggggtctgaagacacaagttttattggaggtctaaatgaactcctcaaacctccgtgatttagcaggagatgtgataagggtaatcaccccagcacttggacccatctagattcaatacatttactgaggctccagaagaaggtcttcacaccttagttatggattagaagaagttaatcacttacgtctttagatgaatgcacacttacatgtagacatatggcttagaaggtatataaaccctggaaagctttgtaattttgagttagtctggtgatatattccaggccttctccctgtacccggttacaaaaataaacttccttccttcccagttcaactgcatcttgttattgggccgcgagaatcagcagcctgaccctcggcttggaccaggaacaacatggtctgagagagctcatcccatgttccaaagggagattaaatgacaaattaagataccccaataataaaatgccaacaataagatgccctacagtgtaatagaaacaatgtaccattatgaaattcccagtaggaaatgaaagctcaaagactaaattcacttgccatttcaagataaaaagaaaatttcaggtccaaacttttttcctgcctcaatttcatattctgatcaggctcagccagaggatgtctcagtatttagacagagtggaggttcctgcggcaccatcctggagaggtgtaacattctttgggtggaaaaggtgaactctgctctcatatgctatctacttaaagagtctggaattaatagggcaccaaagatgatcacagctctgtctccacatccaccaaatttagaaaccaaatctgataactaagtcatttatcagagactcagtggtacccaagtgaggaagggccactggagacaatcttgtttttttcaccggggctggagtgcagtggcgcgatctcggctcactgcaagccccgcctcccgggttcacgccattctcctgcctcagcctcccgagtagcccggactataggggcctgccaccatgtccagctaattttttgtatttttagtagagacgaggtttcaccgtgttagccaggatggtctcgatttcctgacttcatgatccacctgcctcggcctcccaaagtgctgggattacaggctttagctacggcgcccggccattcccctcccttttctgctaggctcactgaactattaacgagcaaaaagtaaacttcccttttctttgagttattatacatttggggtctatttgttagagcaatgcgcttgccctactatactctccctgggccttgtatgatgaaattggtaacagccacaaaaactgcatctgggacacagaaggtggtagaggggaaaataatctgactgacaaagattctgtttataggtgactttttaggattgtggagttaggcaaagctgggatcactcacacagcctgataggggattttcctacgtgggtgggctgacctggtggtcctggttacactgcccaccagccttctggtgtctctactaggagtaaggtgccttctctttctcctccaggaccccacacctccagaccctgctgagggagggccacccatttctagtcccagctcctactctaactatctgtgtgaccttaaacaaggcctttcccctctctggcctcagtatccgcctctgaataatggggctgggcctgccgaccttctggcccttttctgctctgtgagtttgtgaacttgtgatagggagacaggagtcctaggaaggaaatggaactggtgatagggagacaagagtcctaggaaggaaatggaacttgtgatagggagacaagagtcctaggaaatggaaggagagcacgtttcactctgtccagcagagggcagcagctacccacaaatcaacagctgagcaaggccagggctgtgtgggagctatgcacaggttctgcctccagaagccttcagtgcctgcctctgagccagagggttccaagcagaagaggtcccgcccccggagagggacctcagagaggtcctccaagcccctctcagctcttacttacggcatcccagatgccctattcctcttctgcagagagaaggtggttcagccactaaatggtgctgggacctcgcagtttggtgggaaggaggaagcttactcaagcaaggaatatgagacaggcaaaaacccacgcataagccaaaagcccctccaaagcgaggtgttgttccaggctgacaagtgtccagcagggtggacttcagactccctgttaggaactgaattgtgtcccccaaaaagagaaagtcaccccagggtatgacctaattcaggaaaggtcattgcagatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacagttaaaagaatattggcagagaaacagccttggtgttccagcaggagtgaagaggaacaggaaaacgagtggcagtagccctgaaacagccacttctggtggttgccactcacctgaggatgtgagtcttggcaggccaggcttctggggacagggggcccaaggcacagtagacggtaatttttaagattatggatggactgttgggtactggttaagaattctgggtttggccaggcacagtggctcatgcctgtaatcccagcactttgggagactgaggccggtggatcacgagctcaggaaattgagaccatcctggctaacacggtgaaaccctgtctctcctaaaaatacaaaaaaattagccaggcttggtgatgggtgcctgtagtcccagctactcgggaggctgaggcaggagaatggtgtgaacctgggaggcggagcttgcagtgagttgacattgtgccaccacactccagcctgggagacaaagcgagactccatctcagaaaaaaaaaaaaaaaggaattctgggtttgaatcctgcctctccgtctgctagggatatgatttagggcaagttgcttgagctctttgggcctctcttattacatctgcataatagaggtggtattgtttgacttccatttgtgaagtttaaatgagatttttttattgttgtttttatgttaatccctagtacatggcctgctgtaaacacccaggacacccaggatatggtcattgctctttgattttcctcatccccagtctcaaggggaagccaggacaatgagaacagccacttgccatcaagagtcactgaaagggcctcagggtgggatggtggggggataagaaccatgagagaagtcggcacaaaggagttatgggacaaagcgtccaagataggcagaaaagaaaatgtagccagttgatggggaagaaaggaagtcagagggcttagacactgagggggacagaacatctccatgtgcattctcatctctggtagtcagcaacaggtatccacggggagggccctacatcatctgctaccctgaaggatctggaggtaagaggctctggggagaggtgcagtgaccctgcaggccagccctccaacctcctcccacagtggacacggcatgcccctctgccagctgagacagcccacacacaccccagccttaatgattgttctctctacctctcccccactcctcctccacctcctcgtctctgcatgcacctcagagcccatgccaagaactagcagtagtcctggacccgaggtccataaaaatcagtcaactgaataacaccatcaaatctttggtaagagtccagtggggtccccttattccacgctgccaatcctgggctccagtttccccttggggccctgaggaaaggagctgggggcacctggtgccaaggacaaatagggaactggggcgcccaggcctcacctagagggaccccagagcatgcagtatggctcttcttttgctgccctctttgccgactctctcttctccagacacccctggagaggggtataaacacctttgttttatcaacccaaagtgccattgatttaaagacacctctatttgagaaatgttggaaatcgtatgtcttagaattgatcaaatacaccagaatgtgagctgaaaagaaagcaccggacttaaaatttaggaagtcactggtgatcttacttggagaaatccatttcagtagattggtaagtgcagcactagatggctgtgagttggacaaatgggaggtgtggcattgtatgcagcagagatgcatggatggtgtgcagaccagtattgcaaaaaaattgtggtgatgggaagatgtgataaagctcaagatgtggtacgatttaaaggaaggtaatttttgtatgaggacaacttgagcctttgtcaaggctaaggagaagaagctgatggagagactaaaggagtatatgaggcgctgtggaaatagattagtggagggggcatagatatgaaattagtcagggctggccttaagtgtaactttttaacttattagctgacgttggacatctcacctctgtgagctcaggaggctcacaatctcctgagctttggtctcctcaattgtaaaagtgagttaatcatttccctaccttatggaactgttgtttgtattaagtaatttatctacataaagttcttggaacattatggtcaggacatagtagatactcaataaatggggtctactattatgaagtagatactcaataaatgggatctactattatgagactacgagagacagcataattgattagccacgtccaggtgggaagggatgggatcaagctcacaggttgaagaattcaccctgaaaaggaagagaaatccctctgtggtggtttgaaaagatgtccacagattctttgctatcccttccttcaaaagataggatctaattcctctcttcttgagtgcaagggatgcttaatgaattacctctaaataatagaatgtggttgaaatgacaatgttcagcttttgagagtaagttgtaaaaggcatgtgacttactccatgcttcttctcttggat

SEQ ID NO: 2273 - DNA, 1705 bp, Homo sapiens
gtcagtttaaatgtttggtagaattccttaaaaaaaggtatgagccaccacgcccggcctgtattcacatttttcatttgtcatcctcttcaattcccccacttccaataactgagaaacttaaaaccttaaaataaccacaaaactgcctaacaaggagcaacctctcttactagtacattgctaatgtaaccattaaatagataaaatactattcataatatgtgaaattaagtggaaagatgttatgtgtgtctgtgacctcccagtgttctaatgcttactggtaatcagttggttctctcatcttaagtatttctcctaaatcagcttcatttgtaaggtgaatggtttaacatagatctgttgtttgtatcaacaaaatgataatgttattcagaggtaggggcaagtccaggtcttgtgggggcttaaagcttatgcaatttagaggccttctttaataaggaatacaaagtgatccatgcaaaagtaagtacaggaccttggaaggagcctatgcaagtttggaccctgaagtttaaccttactggcttcatggtcaatctgtcttttgctcaaagaccttgaactgaaacctggagtgatgactgagaagaatatagcagggctgcttggctctttggaccaaaaaagagagaccattttctataaaccttgcctggctgacggtccaggttaataaagatgtaaaaatggtagaaggtgtgagaatatatctaagaacaataacaccaacaacaaatcaagggggattatcctttctaaaccttgactatgtcatctgtgagatgtgtagggaagctgcttctgccgtgtagaggccttgaagagtaaggatactggcaggatgcctgtgcactgatgttacagagtcttagcagagggcagaacggtctccttggacaacgtggacctggctgaactacagcactggggaccacttggtgcaccactgcccagggcatggttttgtttgtttgtttgtttggcttattgtaggatggcccagagattctaaatgagaggaatttaagtgggttccaagctgtaaaagattcctgcctcagttaaaaaaaaaagggtgaattgtgtcacaactttctgggaagaatgatcacgtgtaagtgaattgtaagtgcatgtctagattaatgttagataggggccatatatagattttcttgtatcaattaaagttatctttcttccctcaaaggtaggagaaatgctaggaagagctgctactcagggctttctgtttagcaaggaagaactgggggtggtgttgtattgacgagaaatatcttacatatttgggattcgtcagtgggcaggtattggttagagcgatgtgaaacttgaggcaataacatatgaggaagcacttggttttggagtcaccgacttggttgcaaatcctgtctcagttccttcttctctctggccccaggcaagttactcaacccctctgcactttaatttcctcatgtataagttggagataatacagaatacctcataggattgcgaagactacaaaagtgtaggtgtcaagggttttatatacagcctggcatcaggagacactcagtcaatgtcagctgccttttagtttaggaaggaagattttaaaatatacatgggaagataggattggctagagcctttaattgaaactata

SEQ ID NO: 2274 - DNA, 11961 bp, Homo sapiens
ggcttaggattgacttggcgatgcaggctcttttttggttccatatgaactttaaagtagttttttccagttctgtggagaaactcattggtagcttgatggggatggcattgaatctataaattaccttggcaatttttggaattcctccctccctcccttcctcccttccttccttcctgccttccttccttctctctctctctgtcttgtcttgtcttgtctttcctcttctctttttttttcttttctcttctcttctcttctcttctcttttttcacagagtcttgctctgtcacccaggctggagtgcagtggcatgatctctgctcactgcagcctggacatcctgggctcatgcaatcatctcatctcagctctgccaagcagctgggactacaggtgtgcatcaccatgcccagctaatttttgtatttttttgtagagagggggtttcaccatgttggtcaggcttttctttttccttcttttttaactttcagagggggtataattatttgtgttcctgaatatttatgaattttcttctaaacttattgttaaaactatttattgtataacatttttggatgcttttagtaatgtcactagcataagcagatgccagcaaaatgtatcatatcagtcacacataagtaaattgctacaagactcaagaagtaaattgtgaagaaaatttccttctgagggaaatatgatctcaaatgacatgttttttagtgttcaacttttattttagatgcagggggcacatgtacaggcttgttacatgtgtatattgtacccaggtagtgagcatagtacctaatagtaattttcaagttacattttatatttgtaaatagaatatttgattttattttgtgacttctactttatagaatagttttagatttatagaaaaattgtgaagacagtagaaagaatttctatgaactccatactccatgcttgtatttttaataaacagctgtgtatggttgtcagaagagctaattaagctcttaggtgcatctgttgaaattgtttccaaaataaaagggataatagacccattctatattgttcaggacagatggagcccagggaaatgtgtcttggcattctaaaaaagaatgaatggggaaccctggacactgttcccataaggagtgcatgaagggacttgggatatttaattggataatagaagattgaagggtatgtggcaactgtcttcatatattgcagagggtgtaatgtggaagcgacagactcggaggggtcagtggatggaagataattactcagaatatggaagtctatgtattgattacatatttgaaagtgacaggcctgttgtgtaggggcagagggttccaggttaaatctcaaaaataataatagcaggggctagtagtaatacattctgaaaaaccagtgtatcagaaagagagggaatactcccctctcttagatctgctcccctgggtgctgattgtaagtagctttgtatgttttattttagaaaacacatatagaaacacaatatttttaaaaaatagaattgtattcttcttattctgcaacttgttacttgtatttaatagtgtgtcttgggcctcttccttgatcttcattatattttataatggtcttaggattttattgttgaccatcatgcgtgactgcctttcccatatcaatgaaagtttagattatatataacttttgtcataaaaaaaaccaatgttttgaggattgaacatcctggttcgtgtatcttggtacacttattctaagtatttctatagtataaaatatttgaatttggactgctgattatgaggcctgcatattttagaatttgttaaaactgagaaattataatgatgagagtgtccatttctctgcaactccaccaacatcgttatcaagcttttaattttttctgataggtaaaaacaattcattttattgtgtaaattctttgtcagtggagttttgcagcttttcatgtgtttgtttactatgtttctttttgacctttaaaagttgttttgtgggttttttttttgttgttgttgttttgttttgttttgtttttttgtctcgctgctgtgtatgcagtggcacaatctctgctcactgcaacctctgcctctggggttcaagcaattctcctgctccagcctctggagtagctgggataacaggcacccgtcatcacactcagctaatttttgtatttttagtagagacagggttttgccatgttggccaggctggtctcgaactcctgacctcaagtgatccagccacctgggcctcccaaagtgctgggattgcaggcatgagccactgtgcccagccatgtgttatgtttttgctttttccatagacgtaacattttgtctcttatgtgtattacatagtttcttccaagatgtcaacttatagttcatttatggtctctgctttgtagaacttcaaaatttctgtacaatcacagttatatattttttctgggttgatatgttgcttagaaacacttccctaaaccaaaaacatgaaaatatttttttcatattttctttcataagtttctattcacatataggttatttattactcttgcattaattttgtggtatagtgacatagaggagtctacctttccccctctaatgaggtattgtcccatcacagtattgcataaatcttttttccaaaagtcagcttttatcacttaccagttctcattgtacttgagtctgttttagattgtctcttatattgatcttttagtttataggaaagctgctttactttttttttttttttttttttttttttgcaacacgtttttatctagccacgttaccaaactttctttctggttctaatagtttttccattgatgctctggattttctaggcaggttatcatataatctacaaatagtaataactttctaatatttatacttctttactttcttgtcttgtgtattagctagaacttccagaacaactttgaattgcagtgatgatgggcttgcccttattttgtttctgactctaaagtgaagaatgcctttagtgtctcactgtttcatttgctgttattatataatagatagcctttatttcattaagaaagtttccttggccaggcgtggtggctcacacctgtaataccagcattttgggaggccaaggtgggcggatcacgaggtcaggagattgaggccatcctggctaacatggtgaaaccccgtctctactaaaaatacaaaaaattagctgggtgtcgtggtgggcacctgtagtcccagctactcggtaggctgaggcaggagaatggcgtgaacccaggaggcggaggtttcagtgagctgagatcacgccactgcactccagcctgggtgacagagtgagactctgtctcaaaaaaaaaaaaaaagaaagtttccttttggtttatataaaccaggataattttaaaaattaaattaaagatagatgttgaaagtgtataatgtgtgaattgtaactcaataaagcagtaaaaaatgaatgttaaatttttaaaaaatggctttaaaaatattttggggattattttatattttttctccttattaataactacacttgtttttaaaatttggtaagaatgcttaacatgtgatctaccctcttaatgattttttaattgtataatacagtattgtggactatatgtataacattctatagtctatctctcgaacttattcatctggcttaactgaaactttaagcctgttgactagtaactctccatttcccctcgtctcatcccctggtgacaccattccactctttcactcttttatagtcatttgacttttatagtcaaaatgactttgactattttagatacctcatgtaaatggaattttgcattatataccttgtggggttggcttattttggttagcataatgcccttcaggttcatctatgctgtctcacattgaagaatttcctactttttttttaggctgaacaatattccattgtttatgtatgccacattttcattattcatctgttgatggacatttagtcagtttccacatcttgactactatgaatagcactgcagtgaacatgagagtgctagtatcttgttgagattttgatttcaactgttttggataaatacctagaagtgggattactggattttatggtagttctacttttaattttttaaagatttttttggtgaacctccatcctatattccatagcaggtgcaccatttgaaattccacctgtgcagggatttcaatttctctacattcttgccaacacttactacctttttttttttggataatgtctatcctgacatgtacattagagttgtaatctttctgctggtagaaggtcttgcttcaatggtgatagcttctgactgatcaggtggccgtagcaatttcttaaaataagacaatgaagtttgccacattgattgacccttcctttcgtgaaaaattgctctgtagcatacaatgctgtttgatagcattttaccaacagtagaactactttcaaaattggagtcagtcctctcaaaccctgccatgctttatcaaccaaatctatgtcatcttctgaatcctttgttttcatttcaacagtgttcacagcatgttcaccaggagtagattctatctcaagaaaccactgtctttgcttatccataagaagcaactcctcatccattaaagttttatcatgagattgcagcaattcagtcacgtcttcaggctctacttctaattcaagttctcttgctgtttccaccacatctgcagtgacttcctctgctgaagtcttggacccctcagagtcacccatgagggttggaatcatttttaatattatatgagaagaaaacattctaagaaaatgacagataaagtagaaaataagttggaatcaactgcttcccatctcttattgatgtcagtattttgacctccatccatgaatcacaaatatccttaatggcatctagaatggtgaatcatttccagaagattttcaatttacccaaatccatcacaggaatcactatctatgacagctatagccttatgacatatatttcttaaataacaagacttgaaagttgaaatgactccttgatccagcctgctttcctgcaaccttaatctccttgtcaatctctatcagagctcttgggtgaccagccgcattgtcaatgagcaataatattttgaaaggaatctttttttctgggaagtaggtctcaagagtgggttttaaatattcagtaaatcatgctgtgacagatgtgctgtcatccaggctttgttgttccatttgtagagtagaggcagagtagatgtagcataattctgaaaaaaggcctcaggaatttcaaagtggtaaatgaacattggcttcaaccgaaagtcaccagctgcattagtccataacgagtccattcttttttggatttttcataaaatcagcttttggttttattccttatatttatgaaagttgttctccattttattaatctctgcttacatgtttatgtccttagtttttcttttggtgcacttttgttgtttttctgtgtctaaagttcacatcatttattatcaatcattattgtgtcctagtaaatacatttaaagttataactttttctctgaagaaaatgcacactgtatcccatgatgtgtgtagcattaccattaatgttgatttctgtgtagtctgtgatttgagttttgatcatttaatccaaaatcacttagaagaatgtcttaaaatgtctaactagttttaggccaggtgcggtggctcatgcctataatcccagcactttgggaggccaaggcgggcggatcacgaggtcaagagatcgagaccatcctggccaacatggtgaaaccccgtctccactaaaaatacacaaattagctgggcgtggtggcacgcacctgtaatcccagctactcgggaggctgaggcaggagaattgctggaacccaggagtcggaggttgcagtgagccaagattgccaccacactccagcctggcaacagtgcgaggctccgtctcaataataataataatgataatgataatttttaaaaatgtctaactagtttcttctgttgtatattttgcctttaaaattaacttgctatttattgagatggatgttcagttttagtaaatgctctgtgaggattttttaaatgttcatttcttatttaggggaagttcaaagttacatgttatatcatgttattaatagtgctattctaaatggtctcttatttttctactttttctgttttcttagaatgctatcttcacatgcaacattaaaaatgaatttttcaaaattgtctcataattttaatagtgtttgctttatatagatagtgctgttgttcattgcatgattattataggattgtacttttattataaaggatattctttgctttacttagtggttttttgctgtaaatttttctttgtgtaaaattaatattgccacctctgctttcttttttatagattttcctggtttacctgtatttatgcttttttttttaacatttttgtgacattttggtttaggtatatttctcattgttagattttttctattcaaattcctctaatactcgttttctaattggtgaatttaacccattttcatattaacggtgataactgctgtgtttgtacttctccctgccatctgattttatgttttctattcatcatgcttttcaaaaattattttcttgatacttgctgaattgttagctatatcccatttctatatttcctggtggtttctcttaaattattagcaaatatattcatcttgatattaagaattcatcagcatctaaaacctgttaccaccaacgatagtagctaacagttattatttcctgtgtgtctgacagtattttaagcttcttaccagtattaactcaataaatcttcacagtcaccttgtgagaagggagtcagttattcccattatttacagatgaggaaaccagtaagaaggtaagtaattttctgaaaggcacacagccagtgagtagtggaggcagaattcatactcaggctctgtacctagagacctgcttgcttcagcactgagctgttggaatatttctacttgtccctgcctagacaccctctccttccaggttatgctgaaatttactttctagattgttgtcttatctgttatgttttaagaagtctctaaacatttacattaaagacaccagcaatctttggacttgacttcaaattttactgatttatttttccttgacatgtagaattggcatgctttctgggtgctttcttacctgaaaaatggctttattttgccctcatatttgattgatagattggttaatagatatttgtgagtttcattcaacattttgttgacattgcttctttgtgttctagcattgagcattacagatgaaaattcctatatagtttttctctctggaaattcataaggtttggaggggtgatgtgtgtgttgttgttgttctcttattctttcactttagcctctcttttttgaatttctgttattgcttttatcatattatctatttcttttctttctgtgttctcagagaatatcatcactgagtctttaatactgtcagcttcagctgtgtgcattttgctcttcaactttcttttgaggctttaaattaggcaaatatatttttcttagaatttctgaaaactccttttcactggagcttattttaattatatggatgcattatcctcttaaacttctgtgaaaacaataattggagttttcatttgcattagctgtttcatgaaaggtcaagttttttgcttatttattttgatgtttccttttcatgatattcgtgtcttgggatttggttgtatattcacatttttaattagctacttgatttaaataaagtatcagtagttactttcagggttcttggtgattataataattactcacctaccaggcttcttccttgcatgcagctcactacaggaatctgttgtgcctagaagatttcgggacaagtggggaaaccacactccgttaactgcatacacagggaaggagctacgagggagatagaataatttggtctctactattaccttaagagaccttcccctgtcttcgatttaaaaaaaaattactgcatacaaagggtaggagctacaagggacatagaataatttggactccactactaccttaagagaccttcccctgacttctcttttaaaaaacctatgggtctctgcacccctgaacttactttctacacctatttctctcttcacccccaaaatccatattagaatgcccctgcaggctataaagcctttcataaaagtaaaatacccagtcttttcaagagaacaataaaataggcagtctcctacctcttgtcttactctaatataaactccatgaagataagtattgtctccatactgttcatgctgcacagcagttgcccttatctgcagggcgacgcatcccaagacccccagtggatgcttgaaactgcagagagtaacacacgtgattgccaccatcggaacacatttctgtgcacgtcttccacccacagatttaatgccttttccgtcttaactaagcactcatcatggactgtggccataacttttgcagttttagatgcaacagcaaaactaacattaatttttccttcttcttcacaatttcatgggtagatttgttcttaccgtagatcttagcaacctcagcatatgatgttttttcttttgagaactttcaccttttcccttaaagaaagcactttacagcttctctttgacatatctcaactgccatcatcactgctcttgaactttggggccattattaagtcagaaaagggttacttgaaaacaagcactgagataccaccagagtccatctgataactaagatggtaactacatgactaacaggctggtgacgtatacagcatggatatgctggacaaaagggtgagtcatgtcccaggtaggatgaagcagggtgacttgagatttcactattcagtgtggtgcacaatttaaaacttaggaattgtttatttcctggaacttttttcatttaatatttttggactgcagttgaccacaggtaactgaaactgtggaaagtgaggatcagaggataagcagggactgtggtattcatttcattgcacagtgcctagaatacagtaggtgtactataaatattttgtaaagggacaactttgctgaaactgaaaatatttatgttttacccaataatttttcttctggaaatttatgctacggaaatattcagagatgcttacaaagttttatgcatgagtgtccgtgttatttgtaattgtgaaaaatgaaaataactcaaaagtttaacagtggtcatctaaagtactgtatacactgtatatataggtcgaatagaaggtcatcctattcatttattaatgagaggtacaatctccagggatctgtaaaatctattttgtcttaaccaaagaacaaatttttgacatatcttgaataggatgactataaattatgactataaattatgactataaattatgactataacttttaaattgttataatttttgtactattatctgatatttttatttttatgtatgttcctaagtagtttagagatagtcacattttaaaaatctaagatcaaacaaatgaagcttatttttatgtattcatagtataaaagaccttcagtaaatagataatatttttgttttattctagaaaacagctccttgaacacagtgagctggcttttcacacattgcagttgttagcgtttactgcccttgccattttaattatgaggctaaagatgtttttgacgctgcacatgtgtgttatggcttccttgatatgctctcgacagtgatgtcaatacaaggttatgcaaacctccgtaatcaatggagcataataggagaatttaataatttgcctcaggaagaacttttacagtggatcaaatacaataccacatcagatgctgtcttcgcaggtgccatgcctacaatggcaagcgtcaagctgtctacacttcatcccattgtgaatcatccactttacgaagatgcagacttgaggttggcagctgatgagtatttcttcaagactcacttggcgactcccaattcttaggaattgggaaaatttttacacacacacagacacacacacacacacacaaactcatcctcattttcgtactggaagttaaaaaaaaatgacaataaccatccagaaatgacaatatgtacctgttgcctctggagcaagcagacctctgaaaactgaaaaatgcaaaagccagttttttccaaagtgacaaatgtgtcacatatttatgatgtgtgcgtgtattccagtaaaactactaggtagttggaagagtaggtaggatggattttactcacagccatggtttgccaacccctgctctacaccacaagccccactctgatttaagaaatgatttctagatcttactggtggccaatgactagctttttgtgacaggtagaaaaagtacatgaaagttgctattatatagtacgtgctttcatgaaaatttagagtatttttgctagtcgattatgagaactctagtttccattgatgtctaaaagttttgctttccttaaatggctggtttaaaaaattattttggttattctagtagttgtcagggtaatcatttttaaaagtggatttttggcctattgttagaggcaaatgtttaaattatttaaaagttttaggtcttctgtctaggagccagggcttggagtcagacaccttagaagtgtacctgatgctctctctgttctactgtggtgaactggcatggaaaccactgtggtgactgagcatcccatatgcttgaaattctaagcaacatccaatgcataagtgatagtttgtcaggattttgtaagaattcccactacggtcaaatcacctattgtaccatattttggtgaccatccccatttctcaagattctgtgaaggtgcttttcctacctcttctgataccgtggatgtccattgtctaagtgttctacttgatacactaaatttcaattcatttatttgtcagagcttctttagatgaaattaagcattgaaagatgtgttttcactacattcagtctctgtcagaatatattctctgaaaactgtgtgaattatgagaagaaaactgtatatcctaagctgctctctgctacccagtacaactttagactatcttatacagtaatgagcagtatatgcaaaattaaattgctgtaagttttattacattcaaaatataagtaggaatgtggaaactgccatccccaaaatagttgatgctgttttgagtcatgtatatcagtgttccatccagtgagtattgagatttcaatttgctagtaagatttttttagtctattctattatcatttattttaaaatcttttaaactattgtttaaatttaaagggctcggacaaaaatagtttattctacatatagtcgaaaatctgccaaagaagtaggagagaaattgttggagttacatgtgaattattatgttttagaagaggcatggtgtgttgtgagaactaagcctggttgcagtatgcttgaaatctgtgatgtggaagacccttccaatgcagctaaccctcccttatgtagcgtcctgctcaaagatgccaggccttacttcaccacagtatttcagaatagtgtgtacagagtattgaggg

SEQ ID NO: 2275 - DNA, 6716 bp, Homo sapiens
agagaggtcgcgctctttcgcacactccctcgccaagggttaatttctcaaatcgcacgagggggaggagatttccctgtagacgagtaaaaagggtgatggacaaacgtgcgggcactaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcaggtgctataacaacttgaaacagctgacattatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactagggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagatggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaatggtttgagcagtgaacaaagaatccatgcaaaccaagtcatgactggaagaaatggggagtgggggacagtgcaggggaggaaagctgttacatctatgttaaatgattgtgagcagtctataatgtcttgatgttggttcataggtgagacacaactgatggaggaatgtattataaattatgcaaaatctgacatgagctgaaaagacaggtccttttataagagctaatagatgcttaggatgcaaatgttattttgagcttcgcaaatacatgataccgtgcaataagccttttttccttataacagaaaatgagaataattaaaatgaggagaaggccacataacagttgacttgaatttaattgaaggacccattggaggctcatctggttgatttaattatttaattgagtgatttattgcagatctcttaatgcaggttagaaacggaagtgagcataaaccttaaaaagactctaaatgatgcttccaaagcactttcattttggtattaggttcatgtttgtttgtctttacttgtaaaataatttggaatttttgtttacagggtgaatgtcttaatagttttaaaattagctaaatatatctaaaggcatttccaatgtttatcatgggaggaaaaaagccacattttttttaaaacaaaacaaaacaaaacaaaattttggtaatataggttcaatacactgtttttaacatctcagcttagccgctttaatcatatcaagatatgaggctggatcactggcccatgacaaatctgaaacctaccagagaattgactgctgcatagataatcctgctgccagttaacattccagaaaaacttgggcaggcaagtttttatagctgccccactatgctgcaatagagtatctttctattgaagattttccactgcatcccgatcctactatggtgaaagcattgttcttgggctaaaaaaaaatcctttatttcatacacacatgatttcatacactaggtctgagcatcaagccaagtccatgagtttgcaatgaagttctagtgagaaatgctctattcataaagcagggggtttacgtggaccttctagtgttgcttatgggaaaagagtaactaccatattacatctaacgcaaggccaaagtaccaaattaaaaccatggattgaggtggttattcgaagtcacttactcccatccttctaattatgctccactacaaaagtaaggggagaagagggaatactttacatgtacattgctagagggaaaagaaaggcttgattatatcccctcgcttctccacctctctgctcatgtaaagaaactgatgagaaaagagactaatatgtctagactgagttagaaacttcatatgagtgggttttgtagaattgatgggaaagacagtgggaacctagaagaacagaaagagacccacagaatgtctttctttttttttttttttttttttttgaggtggattcttgctgttgttgcccaggctggagtgcagtggcgcgatctagactcactgcaacctccgcctcccaggttccagcaattctcctgcctcagcctcccaaatagctgaggttacaggcgcccgccaccacacccagctaatttttgtatttttagtagagacagggtttcaccatgttggccaggctggtctcgagctcctgacctcaggggatccacccgccttggtctcccaaagtgctgggattataggcgtgagccaccgtgcctggcccagaatgtttttttaaatcagatgtagcatcttcataaggtaaagcctgtcacatcagagtaacaaagctcctggagtacagtgatgctagagtagaatgttccagaagtctggccatagccccagcttctgaattacctgggagagacaagatgctcaggttactattttttctttattctgatagtacagcctctactcagagaccacggtgtgtgtcacacaaccgaggcagctagggcatattctgagggcttttttttttttttggtttccttaatgattctttaacagagtaactggattggccaaggtctgattcaagaggctgtgaggagagtagagaacaaatagactttgcctctcagagttcagagctttaagttgtataagcatggtccatgtccacctcttgtagacacttattccttaaaagtttccatcatgaaaaataatatcatgtcaaaattttataagcacccagaatgtcccagtagtcaaatgtagtgtctttctccagtctctgttttcgataataaataccttgctctcaatttaggatgatcgtaaagcctatgttcatgctgtgagtcattgtctcccacagcttttgaaacatcgttctttgtcttttctatacaacacctgattctttgtgcctcagactcattgctatcaggaagagactttgccaagatccaccaccacatttggccagtagtgtatacacattaaagtgagagctgatgaaatcacaatgctctattttgttccgacaatcagtatgaaggggtaggtcccagtttgccaatgagcaacagcctctgtatgctggtgtccaagacttacacaaaacaagtgtcagtgcagtcacagcattttcttgaatgctgttgtgacagactccagttataaacatctgcgagccatatggcacaactcatagctaaagaggccggtacagggcacatgcacagagctttgaagaacatacacaaacctgttgaatcaagttactttcctcatcctcagagactttgacaattcagagctcacagatggcagggggaattctcaggcttcccttcctcctgattgacactttttaaaggaagtgatgtggaagttgttctagaagttagatggacagtgggagcacattcgtgagtggggcttgggagagctcaaaagtggcactttgattttaggctgggcaggcagaagtctcacagtaaaatatatttcactagacgtccaaaccaacactgcattgtagtaacctcttctgaagtaactggttaaattaataactggtcccataagtcagggtcaagccacatttataacccattcgggccggccatgaagggttctgactcgacattggtatttaaatgctgttactttcccaatgcttagtagcacttgagactttatttccatcgacaaaaactaagaaggccacagaagtagcctaacagtcctccctggtcatactcgtttcaaacaggtctgcctgtctagacatattcaggcaggaggttgcttgctgctatcttgaaaaccactggaagattcagcttcttggggacctcagagcccatattcatatggaagcccacccatataagcctcacagagcaaatcacagcaatgttgaagttgttattttcaagtgcttatttcacgacattaaaaaaaatattttttcctggtgtattaaaattaaaaataaaatcataacttttgatttaaaatcaaa

SEQ ID NO: 2276 - DNA, 1072 bp, Homo sapiens
ctttcccacaatagaggagatacaaattttggtctaggcttatttgagtgtttttactttgagttgtatatcatatgagtgtgactaataatacctctgtttaaatgaatctttaatacatcagatgacttatcatagaaatcatggaatcactctgttacacatagcatgtggttttttttatttcttgtacacatattttgatatcatacactatttttgcagagagctatttccttatttttattcgtggctctataattagactaaaataatattagaaattgtggaaatttaactagacatggtatcatgtccatgtagtcccacctattcaagagatgaagccaggagaatttcttgagcccaggagtttaagaccaagcttggcaatataacaagagcttatctctaatttcaaaaagtcgtggaagtttagaaatttaaattctgttctcaaatctgtattagagaaggtttacacagtgttttccaagccttttttatttagagtatactttaaactctttatttaattgaaaaatatgcattttgtttaaaataacctgtttgataaacagatactcttcatattcctatggtcagactttaatttcacaaggtttttgcattttaattaaaaggaatccactcagggtctttgtatctcattctaaatttcaaatttcagaggcttttgtgcttagttattgaaaaaataattgtaaagctcctgcattactacgagccacttgaaactagaaaacctatttgtatgtatcctggaatacacagaataaggtcttgcatgtaagaaacattttaatagtttttaatgtgaatcaacaaacagggaaatgggcatttttttaatggaatgttacaggtaacataatatgcataagatatctaataattaaatctattaaatgtcttgaatgttctgaatttatcttttcttctaatgttgagaatctataagttgaggtgagttatgctgagaaaatatgtcatagaataaaatgaaaattggaaaagatggaaaggaaataggaaaggtggatacagcatg

SEQ ID NO: 2277 - DNA, 3177 bp, Homo sapiens
gctgggccgccccctgggcagggcagggatcggtgaggcaaggagctgaggagcgctggcaggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatctgtgtcatgtgttattttattctgaatttggaatcatcaactttcatgacttgaatgcattgagtccagtcaaataatgaaagaaaattagtttgtttttctgccactaaatgcatttgaaacaagattgactctgttgagcttaaggaatcgttttagcaagagtagatcaccatttacagctggttctcagtgctcttttttttctttgagacggagtctagctctgctgcctaggctggagtgcagtggcacgatcttggctccctgcaacctctgcctctctgggtttaagcaattctcccacctcagccttccgagtagctgggattacaggcgcctgccaccacgcccagctgatttttgtatttttaatggagatggggtttcactgtgttgtcctagctggtcttgaactcctgacctcgtgatccacccgcctcggcctcccaaagtgctgggattacaagtgtgagccaccatgcctggctgctcttctgtctttgaatgctgcagactccttcatctttcttttggtgtgataattgctcactagagcgtccttcaggttagggagaggaaggcacctcaatgtcatgcatcgccaagtgttaacctgtcaagtacaccctgggtcaggaactggggtgagatacagagaaggaggaatacgcctgcttatttcctctgttgaaaggagttaaaatgagaggtggcaattaattgccttcagcacataactggtcagtggggacaagaaaattaaaagcagttaagaccaacagagttaagtctggatcacttgcaggaagttcctttgaggctgttccatgcttacagtgagttgaacctttagatcagctgttcttgaacctggccactttaagaatcacctggggaatgtttagaaaaatactgatgcctagggctgggcgcggtggcccacgcctgtaattccagcactttgggaggtcaaggcaggcacatcacaaggtcaggggattgagaccatcctggccaacattgtgaaaccccgtctctactaaaaatacaaaaattagccagacatggtggtgcgtgcctgtagttccagctactcgggaggctgaggcaggagaatcacttgaacccaggaggcagaagttgcagtgagccgagatcgtgccaccgcactctagcctggtgacagagtgagactccatctcaaaaaaaagaaaaaaaagaaaaatactgatgcctgggctccagcaccctgcatgcctagtctggatttaagtaggagtgaggcgtgggcgcctctatggatcgaggaagcctcccaggtgattctaatgtgtagaaatgttgagatacagtccttcagctacatagtgttcaaagcgtggtgcgtagatcagacatggacaatctcaaagcaccccagccttgctgaatcagcccctgcctcttaagatgcctctgatgattcctttcacaaagcttgggaagcagctttctgtcggcccagtgcctagcacttggagaccacctctccatagagggctaccaggatctccttcagcactgcggaagagtgggccccagggcatgattaggagaccccagtcctttcagaatgggtcaacaatagcaagggagtgaagctcgaaggacaagttcaggcttgggggaactcatggttcagaatggctcccttccctgggttgctgcctctaggctgttctggaactgcagtgattcattgtgcttttgagttttggggctttcatctcactattgctggatagtctgtcagagttagaagtggaatgagtcgaggcaggccaggggcctctcccttgctgctgggaagggccagcacattcctcgttcctatgatgaagatgcacgtgtatacaataaccaccacatttcttggtactccacttaaaacatgtaaataaccc

SEQ ID NO: 2278 - DNA, 3538 bp, Homo sapiens
gtgtgttccgacaccgccgcacgaccgctggcttctcccctaccctctcagggctgcaggtcgtggtgtgtaatggccgtggtttagggctcggcataaatccacatttccttatcagaatcagatcttggtggcgagctgcatctgtgccaggtgccattagccttaaagccccctcctgccccaggagtgtcctttgttttggaaggaaaacttactcagagcctaatctgtaaaccaaacctatggggaatagtgggagtgtggtggggcctgagctctgagcctctccctccccatgaggaccccccacaccccaaaagagctccgagtggagacccttggggatccgtttgtcctgggttggagcctgctcagcgtcatagtcacgcccggggctgggtgcagcctccatctctaacccatgtggtcacttctgctcctcccagagctctctgcagagtttcaggttcagccttagctctggcagccactgggtagctggggctgtgttcccactgctctgggatcccttccccaccaggagcagaggccttcctgccacagaactttaatgacagccacatgaagtgtcatccccttgcccccccaaaaacacacccgcccctttatttcctgtttgctccttaagttaccttaactactttatgcagaaactggaaaggtgtgatgaggaatgcagcctgagatgctgaaaagaatgactggctttggaaatgggagagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaggaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaacctctggtcttttcgtgggggaaagaagagtctttaattgatgtttacggcagatgcgccacggagctgccaactcaccacttcattatcttcctttcaacaggatgttcaagtacagagtgtctagtgcctgcatttggg

SEQ ID NO: 2279 - DNA, 22956 bp, Homo sapiens
cgccgtcgaccccacgccacgcagaggtgaagatacgcaggacgtcctctaaagcaacttccgtgggtgccaggttgtgggctgggggcggtgctgaccttgagagagcggaggaggcgcaggcgcagcacaggtacgtgggcgggcggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcgtaagtactgacagaatacctggagggaaggtgggactggagaatagtttgtgaaacagatcctgctgaggatgaatccagaacttcctgaagggttccgcttctgctgtgtagggacaaggttgtaaatagacaagccacaggcacctgcaaatggtaagtgtggtagagaggggctggaattgcctgttggtgtatctgtgggaagcagctgctatccttgaggaagaaaagatggagaaggtaagtggctatcaacctgtcagagacaacacattctgtgaagttgtactctttcatttctgacactgtggttcttaatatctgtcctaaacctggcagtcattgaggttcgcaaagtatctccttctatgtgacagtaaaactggaattactatcagaatggaatccattcctgctagagtaaaaccatgaaaagaaatcgcagttttgattatctgcttatcatttttaatagatcacagagtgcagtgttccttatttgttgtatggcaagttgatgaataactcttgattaatatcttttaatgttctgtttcacacagttctctcaattacatgtgaaaaatctgttatataagtaatgctatttaatgattaaaatggatatatgttttaaggtagtgccacccagtcttttttttttggtagaataatattattatctattggttgcctgccttgaagtacagtaatttctctgtttccattatttaaaataggtgagtgtctttgacaaagatacaaagaaaggggacagttatgaaagggaagaaaagatagatggagatgaaaagaaattcagtagtttcagcaagggaattaggagcataatctttgagaaaagtcttggttgcttaccattcgggctttgtgatgagttgaaatgtcctgaatgagaactgttctcaaatgctttcaagaccaacaaaaagtacgatacccacactgacctggaactctttaaaccattaagatatatcactttttcgcagttcagtccatattttttgcaaaatgttctgcttagtttttctgctaagaaattactgtttctgaacaaggttaagtgtcgtatgctttcattgtagttttttttcccctaacatatactgttttcctaattagactataaattcctccacagctgggaccttgttttgttttctcgccttccccataacaaatatcatttaagtgaatgttgtaaacagttacttcatttaaattgcccttaaaatgctttatgacaaagacgttatttgtagtaatacctataatggtaaaaagtttgttgcagtcttacagacgataagattgatcaattgttatatatgcttagtggaattttatctagctgttctaaagagccattagactagtctttctaatggaaaatgtttattgtctaagttaaaacagcatttgaggccaggcacagtggctcactcctgttattgcagcactatgggaggctgaggtgggaggatcactagagcacaagagttggagactagcctaggcaatatagtgagacctcttctctacaaaaaatttaaaaattagctgagtgtgatggggtgtgcccgtagttccagctactcaggagactgaggtgggaggatcacttgggtccaagaggtagatgttgcagtaaaccaagatcatgccactgcactgcagcctgggcaacagagcaagatcctgtctcaaaaaattaaaaagcattttatagactgcatgtttgtgtcccccctccctccgcaccagaattcatatattgaagccttaatctccaatgacatgatattagtaggtggggcctttggggggtgattaaataataagggtgaagccctgcatgggattagtgcctttacaacaagagaccctagacagcttgcttccactctttctttgctcttcaccatgtgaggacacagcaagaaaacagacaactacaaatcaggaagagggcctaatttgtgccaaccatgctggcactcttctctaacttcccagcctccagaactgtgagaaataaatttctgttgtttaagtcacccagtttatggtagtttggttatagttgcccatattaagacagcaggatgcaaaattgtggccagtatgattgctttgacatgaaacaaattttaagcacaaattgcaaaaagtaaccaaaatatatcaatccccactgctggcattaacactctaaaacaaactttgtatattgggggattttatttatttatttatttattttttttgctgaccatagtgactcatgcctataatcccagcactttgggaggccgagttgggcagatcacttgaggccaggaattcaagaccagcctggccaacatggcaaaaccccctctttacaaaaatataaaaattaaccaggcatggtggcacacccctgtagccccacctacttgggaggctgaggtgggaggatcgcttgggcctgtgaagcagaggttgcggagagctgtgatggcaccactgcactccagcctgtgtgacagagcgagactatctcaagaaaaaaaaaaaaggatgaggattttttttgttttcaacatgctttttaacatccactatattactctcatctttctaggctggaaaaaaaaatgttttaaatgttattctgaagtatattgcaacctttaacaattcagtagacttctgaatttttattttcatgtagcttaccacagttgtatctaggaatatatcacatagctgattaattggtgaaataacccttgcaattttacacaggttgtacagtgcacattttcaaggaccactcacatacatccatttgatattttttggtatcaagaaagtctttaaacaatcagtaccaccaatagcagtaaaaagacaaaactgtctgaaagtacctatctgtttaaaactttaattagctttatccatccattaaatagttattgaatataaaactgtatcattcactcttctacactctgaggaaatagtggtaaataaagcagatattgtccctactatcaggaaatttacattttagtagtaataagccataaattaacaaaaacagaagacagtggtaagtactaggcatgaaattcaaacatgactattttagattaggtgattaaagaaactaaaataccatttaagctgctgtgtaaatgacaagagaatccagctttgtaaaaattggtgaaccctttgcttgcagaagggacaactgcaaaatctaaggcatgatctagcctggaatatttcaggagccaaaagaaggcctgcatggttagagaatagtgacttaagacgcaaatactgtaactttggagggataggaaagggctagatcatgttacctttgaaagacaggaaagagtttagattttattctatgtgcaatggaaaaaaaaatgagagcattttaatccaaagagtaatataagataatatatttttaaaatccactttggtaatttgttaattggcataaagagtcagctttcatgtaacataattactaacatacttggatttaaatttgtcattattcttattttatttgtcccacctcttatatgttcattttgtcttcttttgcctttttgatttttttttttcttaattaggccatagcacctgatattcccaggcagactctcatccaagtgccaatcagccccagccctgcttagcttcccagatcagatgagaacaggcatattcagggtggtatggctatagaccttttagattatttttaattattccattttttctacctcataagcttgacagatgtcttttagtatctttttactgttcacctcaggtattaaaacatggaaccttggtttatcatctttaagataatttggtattatacttcttccaggacaatgtaaggacctgcgaacacatcaacttcatttactgccacacctcatgttatatacattgtatattcttaatatgtatttcctaaattctcaagacattttttatacaatatgaatttacatttcatattgtataaaacatttactttttctattgtgtttcgtggttcctggaatctgagcttccatctaagaccttatttcttcttgaaggacatactttaatatttcttcgaatatctactggtaacaattcattcagattttctgtcctgacactgtcttattttactttcattttctaagaacgtttttgctgaattagcagctattttatcattttgaagatatattttattccttctggcttccattatgtcctctaagacataatgtccattttgtttttttctcttcaaaggtaatctttttttggatggctacttttaagaggtttgtcttaagtttggtgtgcccacatgtgttttgtgtttgtttttttgtgtgtgtggtttttttctgcttcgagattgataatgtttcttgaatctggctgtgatgtccttaggctgtttgagaaaattcttagctctgtttgatcagacattgcttctgctttcactctcctttctcctcttcttttgatactccacttacatttgtatttgacaattcactttgtcccttgtattttccatttattttcttgtctgtttcatcctgaatatttcttcttaactttcagttcactattttctcttagtagtctcgaatttgttaaatctctcttgaagcatttattttagttatatttttggttatcagttcaaacatttctacttgattctgttttattgtttccagttgtttatccaatatctcaatcttttatttcctcaaacatactaatcataattactttaaaacctgtatctaataactatggtgtctgctattatctgacacttttcttgtttcttgctgttatcacattgtcttgcttttatgtcccttatttttatgttattttgtattatttattttataaacattataaatatataaaacttggcttaggttatgttttaattgaatgtcagaattgttttgattgaactgtatatgaggaaactatactttgaagtccaatatgatggtattttctaaagaaagaatttatgtctcctggcaagacctttggacactagtaatctaagatcttcttaatctggttagtgatagagacaattagaatataggcaggtctatttcctgttcatactttcacaatgtagacctctgaagtcccaactcaagcatgcagagtttaccagatcaggccctaaacttcagtttttgtctttttaattctatgggttagaaactctgttcaacttttcagccatcacctcaggaatcagaagatactccagaggaaaagctaatgtaaatgctggattcaacaactctgttttttccttctgaatatttcattgtctctaatgctgtcagatgtttgttttatattttgtccaagctgagtgtggtggctcacgtctgtaatttcagcaccttgggaggccaaggcgggaccatcccttgaggccaggaatttgagactagcctaggcaacataacaagacctttgtctcttggaaaaaaataaataaataaatattattagaagtgaaaatggggatgttgttacaaatgctgtggagattgatgagaaattatgaacaacttaataataaatgggaaaatataaatgaagtaggcagttccagaaaatgtaacttttcaaaagccatgtaatggaaaatataaatggtgggatgttgatgtaagaaatcatgatgcccagagacttttgccaaaccttcaaaggacagatcattacaattttacacaaaccattccacagtatattccacttatatactgtggaattggcccttactgcccttatcaaatttaacatcaaggttacagaagcttaatattactgccctgattttattagggcagtaatgatttgataagggcagtaagaattacagccctgtcatattcgcaaagacaaaaatcctaaataaaacagaccttagaaaatgtgtttttaagaaaagataataaaacatgatcaggttgaatttaacccaggaatgtattttagtatattaagagattagaaaaactatctggctatctgaacagatgcaggaaaagaaaactatttgaaaaaattaacagacatagataaacctttgggcaaattagaattgtgtagaacttccttgagccaataaaacctacaacaacaatattttaagatgaagtatttgaagcagtccattagaatcaggaacaagtactatgttggagatcctagccagcattataaggcaagaaaaacaaaagattaaaaattgtaaataaacataacttagtctacagataaattattgaagagctttgcaaggattctgaatatactattgatatggtttggatctgtgtccctacccaaatctcatgttgaattgtaatccccaatgttggaggtgaggcctggtgggagattggatcacgggaatgggtttctcattcgtggtttagtaccatcctcttggtactgtccttgaaatagttcttaggagatctggtaatttagaattgtgtggtacctctcccctctctcttgctcttgctccccctttgccttccaccatgattggaagcttcctgaagctgcctcagaagcagaagccactatgcttcctgtacagcttgcagaaccatgagccaattaaaccccttttctttataaattactcagtctccagtatttatagcaatgtgaaaacagataatatgactatcaatatacaaaagtgaattgcatttctttccagcagaaatgaactgttagaaaatgatttttgtaacataccatttactatattcctttaaaaatataaattaggtaacttaacaaaaggtatagaagacctctgtagaaaattacaaaactttattgacaggcatttaaaaatgtctaattttaaaattgccatgttcaatgattaaaagactcgagttaagatggcagttctccactacacaatgaaggtaattgcaatacaaatcccaaatgagtttttcaaggagcttgacaaactgattctaaagtctgtatgacaaaaagcagaattcaggatactccagaagcagatttaagatagaattgacttgtagatattcgtaacagcaaaaaaataaaaacaactcaaatatccatcaaaagataaaatgtttatccatgaaaagatactcaaaaagtgacacctttatataatgggatatatttggctgcaaaaaggaatgaactgctaatacctgctataatgtggataaaccttgaaagcctgctgaaataaagaagccagtcacaaaggaccacttatgattccatttaaacaaagtgtataaagtagaaaatgtattgagacaatagattgtggttgtttagggcttacaaagtttggggtgatgggggcccgaggtagtgacagctaaagggtgcagtttctttttgaggcaataaagttctaaaatgtatagttgcacgtttctgtagatacactaaaatcaattcagttgtgcatttaaatgagtaaattggtatgtgaattgtacctcaataaatctgttaaaaccatagtaattaggatattgtaatactggcttagagatggaaaaattgatttataaggaatcctgattgtaaggaatcttgacttatgtcagagatggcattgcataccagcagggaaagctagatcatttcaatagatgacgctgcatattcatatgggggaaaaatgaaattggtcctccctacctaacaccatacagaaaaagtagtttcagatgactttaagatgtaagtgtgaaaggaaaacatagtaaaccttcaaaagaaagattgcaaaatatttttatgatcttatggtagggaaatgtaatatgtataaaggaaaacatgtatgtccaatatgttaaagttaaaaacctctgttcaagactccataaaccctcagaatagcggttaatttcagtcatgcccaggaaacatacaagatgagcctggaataccttgtgcaagatagcaaggaagctattagagactacgagggtgtcatatcaaatggactcaggagacaactgaaaagcatccttctggccatagatgagaccatttgagtgtcaataaggacagtaaatgcaattgattggaacatatcaagtgtctttaaatctgagtacataatgattgtaaaacaaacagcatttagttggtcaacagtagaagatgctgttgcatcaattcattattttgaaaatcagttttgttttgtttttaaagtaattaggcatttgtcctgccttttgtatgtgaactgtaagtaaccacatagtagatgaggagagggttctctttgtacatgtattctagctaataaatggaggaatgatagaaaattgccattttgaaattcctaatgaacaaatggatttatttattgcatttcaacagctgctaacatgacagacaagaaaacatatgtttcttaatggaaaaacaccactactgatgttaaaatcttatcaaaaatttgaccctgatactaatcaggtctttagatccatccaatttgcagaaaatataaacaccattaaaactttaagccaatgaaacctaccacaacgtaatattttggaatggaaaatataaatgaaaaatccaattttggagaatattgggacaaattaatttcaacaaatatgttgcaggagaaaaggagacgagaaggacaagtggagaaaaccgtagattacaagagacttagttcaatatgaagcaacctgtgaacttggattagttatcttactgtataacaaatcaccctagcttaaatctaaaaatatttatacactttcttaggatccacaggtggtttagctagatgttctggcccaaggtctcatgaatttgcagtcaagatgttggctgggctgtagtctgaaagtttgactggtgttagaggatccacttcctagagggctcattcgtagagctgcctgtgttttctcacaacatggcaactggctttctctagaacaggtgatccaagagagagacagaaaccatgatcattcagagtgatgtaacattacttctactatataatgttagtcacacagacatttccctgacaatatgtgggaggagattacacaagagcatgaatactgggaagctagctgtcacaatttggccccaatgattgatagttcttgatttgcaaaatatattcatcccctccaaaagctctccaaagctctcatcctatgacaccattagttcaaggtctagaaatctaaatcagttccaattgtggatgacactcataggtgtacttaagtacagctcctcaagaagagttctttttgatctgaagactcatacactaaagacacagtctctgcttccacatgtaatagaaaatgaataggataataaatgtggacatgtatatttaaaaagagggaatattggaggtacataggttcacagaaattctgaaacccacctgggcacagattggcagttgcttggtcaagtttcaaggcctagaattctcttagctctgccttctgggatcttggatctactcactgagtcaccctttctttttcttgtttacacttctgcctgctttctgcctatagaagcttggatgtcccacaagcttctttccatttggttctctctgtgcctttcagtccaggctggccatgtttctgctaatagacttctcttaaaaactttgtggctcacttgtgaattttgagttcactccatcagacaaaagcaacaaccacacatctcgtcccacataaactctgcctcaagcttttgctgatgaaaatacccttaaactttttaaaaacctgtgatgttattcagagattttctgagacacatcgtttgtctgatgaaaatactctgaggcacaacttaagatctttctgagctattaaaggactttataactacagcctcaactttatgttttactggcagtgccctagatttgctttttgctcagagatattccccaattttagcacatttgtcatctgcacaggctgggaatcttcaaatccagcaagttttgacttgtttttgtttgtttgtttgtaatagagtctgttttttgctgtgttggccaggtgatcttggactcctggcttcaagcattcctcccacctcagcctcccaaagttctgggattttaggtataagccaccatgcccagccatggctcctttttgtttaacagtccttactttgatggtctctcttctcacacattttactatcagcaacaagaaaaaatacacatgaaatatttaacacttggccggcaatctcctttgctagatcaatgagttaattaggcattttttctactttgtacatatctgtggataacaaatttgctaaactttctgccattatgtaacaaggatctccttccctctagtttccaagaagagttttctaatctgttaagatgtcacctgcagcctcctcaaaggttatctattatgcttctataaaaaatttcttcaaagctcttcaaactttcattaacactctcctccaagttctaccttctgttcactgccagttttaaaaccacacttacattttaggtttttgctaacaccccacttctgagtaccaaaatgtatactgattttctattgctgcataataaactgccccaaaatacaacatgcaaagcaataaatattcattatctcatgtagtgtctgaaggtcaaaaatccggaagcagcatagctgagtggttctgattcattgtctcttgtgaagttatcagtcaaaccatcagctgagactgtaatcatctgatgttttaactagtaccagaggatacactttcacatgctattggcaggacactttagttcttcactagctgtttagcagaataccgcacttcctcaccacatgtacctcttcatagagcttcctggcttcctctaaaacaagtaatccaagagagaagcagaagccaccatggttttttatgccgttgttgacctagcccccaaagtgacatattattacacagatatgtagccaacctgtgggtcactgatacggtttggatgtgtgtcccctccaaatctcatgttgaaatgtgattctcagtgttggaagtggggctggtgataggtgtttggttcatgagggtagatcccttatgaatggcttggtgctgtctttgtggcaataagtgagttctcactatctgagttcacacaagagctggttgtttaaaagagcctgtcatctcttttgctccctttctcaccatgtgatatgctgctccccttctcttctgccatgaagaaaagcttcctgaggccttcaccagaagcagatgctggtgccgtgcttctacagcctgcagaactggaatgtgttccaagacccccagtggatgcctgaaactgagaatagtactggaccctgtatatactgtgttttttctttccttattgagaacttttatgttttcacttaaaggaaggactttacagcttctctttcgcatatccaaattgccagcatcaccgctcttgcactccaagccattattaagtaaagtaaagaacacaaacactgtgatactgctacacttgatctgataaccaagaagtctactaagtgactaacaggtgggtagcatatacagcatagatacactggacaaagggaggactcacatcctgggcaagatggagcagaatggcagagttcatcatgctgctcaaaatgatgtgcaatttaaaactaatgaattatttctggaatttttcagttaatatttttggacatgaggtgactgcagttaactaaaaccatggaaagcaaacccatagataaagggatactatggtatgttttcattttctataataaaaagttaaaaaggaaaaagacaccataggaaaataaaagacaagtcacaaactgggaaaagatctttgcaacacatgtgactatcgaaaggattagtattcacactgtgtaaagaaccactacaattcaatgaaaatgaagataatgctttccaccccaaacaggcaattcatacaggagaaaacctgaaaagatacccaaccacaaggaaataccatttcacacccaccagatgaacaaaaatgtaaaagtctggcaatattacaattcttatacattgctggttggagtatgaattgatataatcaatttgggaaacaatatggtattatctagtagctgaagatgcacatcttctgtgacccaggaaaaatgtatagcaggagacatgagcaagaaaattcataatggcatttataacagtaaaacgtggaagaaaatccactgtccatcaacagtagagtgattaaatacattgtatatgctcatacagcagaatatagtggtggaaaaaataaattacaagttcatggacatagataaatctctaacaaaatgttgagcaaataaaaattcacaaaagaattttacagtaggattccatttatataaagaaccaatgaaagtaaatagcctaagggtacaaacataagtaaatctataaattaaagcaaaagaatgataagcacaaattcaaggcagtgatttcctctagctacagagggaagggaatgaagtaaggaaaaggtgaacaaggagcttaaaagtatgataattatatgtgttggtttggccaaacagtcctggtttacctagcacagttctggtttgctgattgcctggtgtaatgattaatagcactgtcactccccaaattgtcattgtttggataatgaattatatgcatcctttttagagtaaaagtaacttttttctccttaaactggatggagggcatgtgggtctttatcattcttccttatacatgtatttttaaaatataatttaaaactagtcagtattttaaaatataatttaaaactttagtcagtgttagtcactgtgttagtgacaacacagtaaaaaaaaaaaatttgtaagataaataaatataaataggatccaaatgaaactcttttcatctgggtggatacagggataaataacatactatatgcctggcattgtattaagcttgttactgatattacttcatattcatagcaagacatttaggtaggcattattatctccattttacacatgaagaatctaagacacaaagactatacataatttaaccaaagtcatattatatgtgacagcgcagaatttgaacccaagcagtgtgacatcagactacatgctcttaactaccatgccagagcccataacagattttcttaaccttttttatgccacagatccctttgacagtctggtgaagcctatagagtcctttttagagtaatgtcttttgtacatcaaatataatgcacaggattataaataaaatcaattatactaaaatatggtaatcaaaatatttaacaaatgtatactatacctgtactttttattaatgcattaaataaataataaaatctagcaggtctaatgaataattttgaaataataataataattgtatcttgagatatctacaaatatagtaatgtgataggaaaatgtttgtgattttgataagtgaaaaagtcaccaaaatacttgtaataacactgtggttttttgcatatgttcacaatggaaagaaatcctaaatcttacttcgaagttagcaagaattacaatatttttcccaccccaattcatggccctctactttatggtcttatttcataggctttctgacatgttttgcttcaaagaggtcctattccccatcccatttcctatcttctggtttgggattacactcaagatgtgatatacagatagattagtttattagaaagaaaatatttttccacatggcgaactttagtggaggctaacaaatcagaatgtgctaaaatagccatgtgtacatatagacaatgggaagcttggaactgctttagcattttatacaaaagacttaaaagtaatttcagctgggcactgtggctcgggcctgtaatcccagcactttgggaggctaaagtgagaggattgcttgaggccaggagttcaagaccagcctgggcaacatagtgagaccctccccccatctgtacaaaaaaattacaaaattaaccaggcattgtggctcgcacctgtggtaccagctacttggaaggctgagacaggaggatggcttgagcctgggaggttgaggctttaatgagccatgatcatgccactgcactccagcttgggcaacagagtgagaccctgtttccaaaaacaacaaaaactggtttcaaatatattgctacattggaattctccataaaggaattaattgttgataacaatgccctcagtatactatttgtcaatacctataacaatgcaacaaacaaaaaagaaaatttaaatagctggaccacattaaaagttttattgggctaaaatcaaaaacatctgacaagtttttgacttgtctttctcatgatttaatgtcccagcagagcaactgggaacctaattctgaccaaaaaggaggaattgtttggctaattggaagtgacagaaaccttgggagaaagcaaccgcataccaaggataattataagaaggtaacatgggccctaaaggatagtgtcaagaaacctgaaacccccaaatgaggtgagacttgcaaaaaatgctaaggaaggacaaaaaacaggccttttaaaattctgttcagaaccagaagatgatcaagaaagggaaatgcccactagcagcttctactgtaaggttagagctgacagagaaagaactccttaactactatttgcttcattctctacaaaggaaactagagaagtgggttgatgtaatagaaagaacatgtgtttgtggggccaggcaaacctgggtttaattctgtttcaacactgcttaacaaaatttatgggaggctattgttttggattgggctcctgcaccaggcccctccggaccaaaccaaaatggagtcactcatactaaaactccaggtcactgaaccaaaactaagttgtttatctgaccttccaagaaatcaggagggagaaaacaaccaaatctccaaacaggccagttttaatcagcgtgataaggaagtcctctcttttttaaccctataaagaaagtaactttttgaaatgatcaatacactttgtattccttagttctgctttctttagcccctttctgcctataaagcccacttcctctgctcaacttactgaagcagtattccattttatagaatgagatgctgcccaattctggaatcactaataaaagccaattagatctttacatttgttgaaattttgtctttgacaacattactagttatattattctgggtatccttttccccatctgtaaaatggacatagcgatatccttcccatcagatttttctcattaatagaagtaatacattcaaaacactgagccaggctcacaccagtgagcaacttgttaatattactcagaagcatattatagatattgacagaaagcaatactgttcctaattaggggaagaaattctaagagagtacctaagagtttgaatttagattataacatttgctctgagtattttacattacagcctttggggggaaaagtacaaatgagatctgagaacagtggtactcatctttgaggaattatggaaaacgtaatagaacactaaacatgggaaaacatcggccttcaggttgaaaagtggaaatctcaatccctgaattttttttttttttttactaagtaacttttttgcccattggtgtcatttaaccaaaagaagaagaaattccaaaaaaaaaaaaaatcaactgaaacaaaagaatagactgaatttgccaaaagagtgcttaaatggagacctaagtcttcaaagctaaggtgatgagaaaagaacaggtcttaaatttcttcagagcttcaagaggcaaagcttgaaagaagaaaaaattttattcttaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagccttcagtttgtggtagtttgttacagaaaccctgtaaagttaatacacagagttcaaagagaatccggtaatatctctaaaagactcgtgtattagtcaggattctccagagaagcaaagccaatagaatgatacatgttgttaaagcaaattaaaatggagaccatgcctgaagaatctctgtgcagagaaacccagttaggcctcataagttaaccttacttgatttgcaaacataatctaaaagttaactggagctatttccggtaaatgaatataacacaacttaagctcaatcagtcagaagcagctttataattatgtagctagggactttccaagaggatgaccaaagaaggaaatgatataactataaccaaataaatattttctttgctttcctgttcctcctataaaagcctccccactgctgagctgtgctcagcagagctccgaaacaacttctggtttagagttgcccgatttgtgaatcactgtttgctcaaataaactctttaaaattttattgtatctcaggttatcttttttagatagatagatgatatatgatagatagatagatagatagatagatagatagatagatagataatagatagatagatagattatttattatgggaattggctcaatcacagagacccaagatctgccgtctgcaaactggagaaccaggaaagccagtggtgtaatcaagttcaaagggctgagaaccaggagaatcaataacttaatacccaatgtaataaggcctgagaatgtggggtagggatgctagtataagtcctagagtctgactactgcagaaccaggagttctgatgtccaagggtaggagaagatggaggtcctaaatcaagaataaagcaaattcaccttttctttgccctttttgttctatttgggcaggcctccagtgaattggatgatgcccacccacactggtagagcagatctttagtcagtcttgattcaaatgctaatttcttcacagaggcacacagaaatactgttttatcatctatctggatagcccttaacacagccaagttgacacataaaattaaccatcacaattaggttttcctgggttggaaggaatgggagataatgaaacgggtgctggagggtagaggaggtctgagggacttcttggcgggactatgtgaaccagaatggaatgagcaaattacagaccccacagtctctgctctgacagagattgccagagtttgaaatagacctgatagggttactacaggttaccagaaccgggaagtcatgtggcagccaagctaatatccaaagatcacccaaagagtatttcatgtgatcaggaagagtctctgtttaattgacaactgcttcccacttcccatccccttcacgtgtagcaggagtcacagctgtctgtatgcaggtactttactcgaccctatccaaactattaataggaaaaagtactttctcagtagtctaagtagtcacaaaccctaagaaatacagaaaagattatggacatctacgggagtgccagtgatataaaatgataatccatatcacatggaaaccctcccacataaataatctttatttgactaggactttattcattcaactgagattctccaacacccctgataaccagccaggaccgtgctgatcctaggcaacaatctaaaaggaataattaaaggatgctctgggagcatctataagagaaagcagtaatcaatcgaatacagcacgggtttatctataataatttcagtctaatttaattttctttctgatagtgttactaggctagtcaaccaataaaatgcagtaggtaatatttttctgggcccatgaggtattactgacttttttttttttatcatatccttgtgagtaagttggaggggttggggaggctagatggtagtactgtcagggaaggacttagcatccaaagggtactgactcctagatggcagtcagcctctccagaggtttttagtatagaattacagtcctcggtcttctgtgtttcattgacttaaaagaaaacatagaatccatatttatcaaatttttacctgattcaaaatcaggaaggatagtattttttccaaactttggaacagcttgatgttgactctgggctaaattctgtatgggcataattagaatcaataaaattttgagagtctataacaatataggcagagtccaacaaactagtaggatttttaagtttattcactcatttagatgtcacaaatttctggaatatcaactctgtgtaaatgtctatgttaggctttagaatatgaataaggtatgttagactgcaggagtttaaaatctggtgaataaaacaaacttgtaaacacaaaatacaacaaatattaattgtaaggcattatttagcattatatttagtaaaaaaaactacagttaattgtatgatatgcacagggactggcatgtgtgaaacacctttagacatttaataagctggaaaaaataatatttaccataaacatatactactggtgcaaacataaaatagtaattttgtggaaagtaattatgtacaagccatactatttaatgcagcaatttccttctaagaatctactttaaaaataatctaaaatatattcatgttatatatatataaggaagttcataatcaaattatttataatggcaaaaaagtttaacatgaatgattaaaaagatagtatagccatatgatagtgtcataatcataaacagttatgtctctaaaaaacaggtgtctgaaatattatgtcacattctagaatagcatgttatagtcaactagaagtctgggaaaaaatgatttttttactgtaaaacctcttgaaagttttgaattttgtgccatgttgcgtgtaacacattcaaaaaataaacacaattttaaaataaaggattcaacttaaaattttaaaaatacacttacagatagtttttaatgatataaagaaatactcatgatatactaagtgaaaggcaaggacattacattatttcttgcagcagttatgaataattggaaaatgtattacctggctgtattactaggaatattttcttcagtattttgcaccctaagaaatctaggactggtttacataaaagcaagcagaatgatgaagaaactcaccttaagaacggttgaatgaaaatgtaaatgtttagcctggaatatatatatatatatgagatcatgatgactgtcttcaagcatctgacatcctgccatgtgaaaaagtgatcacgcttccactggaaggtctcagaggatggaactagacccattggcaggagctatagcaagccatttcaactcgatgtcaaaatacttgcagacttagtcacttgcttatatgtcatttcagttcaatgtcaggaaacacatccaaaaagaacagggcaaaaaatgagtggtttcccagtcacttgaaagattcaagcataaattatcacttccttgataggacattatggaagagattcaagcatcagaagtgtggtttttgggtgtgattccagctgtacgagaagccatttaatccccctggaacttagttctccataaaatggggacgtttgactaaagtacctctatctctttttgagtttgaaactcttttgattctgctttggagtaacaacatttttctctcttccagatttatatatcagctttttatcagttgaaataaaccaccctgggccgggtgcagtggctcacacctgtaatcccagcactttgggaggccgaggcaggtagatcatttgaggtcaggagttcaaggccagcctgaccaacatggtgaaaccgcatctctactaaaaaatacaaaaattagcccggtgttgtggcaggcgcttgcaatcccagctactcaggaggctgaggcacaagaattccttgaacctgggaggtggaggttgcagtgagtcgaaaccaagccactgccctccagtctgggcaacagattgagagtctgtctcgaaaaaaataaatacataaaataaataagccacactgtacttgtgaagattaactgagatgtttaaaacattatttgcaaaaatgcaagacatgatgtaagtgtaaagcattattatatatcaacataattgaccattagaaaaatgcaaattaacacctcaatgagatatatcaccagacacctgttagaatggttaaaataaaaagtactgatgatattaagtgctgataaaatgcagagtaactcgatctctcatacattgctgatgctaatgtaaaatgatatcaccactctagaaaacagtttggcagtttcttataaagttaaacatgcacttactatacaacccagtaatacacctactggatattcattctagggagatcaaaatttacacccaaaaacatgtacataaatgttcatatcagctttatttacaatagcccaaaaggaaacaatcagatgtcctccaattgataactggtataaccctatcacagaatcctactgagcaataaaaaggaaagcactgttgatacatacaacaacttgagtgcatttcaaggctgttatgctgactgaaataaaagctaatctcaaaaggttatgtattatgtgattctgtttatataacattctcaaattgcaaaatcacagcaatgaagaactgatcagtagtgccaggggttagggttgtggggagggtgtgatgatgaatgggcagcgtaagagaatttctttggagtgatggaatagttttatatcttgattatagtgatcattatattaaacaattgcatgtgataaaattctataggactgtatgccaaaaataacttaatatgtttatttttaaggtctggaaagcatggaaatttgtatcttcattcacttttgttttcatggactcttttcatgtttgaacttttcatggtatgagctgttttataatctataatatggaatgtttctcatacgaatgtttttcttattgaagaatgccatagaaataagggtgtgaggtatacttacttgacaggagaattttactccttttattttatttacttatttatttttaagacggagtcctgctgtgttgtccaggctggtcttgaacccctggactcaaacgatctttctccttggcctcccaaagttctgggattacaggtatgagctacagtgccctgagagtcctttttaaagtagtgaatgctcaaacatggaattaaatttaggcaaagctcacttttatttatacataaaacaacttcagccatgtacctcataacgatattttggccaatgtctgaccttatatacaatggttgtcctgtacgattataatgaagctgaaaattttctattgcctagtaacattgtagtaattgtaatgtagcacaacctatcacacgtgtttgtagtgatgctggtgtaaacaaaccgactgcattgccagtctagtataaaagtctagcacacacaattatccacagtatataatagttgataatgataataaacaactgtcactggcttatatatttgctatactatactttttatcattattttagagtatatttagagtatattaagcagccttaggcaggtctttcaggaggcattccagaagaaggcattgttatcataggaggtgacagctccctgtgtgttgttgcccctgaagaacttccagtgggacaagatatggtggtgaaagacagtgatattgatgatcttgaccctgtgtaggcttaggctcatgtgtttgtgtcttcattctttttttttttttgagatggggtctcgcactgttgcccaggctggagtgcagtggcgcgaccttggctcactgcaagctccgcctcctgggttgatgccattctcctgcctcagcctcccaagtagctgggactacaggtgcccaccactacgcctgactaattttttgtacttttagtagagacggggtttcaccatgttagccaggatggtcttgatctcctgacctcgtgatccgcccgcctcggcctccc

SEQ ID NO: 2280 - DNA, 892 bp, Homo sapiens
gagcaagtcgaggcaggaaagggccgccacggactgcccggcccgccgatcgtttttattatcgagattattattaaaagggggcggggaccccaggacgcgggggaggggctggatacgcaggtatttttattaaacagattattcctgaaataataatacgcgcaagatggctgaaggtggctgtgatgagagtgttggggttgggatttttttcttcctgttttttcttttttgatctgaggataaagctctgaggcgacagcggctgcggagaccctgcccgaagcgccctcccctcccttgagaagccgcgggcagacagacggacctcggaccgagcaacggggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgca

SEQ ID NO: 2281 - DNA, 1708 bp, Homo sapiens
ctcatccttatttaacatttactgaccacttattatgttccagacacttgagtgaaagaagtgttgtagaaaaaagcaaaaaccaggttcttgtcacatgaccaggaagagttaggcatgcagacactttgaagggtgaggaaaaatggaaattagtgggcaaaaagtaaaaggaaaaataattctccacaaagcaagagagagtcctgttagcagatttcctgcctcacagattgaatcccaggttcccacctaggaacaggagagcccaggctcctccccgctgcaatgggctagaacttcctgtggctccaccccatcctcccagtgcgcatgcttgtcggagattctcaggcgaccttccctcttatcttcctcttgcatttatcagaagtgctgaacccttgacgtgccttatcttatttgctcctcacaacaaatcttatgagatgcatcactaccagaagttgtccagaaagaactgtgaccgtatgttttaattaaataatttttcatccagtttttttctttgcatataaagaaacagaatcctgacatctgattgaattattggctctcctgatggttgcacgatggctgcagcagttccagatgtcccatcgagacacaaaaagatcccagatggaagatgccatctcctcctatgtgcctctttttaagagttacacaggagtgaggaggaccaccaaaccaaactaagactcggaggaaaaaaaaaaaagaaaaagaagaaaatgtctgctaggtagatgtggttttaaaatctgcccacaaattctctgatattcctcccacttcaaaaagttgaacaatgtcccctctgcccccaggtgccatgccactcaaacagccaatggaaaggcccacgtggcgagagctaaggcttcctgccaacaggcaagtgaggaagcccagtcagctgcctgcagtcctgacccatgaagagcctgactgaaagtgaatgagcaaccctgagctaggacaacccagcaaggcccatcctgaattcctgcccacaaaaactctgagacagtaaatgttcgttgttttaaaccacaaagttttgaagtaatagattaattaggtaaccaattgggactgcagtattccttcagggaacttgaatagtcattctgtatatggaaattgtacacatcttaaaattgctggactaaagtgagaagagactgtcttgagtcaactggataaagtggaaaaaaaattaatttggaaatcaatagaattctggccttggctttgtcactaagaaacacttataagtaatttcacttctcttgaaattatgatcattatctataacataaaggaactgagctaaatgttatctgatgcctctttaggctctcaaactccatagatttatgacatgcttgaaattcactttgtttcaccctaattcagagctttgtttcactagctctagaattagatgccttgggtttaaattgcaattcagtcacttatttaaataattgtacttggatgagtgatgttgccattttaagcctcagtttccccatagattcattgagaagatcaaataagatgatgcagataaagctcttagtttgtggggacacttagtaagtgcttaataaatacaggcagttgtgttatctatgttgtagcagcacattttgtaaaataaaacaaagttgaaatcaca

SEQ ID NO: 2282 - DNA, 3759 bp, Homo sapiens
gtagattctaagtgattttcatgttttaaattctcagacctcactaaaattggtaccattattttcatctgtattttacccttgagaaaaatatggctcaaagacatcacttacccagagtcacagagccagcaggcactgggactgagattccaacccaggtcgtccatgtctggggcctgggtggacacccatgacactatctgactctccagttgtggaaaacatatctgacgctggaagtagaaacagaagttagacaatggctaggctacactgaaactacactgaaatttaaattggacccgttaaagctcattgaccttactcatcttatttttctttcctgggcagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaagttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgtagcttatctgtttttttcttaaattgttgccctgaaaaaatttcttgcatatgaattgtaaaatgtaaatacatttttataaccaatgttttgatcttattgaatgttactttgaaaatgtataactattgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatcatgttctcgttttgtagttcagaaagtgaggctcaaagaatttatgtaaccttcccagagtcacagtgtaaagttagatgttgaaacccagtttatcttatacaaatgagcctctgcttgttctacaaaggtagtagaatcaatctcgacctatataaatagtagattttttatggtgaaactttcccacataaagtaaattttaggggtgaattagagtaaaacttacaggataagcattttgctctttttaagaacagcatgaaatttagaataccaatgatagctatctttaagaatcagaattagtactagaaatttaaaaaaccctatagtttggagttagtatgagccttttgtgaaaataaatatattaaattattttgcctgatgtggtaggggaaatgtattgctctatattaagaaatattctggatattctgattgacatcttattaggccatagtgagctatgctctgcacaactgagaaattaggtatttagaaggcatatagagatgttgtcataactaggtcttcaacgtgaaaattaatttttattgtatcatgtcaagtatcagtttaccacatattatttttatattaattcaacatttgccttaagtgtgttgttaaatgaaagtacagacagcttcattgttgtattgttaataattgttacttactgctccaggcattttattaaattaattttttaaattattttccaccctacatcagtatattggttgtgctttatatttgccaaagtcctaactgactatacatagaaaaaaaaaaaaacactgttctcacttgattttattaaattatttttaaaagtc

SEQ ID NO: 2283 - DNA, 11373 bp, Homo sapiens
cctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacgggggggggcagggttaaaaaaactttttttatcagtcagaggataatgcaagtgtttaacagatgcttcactattaaaatattttcccccaatattgaagaatctctaaccagggacaccagtccctacgaagaccttgggcgattttgaagtgcgggcacctcgattccccgaatctgtagtgtggctggtatcggtgttcccctggtttaactagcctgtttggtaagtaactgaatattttttacggcgtgttcagagcttattttccagtttttatgaacaaacatataaatatatctctgcattcctgcctccctcataaaagcgggcatctgtggaaagcaggtttagttatcggaggggaaccattaaacgccagtttaagaggcaggccgggaggacggctcgtggatgttgagactgctggccttggtgatcttgaacgcattataacggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccaggttagcccaagggagaccaaagactccaccttgagcatcgccctttggaggcgggcagagtccggccgcaggccacaaagcgatccccacccgaaggactccacaaggacagtcctttccttgctcaccgccgacaaagtggttggggcaggaaggcgaggtcagtgcgaatggagggcgcccaacttcggtgttgcagttgactctgtgctcgggctctgccctccactagccctagagtcttgggcagcaggattgagaaatatatatatttcaggtttgccgcggctgggcggtaggagacagggacttaaaagcccaggattagagtcggtgcagggcccattctttttctaggaaaggggttaacatccttgaacgtccccagacaagcgtcttaaagcattgaacctagaatagggattaactgaaactaggctcgttggtaagcgccaggggcttgcagttgagctcggaacaaaatagtgacctactgctctaaacccccaacttgcgtgggtctgcaattttttagcacaaggagagccttttaaagacctggttcttcaaggaaagaatgcaggtagtgtggttgggggttctgtttacattttcacccggaggcaaaccccgaatgtgtaaatactggtagttcaattctctgacatttgatacgtttttgaaaagtctgtttataaaaacacatttaggccttgggagcaggtagacaaagtaagattgcactggggctgggaacatataaaaattcagggaaattagttggttggctgctttaagacccaaagggagttttgggaattgaagggaggaagaagagtccagaggagggctgagttagggattgagatgctctgtccaccagagaccagcggtgagtggcctcacttttgaaagcttcagaacttgccacatttagcttttctcatgcttttaattgaaacaaacaaacaaacaaaaatgaatgaattacctcgtggctccagatagcattgcaagtggtaaaggaaatggacaacatggtacagaaaaaagaaatcataaaagatgctaatctgaacatcagttctcactcacagtgtcattatcagttaactgctgtggtccaagggcctaagacttgatgtggctcagaaacccaaatccagaggtcactgccttagaaagctggcttgatgagaggggacaaatggatgaaccctagtggtgtccccaactgtagtaactgactcagggaggccaggctggccctgactggttgagctctaccctaaatgcacaaacgcatccacttttctcttgcagtgtcctttggcctgttttgttccaggttttccaggatactgggttagcctgctcctttgggaagttgtgaagcaaggatgccatctcaagtttgccctcaatttaggtgtcctgggcatcctggtggtagtgatggaggtgttggcagtggtggcaatgaaggagagggtggtgttggtgatgagagggaaagtgggagaagaaagggagaaaggcacagtccctgacatcgatgtcagcatggggaccccactcctgggctgcactagtgtagctgctgatgcacatgttgtaagtactcaaaggcccagggaactggcttgctgggggctcctctgggtgcctgtggaggaatcttagctaggagtgcttctctgcctctcctcagaggctgagggctgagccaaaaccggccttactcgtgtccagaaactgcttcacaaggaggcagcccaggtttgggtgagtgtttgggattctgtacctttgttgtagctgatggtgtacctactgtactgcacatgtcaactgccttcagccaaatagacagaatctggttcaagcatttattttgctcctcatgtctcttgtctctttgccgtcactgctacttctttctctggaaaaagacggaaagagcagcagagaggctgaacatggccatgcaaacattttggtcttgtgagatattattatacttgaaaaaatcaatctggtttaaactaattttaaaaaaatctttagttaggttttagggaaaatacagattgtctcagggtgtttattatttcaaaggcaagggcagtttatatcctctgttttgctcataagaacccaaaataaactggacccaaaaagaatcaggccagagggtcataaatgcacattttatgttcatgggaattatggctcaattctcatcatcgtctttcaaatcttgtttcaccttgtttttctaaccaacatagtggaagtgactctgaccgttcccttaagaatctttaatgctcttacatgagatgagcctcagaacaagctaagaaccatcgaaagaacatcaagcctggaaggtgacagaaggagcaatgtgttcttgaagatgtcacctcagcccacctgctccaaggacagtgcttcttgcgacactctgatagctctgcattcttttctgtaccagggtagggtggagtcattttacatgctatccacttagtcccaggatgtttaggatgctcagaacaaggcatattgtctgagtggtggcaagggtctccctctaactggggttgtgtagtccttcctgtttgtgtagttcttcttgtatagtcttttcttgttggcctttgagaagtagttgtctacagacataccaagtgaaagtggctccagaagtgtcgtgctgctcaaagtacacatctgcaaagcagaatcaaattttgttggatttgagtgtctatttcaaaaaaggaagaataagaaaagctgcccttgtgtcttgtgaggtttttttttttcttcttcttcttttaagcaagttttttcctcttcttttaagcaagtttttggttaagggggtggcatatttaggggttggatcctcttcctttctcttccctacatggagagatggagggggaggggctagttcagctgaatgatgacagtggaggggctgattgcttatgaatccttcagtccagctctaattagaaaacagttaagttggtggagaaaatcagggcttgcttagtgcctgcacattccctcctcctctttctcctctccctctttcccttctttcttccttccacccccctccctccctctctctcttcttctctccagttctcccttgtaatttgccgtctagcagcatttgggattacaaggttttttttcttttcttttctttttttccctatcactgaatctgcaactggcatggaagaatgagatactgattcatgctgaagtcttttaagaaaaatcttaatatccacagtcagtagaattttcctttctttctaaataatcaatgactagatcctcatgttaactggtagatatgttgctgcactggagggttttcattgataaggaagaactaaatatttttccaggtgtctaagtgtgtctgtaaatctaaaatcctcattcagactaaagggaccataagataaccccgtgaaggcctcaaagaagcagcatgatgtagatacatgggacgtattattaacgttattatactagtcctaagaggtacagtaaatctgatctttgttaatctttgctactttgtagtaaaatatagagtttagagcaaaaccggtctgagaacctacatcccataggatttatgttaaatactcattcaaattattgcttcaagcaaattacatacacactagcgacattttctttcaagccgggaggaaatcactcaacattcagatgaggaagtgtgatttttcatacgtgttctacggaaatagtaaataatggacttcacctagtctgcagtgtattatggggttcagaataaaatatgagttcaactggcaatttcaaatgcggctttggagagaaaacatttatttgactgaaagatttgcttctgacttgaggcccaggaacattcccagttttaactgtagtgttgcattcctgggaagttctgttccatagcttcctttgcaaattcatgtagatggatttctttagctctgacagtttcctccaaacctttcctacattcttccagggcctttgcttatagacaggggagttacaccaggatggttaggtttcaggttaacaaaaagaaacacttttattgtcaatattaatggcaaacctcgatttttacaaggcttgggtttagcagtgtgagcagatcaaaagcagcttggtttgatttctcaatattctctggagcttagacaattaactgcaattttgctcctaacaaaacaacacaaaaaagttagttacagaaatgttataggtaatcttttggcagagatttttacctgagtacaacatatcagaatctagaaaatttatctactgaacttgagttgagttttgcaggaaaaccccttaagaaaatcttgtgtgaactacgtcctcggttgcaatgccatgagcctgtttcagtgtgtgcattccaggcttgcctttctagctgggtaaggatccggcagactgaggtctccttggtaatttgggtacaccaagtctccagttaatgatagataatcagcctttgggtcattcggtcattctcttattacaaacccctcctgctctctctgatctcctttcaaactaaatttcacacaaacaaataaagcaagacagggacaagttcttaaaaaaagagagagaaatattagaaacgcctgatacagaactctaaacaaggaaaggcaagctaaaagaggataggaaagaacatcttatcaaaatgaacatgttgtgtacaaaacattaaaagaaaaggctctggtttttgttaaagtgacagaaaattaaaataaaaataattgcaggcaccaaagttataaacagggaaggcaggatgctagctggaaatgcgcagcactagggagctaatttgttgttacagattatatatctgcaccctgcttggagaagtgctactttgttccattttccagaagagaatggtttttcttcttaatacttgtgtgaatgcccacttaagttaacacaggccacaactttgaggaatgagaaatggaattgcattctgcttgcgaagcatccaacttcaaacgaagaaattggttgtgtacaaaaaaaaaagtagaatttcattcagaatacgtttggagacttcactaaattggtgtgactgatgcttttttgttttgctgacagaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgacc

SEQ ID NO: 2284 - DNA, 19996 bp, Homo sapiens
tgtgtttgtgtctgtgtgtgtgtgcacatgtgtgtacaggttcactctctaccactgctttcccctttgctgacctggactggcctgctggatttcccaccaggagctctctaatgcagtgtcgactgctattctcaatgaggcccagcactgtcctggtgaaactggaaagagaaagtacgacaggtgctgtgttttttgtatgggggttgtaggatcagagaagtttagagttggtgggacactcaaggatggatagaaaacttctgtttgggtctctgcagtgatggagcaatgtggattttaacaaccagagtagcagctctcatctcatgagcacctgtatcgtgtcagtctctgagttaggttctttaaaagacagagttttgttaatcctcacaattttgtggtattgttaaatcagagtacagatgataaatggaagctcagagtggttaagcgctttacctggtgtcacacagctagcaagcggtggagcgaggatcttgactaatactgcagcttttcccacttccatggcacgctgcctccttctagcattcagtgaggaaagctctcaccgctgggagttgttcactctagactgagcgcctttcttagagaagggatttcttggagaaagattgcagagtcttctctaatgattacaagaaggacagagtcctggtggacacagttggagggtcttgtctggaggcagtggaatgagccaggtggcctcttggagctttttcaggagggaaatctgtaagggagaggagatgggactctaccttcgatcacttggaaggcggttggctgaggccagagagtatctttccataccttcccaggagccaccccaaactcctcaggcctttgtttctgaggttctctcagaaccactccaggcagagcccacaacacatcctgatgttatgggatgaatggggacatggggcagggcagcagcctggaagcaagtgaggttaaagaccgccttagcgagttttcccttccaccagacttcccctggctccccctggctttgttcatcttgaactcccttcacctcttctactgtttcatccctttccttcagtccaccctggatctcatcctttaaagccgaatcctctttcctgaagaggaaagaaggaaatcctgactccttagatcactatcgtgtgagatgaaagttgctcttctaatttgtcccattttcttcaactcttcttcccctctgtccctgctccacactcaccactggcaaccactgagtctgagaccctcccgcacactttctctgcgtgtcttcggatgctgtatttacttaagctgaatacagggtctaaagggtggcagtgtcacattagggcccatcgagggagcagagggcctttgtcagagtctgcaggttgtggggatggtgactggcctggagtcggggtgaagcaatgggaactgtagaagaaaggggaaggagagcagggcagcgtggatgctggacctgtctcctcttcagccttttggactctgtgttccctctcctgggaagccatacagccttggccgcttcaagatggtgcctccttgggcagcacctactctggagtcggtctgcatagttaaatggttggaaaaaagactggagagccaatcagggatgctcacttgcagttcgtgtgaatcctgcctgacccacgtttagagacaccatagaattgtatagaaccttaggtatcaaactgggtttttcagatcccactttcctggtgagaatattcttctgttgatgtgctaggaaatgtttaatccaggtgagaaacaccagactggtagtgtttgcgatttctgtggtgtagatactcccaccatggctaattccaagctgctggtgtggtcactgaaggcggagttgagaaaaggtgtacacagtggtgcaagccagctccagggcaccgtggcttctgaacgcaagtgtggaagcgctaggagtcctagttgctaggctctagagtggaagttgaatccttggtggggctgccagtaaggtggggaggtcattttctcaccaaatcaaaacacaaaaccctggctgtgtcgtctttcttattctcatgcctggttcttgattgtggctagcaccatggctatttcaggatcccactcatactgctgccattggttgaatgcttacatccattatctcatttagtcatgacagtaatcccatgacatagggactggtattatctccattttgcaggtgaggaaactgaggcacagagtgggtcagtaatttgcacagggttctacagcctttgagtggtagaactggaatttgaaatcatgactgtctgatcccagatcccaaatccttgcccagtatattatactcgcagttttgtagcttttcacagacatttccaaattctgagtctactctcaatgcagggtcttctagcataacctttgttcctgttggcaacacttcattttggactgtcaagatgcatttcctgagatgtgagatgtcatgaccctgtgtttggtaagtttggctgcaaggtactggctgtcctctaagacacttcctgagtcccaagtccacagattttactgaggactgaaatggctgcattcttcatagacactgagtttgcctgttccaaaaatggtgatttctatagcaaccatttattctagcagatgtgtgcctggtatggttggcagagagggtgggaccaaaaatggaaacggccttttattcttcacttcctgaatgcacgccctgtatgtgaggcatataggaggaaaaacatggcatccttagaatctgtaatagatctatggctcaggaaagaaatacgtgttgcttcagactgctttttatctggagcttgagttgggctgtgtttggtttgtggcgtgttctttggcagatgtacctgttggtttcaattcaatggatgtttgtcatttggtctctgcagaatatgcacatttactgtgggggtaggtggctaataaacagagagaagacactggcttggctcttaaagatcacgacgtctatgtaaatgtgtattacatagggctttttttggtggaaagtaaaataaccaatttatgccagcctaagttaaacaagaggatttaatatcataataaaggaaggttttatggagcccagggacaggagcatggccccatctttgaaaggcaagtgagcggaactaagaatgaactgttagaaacttaggtggaattctctctctctttctcatgcttgtttagtctttgcacgtatttccattttcacctctctgcagaccacagagtcgaaaaatgaccaccccaggactcccaggcttacatgtgaccaggcttgattcagctttccctgtgtgtatcccaaattctagaaagagacacagtctgtctgatgcagcttggatagttatccactcttggccaatcactcaccgaaggctttgtggtgagtgttatttatctaagtctgctcaggctgtcataacaagatactacagactgggtggctcaaacaacagaaatttatttctcacagttctggaggctggaaaatccaagattaaagtggtagcagatttggtgtctggggagggctctttttctagcttgttgatggcctccttctcgccgagtcctcccagggtggagaaagagacagtgagctggtgtctcttcttacaaggacactattctgtcagatcagagacccacccttaggaccgcatttaaccttaattacttccttacgggttctgtctccaaataacagtcacattcgagatcagcgcttcaacatattaattgtagaggggcacaattcagtccatagtagtcatgtaggataacatggctgctgggatccactcttgggccttgggaatagaatggatctcattggctcccccagaaggagaccagtgcagatgaaaaggctgaataccctgccaagacaatgtcctgtgccagattagaatctaaacctcattgtcgaactcaaacacattgcacttggggtgaatagtcctgctgtgcgtgtgtgtatccatatgtctgtctgtgtgtatgtaattagagaggactttctggaaaaggaatgtttgagggtggccttgggttcctgttggctgtgaacacactcctaatgagctgccctgtgtctcagtttacacatggtatttgaaattgagtctaaattcccatttcttgtactttctgaggagcagtcaagaaagagccagatttacagtttgccagtctcttagctctatgttccaaaggaattaagtcactcttcttgacagtggccttaaaatagggttttaataaaatgaaaagaggagcagtggagccacccacccctgtcacctgtggctaaatggatatacgggcgccaggctgctacgggagccttttgtggtgtcacctccagtgccagtgggatacgtgccgcaacagagaccagatgatgaatatatttttaaacttggaacccatgaaccacttattatttctgaattaggaatcaaaacatatgaataatttcaacagggtttcagcagatgtattctgcttttaaggtcactctgctttgcggagatggtcgggggtaatggggagtgaagtccagcctgattctctttgtgactcttaggacatctgtgtcatgtttgctcaatttagcagtcaccgtaagtgtgatgcgaggccctcattgcggggtcagggtaacttatggaagcaaacagccttctttattttttaatacatcactgtcacctgcgcttatgccaggggttattagaagaagaggggctctgggtggccatgtgttcatggctatgatgactgaaaaggccacagcatgcaacagagtcctcagatttacccccaaatgcttctcccaccctctattctctcttagcatctctccctgaacctctttcgccaaccccctaccaaacaaggtccagaattgaggtgttctggaattccagccttgctaagctctgggattaaggccagtcatttggaaaggggatgggggaagaggcaaaaacaaaacaaaaaaaaaaaccaaaaaaaaaaaaaaacaaaaacaaaacaaaaaaaaccaactgaacattaaccctttgggtccatagcactgagaagacctcaccatttcggccactggcaaatcagcatctcttggccatatccctgaaacctgagcttcatgtaccagaaggagacagttaagccaagtcaggctgatgaaaatctctccgttctaatgactgtgcagggtacacctgttccagcctctcacttgctctcattgtcagttggacgcaggtattgaatgaccactgagtgtggagtgcagcacgagggtgctgtggaggaggagagttcatgagcaagaagagaagcagtctcttgacctcaggaagcttgcactgtgtttggggaggcatggtcatgctcactctcttgctctcccagcacaaagggagtgggctaaagggtgggagggaggcagatagttactgggcctgaccctcttctcggggtcagccacagatcccagatcctttaccttcctcatctgcctgttttcctttatagttctattggagttaaaaaaaaaatgacagcagtgtcagtaacacacactcattttaacaagagaggcagtacaaagatatctataaagaattaacagtattccttatttgctctccatttcagctctcctctagggaaatgaatgtgctttatttttatgaaataatttcaagcttacagaaaagtttcaagaataatacagagagcacccatatcaccttacccatttggagtttactgatttttaatagtttgccccactggtttccttcctgatctatgtaaccgtagagcagccttttgaggtaggagacaggtggtattatctttttgtgtgttagaggtgagaaagctgtggcccatggagttgaggagtgtgcccaaggttatctaactatccgacaacaggtttcccacacaaattccacatgatgtcattcttgttttcatttttgtctttccttgtaggacttttttttttttcatcgagcctgcagaaggggcctgtcttgccttcacaaggaggagatggttgcaggaaagtaggaggtgaaaggtgtcctccaagtctcctcccccagatcagtcggacctcctggcctcctttggttttccctctagggcagaagcggtgctggctggagggggtccaggtgctgtttgttgcaggagcgccatcttgctttagacctttttcgtttcagacagctagaggaggtcttttacggtcctacttgacccccataaaggaagttcactccacaatacgcatctcttttcacatgaagaggcaacagagggaacaaaaggagcaaagcagccttctcctgaagaggtgaaaatatcactgccttttggagccagatctgggtttgcacactccaactcttggagtgatgtgtccttatttgtaaaaggagagttctggagtacattgggaagcaagtcatcagtcatatccacagcctcctgctcctgttaaatgtgtcctcctagatggaaaggttggaacaagctgtgccccataggttctgccatttttaggatctttctggcactgagacttttgcttctgtgatctctcattggaatccatttcttttgcccaggcgtggataatgcttttgtctaatgccagctctgccccatctggtcttaaaacgaggtgaatctgctgctctgtattgaaatatgtgatctagaaggagccataaaataggaaccttaataactctttctctctgtttcattatccatgcagttttcctggcagctgtccattccggcctcattcccacctctgggacatgtcaagttattgaggtggtactggctgtgggtgactatagatctgggccagcctgttcaactgggtcttctggggttggtcctgggtagagctgggtggatgtagtctaaaacagagaaggtagtgaggcccttcacatccattttaaggaagctgagtattgttgttgagagtggccctggcattgtcttcatcaagaatggggttagggatccggctgcagtgacactggtgaggtgagaggttgaagggatggtcagacattactgtctcttgagcgaggttctgaaagtctattccttggagactttcacaaactggagggagaccctgtgtgtccttggctgaaactagaggcccaggtcacatgaccttgggagagaagccactcatggcctgaggacccagtgagctccttgacctacgaggggccatcctgatttctccacttcccagtcaactctagaatggagtctctgcctgacgaaattgtggttattttgaaatcagcttgtcatgttccttgattgttttgggtgtaatagtctcttctccgcagcaggttgtaagcatcttgaaggccaggaccttgtcctttcttctttcattggagcagaggttagggaatgctggcttctggacccagccttggaccccagggttagcactccctggctcttgcagttcccccttgccccccaactccactattcccctggatcacagagcttggtgacagcagtgtagccccttcatctcagcgtgatggtgggagggggtcgtatgcattttcaaagcctttcctgtgtgatgtgccctcctggtgcagcttctctcatgagaatccccagcctagacgtctcttctcttccattgcagatcaagggttctcaaagtgacctgctgagccacgtgcattggactcccatggtgtgcgtgtgaaaattcctcagcccacacggatgggccagaatcagaattcctggagtgggagcagaactctgtattaaataagccccctcagataattccaatgtacactaaagttagagaaccactgtaatggtctgatgtccctcacactccccaccccagtacacacacacacatgcatgcatacacacatacacactctgttaaatggctgcttctgctgttgctaagaatactttgcttttcaggtgcttgtggatgggtaggaggcagtgcctgattttgagctcttgactaggaattgcgtcaatagttagaggagggaaggatcagaaaggggacctcagaatggggttatttaggggctggggagtcagaagaactcagaaaggggcctactgcattgctggtgaagcctgaatcttccatccactgttagcacatggctatgcagactctgattcccatctgatgccatatgtgcttcctccacagtccgggagaggagctttgggtcatgtgattagccttttgccctggacagcgcacctaagctcagcacatgtcttgggatggagctgcagaatcttggtgccgtctcccccttggaaggctagagtcttggcactgagaggaagtccttcctccatccccagcctcctgactccattgctagcgactcccagcaagttaagaaagattcagtgggaagggtatagggctgggagttgtctggatctaagcctttcttgctcagtttgatagactttggaaaatctctgtctctctgggaactcagtctcgtctggtccctggctttagcacagtgtgtccaccattgcagccatgggcgagaagccactagagctatgtctcttccttaggagagcctgggggggatcccaaggtgttggtggtttggaagggcagtgaccctgcatgaccaggatccatttgcccaggcacctgctctctgccagcctgaacacccgggagcacctcccggatacgacagccacccactacttctgcatggccgtggccacatgggcacagtggggtgaagtgaagatctcagactctggagtcagacagtctggggtttgaatccgagctccaacacttctagctgtaggatcttaggcaaattgcttaaacatctgacctttagtttttttcacctgcgaaatggcgggtaaaaactgcgactagctcctagggtgtgttatgggatgcagtgaggtgaagccaataaaacccttattagcacctggcacacagtaagcacttcatgagggttagctgtgcttgttgttcctgggtgtgtttggaggagacttgtaatcttgtaaagtgaagttcaggtcctcagagacaagtggtgtctggctgtgggttctggccattgaaggcctgggtggtttagaagggttttaagttagtgccttccctagaggtgggcacacgtctgtcacctgcccctgatgtgctatttatcctgccaagccctggggcactgaagcagcccagaggcggctactgcaaacaccagggagagatagagtctccaagaccccaaatagagtttgcaggacctcttgagctctggagcaagaaggaaagggacagagacaggccccagtgtcagtggcgggttgggagggagcagagcacagctccccatgtgcgttcaggtgcccagaatctgtttggccactttcatctgggtctgcgtgggtgggggcgtgtggtagcccagaacccacttggcaccaggtacaattttgtcttcagctccagtggctacttttctctcctttgcttcactttgaaaatagtcagcaaaatccttatttccataagcatttttctggctgtaaaaagctgaatcccaaacctgttattatagctgttcatgctattttaatctgctctgtttagaggtgagagggtagcagtgactctgcaattactgagtacatttgatccgtggcgcagccaccggagccggcagagaacccttggagtaggatggtgtcgtgtgtggcaaatcactttcaaatttactaaaacgatgcccctttgcagccatgcagatatcataattttcctccccaaggcttgttgaaatgcccatttgcttcctgccttacgcaggctcccagcacgcgccccttggcccacctgcctattccctttcattctttgtcttggccagattctgtctggtctctcttgccctccgcccctttttcttcttcctccctcttcatttcctgctcagaaatattttatattctactgactggcatgcttgtgaaaccattttccatttgccatggtcagaagaaaaatagttagcattttaaatctaccaactatttcacatttaaacaagctggcaagccgcaatgacgctgcgcctcctacatacagtaattgttgcatccctaggctcccttttctatctctgttcctatttcattcatttttctatttgcagccagcacagaatatgggcttctcccccctccttctctcctgcggcccgctttctatccagtgaccttggcttctctgagtgccgcaccgtaaatgaaatgtggcattgccacatgtatcttgataaaatatatcagtggatgaattgattttcatattgatttccttggacgagcaaggtgtgtgtggaaatcaagtgtctcttaatgatagtcctagagagagacaggatgcccagggaggagcaggctttgtttttctttcacttacgaaaagtttctgcttgttagcttgggagggaggcctgtttgctttgaaggcacactctctttctgggggtaaacagcaaatgtcccaagggtgtgtcctgatccctgagaagactgcatcatccaggtgaccgcctagagccttagggaatgtatccctctggactccgccagctgcattgtctttggagagagctgaaaaactctcaaggcatgttggaggcccttgtgcaccctgcagggtggagggtcttggctggagagtggccttctccctggccacttccactttcatatttcaggttagttgagacgtggcacttgtgaatctaggactgatgctgtgccccaagggcatgactgtgtataattcataagtgtcagcatcgatggctggctgtgtatgggcatgtgtgcttgcgagcacacgcatctacaaatatgtatgagctttgtatatgggttggctatgaatgtgggtaggcagcagtccctaggcttgcagtggcttttattagcgagctctggacaaccaaaaagacagcatccagtgaggtgatcaaaacttcatttcatctcctctgcagttgctttcccaattcactctcccaactgctcctaaataaaatagatgctttcagctgagagttgaatttctttatgaggctaagtaagcgtggcttaaggtgatactgtgcatgtgtgtgtatgcgcatgtaaagaaaatgaaacagttaactggaatattcaggatagagcgatgataattcattacattttctggctaactgaggcttaactggaaaatccttttagttcaagcactgctgaaatgctttgcaaaacagactaggatattttcctgcttttgtaagtagaaggtagtgaggtaattgcatcctttgatgtttcatgatcttgcagcacacgagggccggtattttggttatcatttgtgattgcacagtggcatacaggagatggagaactagcttggattcatgtttaccctttgatggtggttctcaatgggggacaatttcgtcctccagggcacatttggcagtgcctgagacatgtttgcttgtcacaacctaagaggttgtttactgatgtgtagtgggtagaggctggggctgtttctgaatttcctatcgtgaacaggacagtctccttctcctgctcccccaccccactacaaagaattatttggtccaaaatgccaatagtgctgaggctgagaaaccctttcaaaatttttgtcccaaaatttttactaaattcttgcacataaaatcttttgttttctctgtttttttctttttaagggtcaggtgctggaaacgttctgaataattgaaacttcgaattcattgacgtttattgttccacagaacaaatagggaagcctgccagtttgcagataggcaggcctgtccccagatggccctccagtgaatgcccaaattcattcagttatttagggccattaaaaaccatgagggccacactagctttaagttgagctaggcagaataaacaatccgagaggggggacatagctccccccctttttttcattgcagttcaaactaaaatgctcagagacttccggtagcactttctaatgatgcagggtttattctgcttaccgcgggtcagagacaatctgacgatgacagacttagaactgctttcagaatgtgtaaacatgttcattggtttgaatggctctaagtgagtcttcggcagaatctgtctggttttggtatgatatatgtatcttggggaaaatggggagattttgcatgctctgtatctttgactttctttgagaaaatacttgggagtcaatgagttcacataccaaaaaagccttatgcagaatctaactgggtgtgtgtgaaagggggagcggcggaagttaggaagactgaaggacctcctttatgacagtaaaaaaaaaatcttttaaacttaatttcaaatgaaactttaatgtcaaatgttctggaactgtcacacatcattttgttaacctatacctattaggtataggtataggtctagaatgctgtacaagacgggttaaatgaagtctgtgtgtgtctggtgaatgcatatgagtagttagagatacaccattcaatacttgatttatttgtgcaggttacctatcatggtaacctctggcaggggctcattatttcatataaactaaaaaggaaaaaactatgcctgcaagactgattgattttctgaatcactcacaaagggcagccatgcagcccaaacacacttcatctctcaagttttattttagccttttgccttacaatgtctgtcagtagggacaatggtagcaccagaggcctgggggtagagtcggagggatgaagttccgctgccctctagctgtgtgaccttagacaagttgcttaccctccctgagcctccatcctgccccctcgcaagcttgttttcaggataaagggatgggaaagccctgtgtaaattgccaagagctgagtaaatataaagtgctctggatattgttccattgttaagcaacggcaataccatttataaaccaggttttgagtccatctcgagcattgttcatgagaggggccggagcctcccggcaggcactcctttaagagctgttatcacggattactccatctgctgcttgctagccgaaatgctaaatggagttgtgggtgtacctggggtctttcttgttacagtatagactctgagggggtctagatgtgtctcccctcctttctctgagatagaagtgtatttatagcctggtgtaagtacaatcagaaggttcctataaaactctgttattactgcagtacaaagttagaaatgcttgaggtttcggcttcttggctcttccatgcggcaatgaatattttatgggaaaggaaatacttagtgtctgactctttttatagtgcagctactcacagtgctggtaaccttccaaatctcgccaaaatcaaaattgctgcctgtccatctctctactcccttcttcacaaaattgactggtgtcctgcctcgctgaggtgtccagactctcttggtggacgggtccatttacaaaatgtggggggtgcagttttcaatcctagtgaatgccctaaaccagaggcgttggctcctccccagccctgccccacccctggcaccttgtggtgctggtcagccccagcagggcctgctggcagagtgcccactggatcttccattgaaggtctccatctgccttttctgccatgcccctttcctgcatgcccactagccgctgagtggaggtggcccaacctctccaaagttcactctgatcttggaattcaaaaagcaacaggtgagtttgaggtccaacaggcccctgaggggcttttaaattttaaggcttgagcttcggctgaagccctggcacagagcagtcatcgggctggtaagatttccctctcaggtcctcttcctgtggtccctttagtgaccccacgcataaggcaggaaaattgggcctcagtggtcttggccctggtttactagatcagggactttaagtagaggaaatgggtctcctggcaggtcagcatccatggaaattgctcccctggtggcccaagggcattgtggcacaggtgttccactgggttggccccatggtcctcagagacctattacgactatagcaggaccgcagactaggctgatggccagattacagtgtcaaagaacacctttctcaggcagctatccctcatggatctccttagaggcccccacaggctagtgaaatgttgacatctcccatggaggtgggctcagtggcctcgtctttttaccagtacccaaaaagcccagagtggagagcttggcaggtgtgaagtgtggctcctgagatgcacgggagcacagctggttgtgtctcaacactggatcgtgacagtttttcttagcatgggcagggctgtgaaaaatgcttaacataatctgaatgtgggctccacacttaatttagtaggactctgcgagctcaccagcatcattgcatttgccttctgctctgcccctggtgtttgtcttggcgccaaagtaggtaaagggaaaaaatgatttgcaaacctctggcagctttggtttgatctcccaactctggttgcattgctgccaaacagagctgtattttcacatgacagcttcgtactgggccttttctttctttctttcttttttcttttgtactttttggtatccaaacttggtggtagcagaaggcaaggtggggaatagagagcttttggtatcacaggcttagaagctcatttgtctcttaagatgtgagggtaaggaaagggctagttattatttttgataaatgggaatggggtcagccaatggcttactggagaaactagatatagccctttatacttaggactgaccacacagttgaaattaattagcacagttgaagtaattagcacagttaaaatttagggttcctatgaccatgaagttgatgggtgggagataggtaaggctcgaagaactgaaaatcctcaaatgtgctaaaagcttcattattggtccttattcatattttaactcaccctcctcatctgtgaagtcattttttttaaacaatgaaaatggataaaagaaatggaaccagagagagaagcaagagagaaaaactttaattaagtgcctattgtatgatagacactgctgtgttcttttaaataaatacctttcagattaattccaaagctaagatttagcaattccctggttctgggattatttggccctaggatcagataagccaccagtattcactgagtcattcagactccagagttgcgccagatcccatggaagatgcaagaatgcatataggctgtagttccttctcttgggggttgagatcacacagctgtatacccatgtgtgcacacacagagacagatacagctagtggatcatgccggggggaactatacattccagtgctccagaaattcctggcatactgtgcctggggtattaggaaggtgacttgtgagtccctccgtgggacactccacctccttatggcagcttgtggctgccatgatgaaatgaaacacccactcctgaagatgtacaatttgtgagtgtggtagacaaaatagtgactccctaaagatgtcatcctagtctctgtaacccatgagtatgttagattacatggcaaaggaatgacttaaggctatttaccagctgagtttaagatagagaaattatgctgggttatccacctgggtccattgtaaccaacataacctcaacggtctttaaatgtggaagagggaggcagaagagtcagtgtcagtgtcagagtcagaggaggagtgagccatgggcccaggaatgagagcagcctctagacactgaacaaggtagggggacagtctctccttgaccctccagaagccacaaagccctgccagcaccttgattttagcctagcgagacccattttgaactccttccctacagaactataagatacatttgtgccattttaagccactcagtttatcgtaatttgttatggcaacaaaagggaactaatatagtgaggcagaagaaatctgagtggctcatccttgggcaaatgggagccagtgctgatccttttactgttctcgggtgctcttgcaacaggaagtgacttgcagaagtccttttttatctgaaatgccagggaggatggactcttattcagcctagcttctattcagctcaaaggaaagaacatctgcctttttcccacatcttctctgtacccctcacttccttcttgtgggggagattccttttcttcggtgagttccctttgcggtgtggaatctcgtggcaagggctctgagtaaaggaggagggttgcatggaatgccattgaattcattaggcttggactctagcaggaatgttgcctggggtgctgatgtccttctcaaccttcctttgctggagtccttcttgtaacttgtcttccttttgtgaacaacctgggtgtagtttttaaaataagcgaattctcctagaagtgttaaaaatgagccttcaagtactatctcggcattttgcaaaggttaaagcccccactgtttgggggctgagggtgctctatggggggccacccaaaagcaactgtggaaacagagtctggcttcagtctctccagatgttgtgcacataagggagggactcttgagctcatagatcacagatctgtccacaggctgtcagtaggaaagagcatcttattttacagatggggaaactgaggcctagagagcataagtggttcatgcaagatcttacagagagtttgtgagagtctgagagctgttccccctactattgcaacatttggaatgttctgaggttcttaccttctattatcagtttgagggctgtagatgagttgtggtagctacagagatgagctttccagtgtgcccccaccaagagatgaatgaaagtcatcatcgggcagatcactgcctactaaaaggggtgggtttttttggggggaggttttactcttcgtcacagaacttgagaatatttctactgaggatgactttgtctttggggcttccattttatttttaagattcaagtgtagttttaactgcagggcattagctcccttgtaggtcacctcgtgctgtctctggggtttatgactgagctctcattccttagtcacatgtcctatactcacacttcctatcccattttcctgcctcaccaagatcaccacaatgatcccaggttctatatagcatttcttttctggaggtctttaaaaatattctgggagatctgtctggaatgcttgagtacattcatttattcctgtatgcatagagggcccagggacctcccaggctctctgagccctctgattcttagagggttaaactattatggaaacagacattgcatctgtgtcttctcttgtttcctgcatgcagcagtgacctttggagtacattgttcaggagaccgacccttttctaccatttgaagtctgctattctcatctctctaccaaaagagaaactaaacttcattgtcgtgattaaggtcacagccaacagcagttaaagaagccgttggtcttcccactcataccgctgccctctccctagctctcaggaggaagagctctccaaaatggaagtgtcttgggaaagaaatggaagtggaaagagaaagatgaaaaggccaccaatggcacttcccgtgtctcagcctcaccagagaaggaacttggccacacactggttgggtataccaaagtgacacaatgtggatgttccagtggcaattaagtatttatatgactagacttgaggagttccaggccatgacacttccaaatccttccagcccgcttgtggagagaggcccggaggcttccagcgagacaattagagtgtgaattagattgtgtcttctggaagggagatgaagttacctgcctactctattacagtttatttcattaaggttgaccatgcccttttttttgggcagagggaataggatggattctctggagaaaacagtgtagcaaggcaatggagaaatgtccacactggagtaaggggctttctgggacctggatggagtctccttcctcccctagggaataggacagaggtgggaaaggtgctgcctgactgctctgtgcacatctgcatgttggtgatgagtgtggccagccccatgctgtgcatcggtgagaggaccgctcaggcaggtgttgctgtgctggcagcttcttaggaaggcaaggagcaaggcgtgggctgtggggcccttggggcagagcctgtcatggagtgggatgaaagggtgcacgggacctgttggcagccccagcggccaggctctgttcccaagctggagagagaggcaagtggtgagggagggcaggaggaccagtcatgggtttaatgcaaaatgacagttacgggggttgccattttagagtaaaacaggccatgtgactgaggagcaggtagcattcatattattcatatttcgagcttggtagatgtagaattttgcagtggaggccaggagaggatgtgagagctgcaggacagaggcataggtttttggaggtggttgtggtgttccccgatggcaatcaacttcacggagagaagaggttattttctacttaggttgcctggagcctacattccaaacttttagtcctcttcatctagcactaagttttgcatctcccttattcctgtcatacattattagtgtgcactgttttaaagtcttttacatacatatgtcttgcattccctacttaattgtaagctccttgaaggcattgcctgtgtattatgtttctttgaatctctctgtggtggctaatgctctgccctgcatttagtaggcaataagtttgtgttgagttttgagtcaactaccactcttttctcccttcctcttttttaatttttttttaaattattttttattttttatttgacacagagtcttgctcggttgcccaggctggagtgcagtggtgcgatctcggatcactgcaacctctgtctcccgagttcaagagattttcctgcctcagcctcctgagtagctgggattacaggcatgcaccaccatgcccagctaatttttgtatttttagtagagatggggtttcaccatgttggccaggctggtctcgaactcctgacctcaagtgatccacccgcttctgcctcccaaagcgctgggattacaggcgtgagccactgtgcctggcctactcccttcctcttacaaggctccttactcatttcctgcgtctcacctgctctctcagcccagttttctaaaaaaagaggtaagagatggatgccagtctctttctcctccagagtgattttgtgaggatttgtacaatgcaagtcttgagatgcaaatggacatctaggaacagaggaattgctggagcatggagaccacacttctgaagatggaaggagacccttctccaggctgtcgcttttgatttgcggttttcccattgccaattgctcacactgatccccagtcctgaaggggatgggggctgccgctaattccctggcatctcatgacttcctgttttcctccagttattatttttattgtacttccttcctgcttcttcactctccggcttcgccagtttgttccgtgtgatcatttcagc

SEQ ID NO: 2285 - DNA, 2228 bp, Homo sapiens
tttttttttacccttgagtcaattctcattgattatgaagagctggtatagcaagatgggaaagagagaggaccctggagctaggttggtgagatctaggctctttagaacttggattcggtcctcacagtagctctgggaggctgatcatgctattcccaacacacagatgtggaaatgggtgcagaaacacatgtgtgttcacatagccagcaagtggtttatctaagtgtcactgcaatgatctgtaggactccaaagcccatgcttccagctggaaaggcaggcaggggccttgcatgctgtgccagggttgggacttagtcctgtaggcagagagggtcaggcctgtattctagaaaggtagctcggtggctgtctggagttttgaagtgaagcaagtagaaattaggtgtagagaaactagttcattaaagtaatgtcttgagagatgagggcctgaacagaagacattaagacagtggcagtggttgcggagaagagggggcttgttggaatccatagagcttagtgcctttggatactagaattgcatcatcccttcccatttcaggtctgatgccccagggatgggtgttggagatgctgactatgtgcaggctaaaagcaatctctgcagaaaccaaaagtgcctcctttggtctctgctaacagctagagaaaggtggctgagcacagtccgaaagggccttcccttccctgtgccaccccagccttatcattcctaactttccaggagcatcgcagagaatgaagttggattcctcagactgcattttgggaaatgctagtcaaggttagaagtgtggaagggaagacgccttcctggggtattgtctgcacacccctcttccctggtggcacaggggacccaccagggtttggtcctcagttttggctattccataagagttgatctgccctagatggggttaacttgtggtcaccaaacttgcaggggttgactgggaagcaggagtggcagtgaacataatggccagccccaagaggagtcgaggccagcctcctctgacgggtgcagtctctgcggggcgccaagccatgctcagggaagcgggcatcagagcccaaggagatgattggctggggtctgcatgtcctgtcatcggtaggacgcactgttgccatgtcaggaatatactggttttgtgccctttcccctagtcagtgccagacgtggtcataaacttgcttttgggcttccgtttttccaaattgtgcaacatccctgcccttctgagagtttgtgctggctctggtcaggccggaggtcaggtggtcagattctggctttatttgggctgtgttctcgctgcgaggaggaagccaggttacctctgttggacctgcctgctcccagcatctccagcaacaagctgtctctgccggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaa

SEQ ID NO: 2286 - DNA, 2894 bp, Homo sapiens
gtgaatatagatataaagatatagcagaaagatgcctacaaaggcaaaagcgcttggggcccataagagccataatcaggccctgaaagccactggcacattgtgggagcccaggcttcactgctgagcacctcctctgggccaggcactattctcagtggtagaatagaggtgtgcatccgcccagcctctgcctgcaaagaaccatcagggtagacatccttaaaaacaggcaactacagcactgtgagctaaaaggagtatgagatgtagaatcaccggctttccttctgccctcctgctgtgggcgtcaagtgctctctgtccaggaatttttttcttccgtcttacatctttcatcaaaggccatgtctaggttatatcaagtcctgcttctccacgtatgccaccaaatctccatttaagaatcctgcccattctctggtcccttttagccattttgccaacggggtgagtatgtctggggtgtttgtggctaaaagtgcactggtggtagggacagtgtccctgcaaatgcttccattattgtccctctgcctccagggccctcagtggacctacagttttttgcctcatcttttctggctggactcatcttgtttattgcccaccatgacggggagtggaatagatggggcctggtggagagccagggtgggatctgaatgggccacgggggcattgcctgatagatctgttgtgggatgtgtttttttttccagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgagctgatcgctataactgccctttaggctccaggctctgcacccatgttttcttattcaattccatatcagttctggaagatgagtattaaagtaccattttacaaataagaaaactaagcctcaaagaaattagctggcaatcccaagatctcagtggcctaaggtgtcagttggtcaactgtggcgtaacaagtggtcctcaatgtagtagcttatacagcactggtcatttactttgcttatgaatctgccatttgggtagggcttgtggggatggcttgtcgcagcttcagcttggacaactgaggctggacaatccaccttccagatggctcactcctatggctggcaagtggtcagcatctcctggcctaggagcgggtcagaggcctcaattcctgtcacttaggcctctccaaggatgttcgggattcctcccagcatggtgactcttgggttgcaagagtgagtgaccccaaactgcaagaccaaaggatatggtgttttatggtcagcctcagaaatcccattgtgtcacttacactgtactcttggtcaaagcagtcacaaaggctttaagagggagggcatctagattccacctcttgatcgggaagtgctaaagttctagaagaacatgtgaaatgggagattttgctccttggaaagcatacccaactgggttaacaattctgatactgctagacatatataaaggaaagggatgattaagcaaatgaaggacagatggttggggccaagtttctcactgttggagtgggataagccagggcaggaagccagaatgatccatgtgcaaaaggactaaagttggagacatcagtatggactcctgtttagcttattgtagatacagatgtttacatgtggaagtatgcataggtagcagtatgcatagatatcatggatatattagtatcatactaatataagatgtaagtaataggagaaaatggtgtttcctctgtaagatcttctcagtttttctgtaaaccaagaatactttttatgtgcaatctgctacacctaacatacagtcatccctcggactggttccaggacccctgtgaataccaaaatctgcagatgctctagtccctgatataaaatggcacagtattttcatataacctgtgtgatcatatactttttttttttgagacggagtcttgctctgtcgcccaggctggagtgcagtggcgcaatctcggctcactgcaagctccgcctcctgggttcatgccgttctcctgcctcagtctcccaagtagcatatacgttttttttttatacacatgggcaaatagaaacattcttttgctatcagtggagagggtctaaaagaaatgacatctcagtagcaacaagcacacttaatgcctagatctagtttccaatgtcattcttcaatagaaggccccttccaagtcatatatatatatacagggttccttgaagaaatggtcaattctaggaccaaggcaggaaatatacgagatgagcctggaacttcttttagtgccaaaaagtaaggaagtgcttaaataaacgcaaacaaaacggaagcccacattgatggggatgtgacaagtggcacctgtgctgactgaaagagcccccagtggccaaccctggaacaatttagcaacaaaataaatggccccaaactccagtcttatcatgagaaaaaagaaaatcagacaaatcccaatcgtggggcatcttataaaatgtctaaccagtaccccctcaaaacagtcaagaacaaggaaagcatgaggaactgccacacccaagaggagcctaaagagacaagaccatgggccgggcgcggtggctcacgcctgtaatcccagcactttgggaggccaagacaggtggatgacctgaggtcgggagtttgagaccagcctgaccaatgtggaaaaac

SEQ ID NO: 2287 - DNA, 1763 bp, Homo sapiens
gcttctaatagcactttagatggagtttagggtttccttcatataagatcatgtcatctgcaaacagagacaatttaccttcttcctttccaatttagatgaatgttatatctttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgaggaaggtaccttgcttccccttggccttctgccacggttgtaagcttcctgaggtctccccagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacattccaggacccccagagtatgtctgaaactgcagattgtactgacacctacatatagtatgctttttattctatgtatatacctatgaaaaagtttaatttatgttaggcacagcaagagattaacaacaatagagcaattataacaatttactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgatacagtttggataccctagaaaaaggaatggttcatctcctgggtgggaggaaacaggacagtgtaagatttaatcctgctactcaaaatgcacaattcaaaacttatgaattgtttttctgaaattttccacttaatattttcagaccatgattgagtacaggtaactgaaaccatggaaagtgaaacaaagcataagtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtg

SEQ ID NO: 2288 - DNA, 15759 bp, Homo sapiens
cagtggcggcagctgctggcccggcactgccccgtgccagctcgctaagcacttggtcccagctggagagacttgataggactttgccgttctgcctgccacagctgttcacttctcaggaagggagtccagaagctatgtggctgcctgtgtggtcagacgtgggtgagaagatgaggatggatgcttgctcctctcatggaaacagataacttccgtacctgccaaaccaatggcagaggagctgggaagctcacaggcattgctgaggcctttgaagatgttagctgagaaaggcagaccagccagcatggagctgccctccctcccactcagcgcctttcctaggccaaggaccaggtgaagccgccttgaccctgatccagccgcctgggttgctgctgccggggaaggcaggcctggtgtggacggaccccctgacttttcaagacacactggaggtcactgagccatgttttgagtcagttctgcatctcatcaagacacaggtaatcagaagaggggtttggaaactcaagagcacataagtgaacaaaacatcaagcttgctcttaaaagtttttcaatcttacgcatgttgaaatggcctcactccagtcttgctcgaagtctgctgggtaaactgcaagttctaacagactaagaggaagtgcttcagtcacctaaggtcgtattttattttgtgcttttccaagcagtgggattatgtaatcacctcgcattgtagcagtcttgctgttcataatcttgctattcatgcagtggggtatagagaggcattaatttaggtcttcatggatctcctgaatccgcaatgatcatttgaaagaagaattccgagcagcttagtggtagagataagacccaacattactttgctgatggaatggtggaggtgtccttttctgctggtccccagataagtaaggagaccccaggggtgaaaaaaccacaggaacacagctcatccccaggaaactggtggacaaatgagcaaagatatatgtgctagggggtttaacataatgctgtggaataaacagggaattggttgaataaattattatacacccatacccatacaatgaaaaactttgcagtcattaaaattgatgtttttctataattaataatattgagcgttactgataatataccattaagtgtaacagaagaggttaagaataattatgtagactagattttcattataaatacatatgtatgttttttatctagggaaaatgttagatgactatatgccaatattttagaagtggttatctctaagtggtgagatttttgaatattgaaaaaacgctttttttctaagtgcttagctgtgttctctaacttttctataataaaataattgtattgcttattaaaattggacagttagaaaatgaatgaagttggtggatgagaggtaaaaggtatgagaggaatttagaaagtaagccaagctgagtaggataagcaaactatgcaactaacttttttggggaaggtgttccctacctgagaaataagcacgtaaaagctggatgagaatgggtttctggggaatgacccaaatctgttagacccccggggttgggtacatcagggaacaataattgttcctccatacttcttcctctcaattttccattgtaatatcacatttttctgggtacatgactacctggaatattggtcacatttttagcctttctggtgattaagtccaggccagtgtgggagtaagcaacctttaggaagcatccgtccggagttttcttttcctctcctccatcttgctatgtggaatgcagacatgatccctagagctctagctgccatcttgaatactgaggacgagggccacacctaatagggaaggggcctgggtttcagagcttccacacccatcctggattacttcacatccagacttttggtggagagctaaataaacttccaccttgctgaatgaactgtgaggctttttttttattatttatgaaaaacagaaaagagaaaaggaaagaaagggagaatgagaagataaagaagaaaagatctaagcccctttagatttgcataatgataatatcaatagctaacctttactgagtgcttctttcttgtgccagattctttgctaagtgctctaattctctttgctaagcactctctaattctcacaacaatctttgaggtgtgtattatttcaaatgtcaatttttagattaaaaaactggggatcagaaaatgatatggtttggctgtgtccccacccaaatctcaacttgaattcccacgtgtttgggaagggcctggtgggaggtaattgaatcatgggggcaaatctttcctgtgctgttctcatgattgtgaataaaagtctcatgagatctgatgggtgtatcaagggtttccgcttttgtttcttcctcattttctctggctgctgccatgtaagaattgcctttcacctcctgccatgattctgaggcctccccatccatgtggaactgtaagtccaattaaacctccttttcttcccaggctcaggcatgtctttatcagtaacatgaaaatggactaatacaataaattggtacaagtagagtggggtgttgctgaaaagatacctgaaaatatggaagcagctttggaactgggtaacaggcagaggttggaaaaatttggagggctcagaagaagacagcaaaatgtgggaaagtttggaacttcctagagacttgttgaatgacattgacaaaaatgctgatagtgatatgaacaataaggtccaggctgaggtggtctcagatggagatgagaaacttgttgggaactggagcaaaggtgactcttgttatgtttcagcaaagagactggcagcattttgcacctgccctagagatttgtagaacttcgaagttgagagagttgatttagcgtatctggtggaagaaatttctaagcagcaaagcattcaagaggtgacttgggtgctgttaaaggcattcagttttataagggaaactaagcataaaagttgggaaaatttgcagtctgacaatgtgatagaaaagaaaatcccattttctgaggagaaattgaagcccgctgcaggctgcagatatttgcataagtaataagctgagtgttaatccccaagacgacaggggggtggtgggaacatgtctccagggcatgtcagaggtcttcatggcagcccctcccatcacaggcctggaggcctaggaggaaaaagtggtttcatgggccgggcccagggtccccgtgctgtgttcagcctagggacttggtgccctgtgtctcagctgctacagctgtggctgaaaggagccaatatagagtttgggccatgacttcaaagggtgcaagcctcaagccttggcagcttccacttggtgttgagcctgcaagtacacagaagtcaagaattgaggtttgggaacctctgcctagatttcagaagatgtatggaaacacctggatgtccaggcagaattttgctgcagtggcagggctgtcatggagaacctctgctagggcaatgcagaaggaaaatgtgaggtcagagcccccccacagagtccctactagggcactgcctagtggagctgtgagaagacggccaccatcctccagaccacagaatggtagatccactgacagctttcactgtgtgctggaaaagctgcagacactcaacatcagcctgtgtaaagcagctgggaggaaggctgtacccaagctgcccaagaccatgggaacctacctcttgcattagcgtgatctggatgtgagacatagagtcaaaggagataattttggaagctttaagatttgactgccccacttgattttggacttgcatggggcctgtagctcctttgttctggcctatttctcccatttgaaatggctgtattcacccaatgcctgtacccccactgtatctagtaagttactaacctgcttttgattttacaggctcgtaggtgaaagggacttgccttgtcttggatgagactttggactatggacttttgagttaatgctgaaatgagttaagactttgggggactgttgtgaaggcatgattggttttgaaatgtgaggccgtgagatttgggaggggccaggggcagaatgatatgatttggctctgtccccgcccagatctcatcttgaattcccacatgttgtgggagggacccagtgggaggtaattgaatcacaggggcaagtctttcctgtgctgttcttatgatagtgaataagtctcatgagatctgatggttttaaaaagaggagttcccctgcacaagctctctctccctgctgtcatccatgtaagatgtgacatgctcctccttgccttctgccatgattgtgaggcttccccagccatgtggaactataagtccaattaaacctttttcttttgtaaattgcccagtcttgggtatgtctttatcagcagtgtgaaaacagactaatacaaaaaatttaaaagttgcccaagttcacaaagctagaaaataatgaatttaggatttgaactcagtatccccaagcccaagcctgcaattctctttttctttttttgagacagggtctcactttgtcacccaagctggagtgcagtgtcatggtcttggcctctgtagcctcaacctcccaggttaagtgatcttcctgcctcagccccccaagtagctgtgactacaggtgtgcaccaccacgcctggctaattttttttgtattttttgcagagacggggtttcaccatgttgttcaggctggtctcaaactcctaaggtcaagtgatccacctgcctcggcctcccaaagtgctaggattataggcgtgaggcattgcaccaggcctgtttcttaaaatataatctgtggtttccccctatgagaatctgggaggtgttaaaaatgtgaatgccttgatcccacccctgactgatttgatcagaatctcctggagtaggattcaagtagctgcatttttatcaagctccctcaccaagtttgatgctactgtaggtctaagctatatcttattctaactcaaatgggggcaatgaatggagttttgacataggctataggctttgtaaattgctagctttctttctttcttttcttttttctgaaagatatttgcagtgcaagtagcttacatattttaatgacttactgagagagcatattaaactaaaattgcacaaaatgctcaaattgctttgaaggtgcctcaaccttgaaaccctaaaatagtactaattgcctattttcatcttttctccatctcccctcaacataaataaatattgtgcaaatgaattatatatagattctattgttaacaagaagaccctctttcttctttttctccgttttggataatccctcctctggtagtctcatttctatgttcatactcacagaaaacattggcttccatagtgcaaagcagggcagagggaagcaggaagcagtggagcaaggggaagagagagggagagagtgaatgactctgaagaggaaaggaaattaacatttattggggttctgccaggccacagacatttttcttacattattgcactactgcactttccatgtattatctcattcatatgctctcaaaaccctatgaagtagatagtattatcctattttatgatgaggaaacagaagttctgatatgggaaatgtcaccaaacaaggtcacacagccagtgtattggcagatccaagattggctgaggctcgtttgacctgaaagcctgggtgtttttaccattcttattgtctgccatccacctgaagtcacctagcatgtttttccatcataaaactcatttggggctctgttttgtaatcaaaatctgaatcgaatgtgaatgcaatttgcttgctgctggttgtaatagcatgaattattgaactctagagctctcacataaaagttaagcatctgaagagactcagctggttgattctatccagtctcccactgctctctcaagggaaaaagattccaagttcaacattagctctcacctgttgtattgttggcactagcttttctcacccatcattgttttctgtctctacagatgcaggggcgagaaggcacaggaataaagtttgtgtggagatctcacagtcaggtcatcaccaaactctttttccttgtgtatacctaaaatgctttccttttctgatatttaaaaagctcaagactctatgcttttgtaattcacctattcatttgtctcctcagtagggtctggaagccacaagaggaatcattttgatagaaagataatgcataggcttcagagacaagagcttgcaggcactttagcaataaaattatgttgttgctttgccaagcatccccttctgtgaggaaccacctgttctctccttaccttctgataggcaggttattcaccctggccacatcatacacacaagggtacgtgggccaggctagccagttagaatatcccaaaccctcagcacagtgatgaggcatgtgcctcaatcagggataattagtattttctctgagatttgatatacagatactgagaaataatctctattgcttttgaattatgagccttcaggttgtggactttggaccaccagtgcaatatagtgtagttcaatgttggctattatattggtgatatttcccaaccagtagacgcactttcctgaaagaagctgtagaaggcagcagaactagatatagcaagctagataggtaactagatagctagagccctgacaataaaatctgaactcctagattaaatggtgcctggttattcagttagatgagatctccaattctctatatccccaatttactgttgattacttaaattacttggagttattttttgacacttgaaactggaccagtcctaaccagcacatatttgaaacccagaaacaaccaacttcataaaaatgtaatatccaaatagcaaaattcagaaacagcaggacgttcagctgccagtgagccctgagtttatttccaattttaaaaataaagggaggtaaaggctgataacagggtaaaagaaaaggaatgtaagtggagtagaatcaaccacagtgacacatacaagggaaaaagcagagctgagatgagaactcaacctgctactgtgtaataagctctttgacacaccctggcaatgcttcccaccaatttagaaaggttggcctggttctctctactcctcgcatcaggtgggaccaacatcaatatgctgagctaatggcttatcaatggtttacttccctgagctggtcatgagattgcccatcactggagaatgcagcccaaaaccaaaaccatcctggcctttgactcaagttatgtatcatttcccaggctaagttatctgctgctggagaattcaggatttgtgtctgaagcatctctgcctctctatctttgaacactgtacacaagtaggtgtttaagaaacgcttgatgaatgaatgagtgaattgctctgaaaacattcaggaattactgttctcagatacatagaatgcatgcaaggttaatacaaatggctgataagaattactcaagtgcagatctattggatgagctagggaaaagaaggattgttttcatcatgttttctaaacatcccccaattttaatgatttggtgttatacacacttacacaaaggttccatactcaaaaagttaggcatcactgaatcagcaaaatcacacaggtttctttgctgactcgcttttcagaagttttattttgtgaacatgatttgcataattgcatctggggcactttgctggaagagcccacgtgtcttgggaatgctgggcaagggaaatgtaactttccctgtgggttcactccactgataaggtaaggggtcaaaaattgtactgtaccctaactttgtagttgctgcttaaccaacgaagccactgtgcctccttcgctcatagtgataatctttttggagcagatttgttgggggaaatagagtaaatattagaaagggctggttagcccttgtgtatgttttctcttctctgataaggagggagacactatgcaaaccccagtgctcacccaacaggaggatcagatccacctggccttggcaaatcccagatgatccacttctgggtgcttgagatcagcagaaagctcacagtgatcttaccaagtggaaatccctaaatccgacattcagatttgagaccagttttataagacactctgcgtgagttttttgtttttgttttttttcatagaaaactttacttcaggagaggtactaggatgcaatagttaagaactcatgttagaatcaagtgggatgttggtttgcattctggcttttgtaactttggccaaaacatttagcatccctgatccttagtttggaccatccacaaattggggctaatactgttatttccctgtgcagcaaactcagcaagtctgggttatccaaaccctgcatattctgacaaaagttttggctcttgcctgggagataacctctaagtccttagaatattttggctgatcagagagattttgtctacctggaggccttgggtcacacgagatagtctaagctaacaatgtgacttatggtgggggctctgggccaaacggtagaagcttgacctctggaggggctggagactgagggcagccacatgggtggtctgagatggtaaatgtcatcacacaatgaaatctccagtaaaatcctggacagcaagtctctggtaaaaagaaatgctgtctgcatgactccactgggagaggacaactggaagctttatggaagctcctggactctgccctaatgtgcctttttccactgctgactaacttattttctttcactggaataaactataaccatgagtataatggctttgctgagttgtgtgagtccttctagtgaataactgaaagtgaaggtgatcttgggacccctgagcacacttcctcatggttttggagacgattaatgtgataaacaatgtagaatacttagtggaatgcctggaaaataataagtgctcaataaataaggaagcttaggagagaggggtaataggcctgctgttatagcttctggtctgacttcccagctctagtcatcattcattccttttttgctttcaacaaatatttttttgagtgccgaccatgctaggtatggtcaagacccttcatggagcttacaatctagttgaggaaacaaagatcagacttataaacacacataaatatataattgcaagctggagtaaacgtgatgaaggaaaagaattatgttatgacctcatgggaggtcagagacttgagggatggaaaggaacccaacgtagggaagattctctttattagctgcttatttatatctgaaattctgttatgtcgtgtgacttttgttatgtgtttctctctttatttattttaatgttttctccgttgtatgttctcactgatatgtgggagctaagctatgaagatgcaaaggcatgagaatgatacaatagactttgggggcttcgggggaagggtgcgagggataaaagaactcaaataaggtgcagtatatattgctcaggtgatgggtgcacccaaatctcacaaatcacccctaaagaacttacgcatgtaaccaaacaccacctgtaccccaataacttatggaaaaaaatgtaaaacagagaaaaaatattttcctgttttctcattcctggactatattagcaagtgtctctctctttctctcccctcagtcttttgctttggcctctcttcttccagtctttggtagaatgctaagacatcataggctcccttttccttctttacctaactcctgccactttgagtctgtgggcatgacatcccttccttccttcttcaagccaatatttatcaaacactcagaatatgccagcctttatctcctggtccctccttcatcagttccagggttctgcagcagggaaaagggaaggaagtaggagtttacatcacctgggcagagaaagagctgcttatagtcagtagtgccttttcagggctgccattggcgtattttcattttttcctccaaacatttccctgagatttctttgaggtgatctcatttccctatcctaggaggtaatccaagatatgtctagagccatatccctggctccaaacataagctggttctcaataaatagcttgggattgtttttgaaatgggctagatgccaatgcccagagctgttcaatgggataggactgaactccccagggaagcaaaagatttccgtcaccatctcttctccaccagggcacagggcacctgtggagaagggcaaggggtacgtgggagcctgaaggatgagggaaagcgccatctcattcggcctgggaggcaattctgccctctttaattatccccctttccagattgagcttttccaataggtgtggcacgtggtgggtgagtctttttccatatggtttgagaaactgagccaaatacaccatgcagagtgagaaaaaaatgagtcaaacaaccctcccaccactacttctcccctggcttagaggaaaagcaaagctctggttgctctaccccggctttctcctcggagaggtttttggagctgaaggaggaatgactaatgacgtggaggtttctcctaatgcaaccagctggcctgggggctggaggtggcccctgaacgtgatttacaacttatacactgtgtccttgaatgaggtactgaacctctctgggcctgtttcctcaactgcaaagtgaagaagatgatttttaccattcttcccaactctaacgataacagacatttatttatttatttatttatttatttatttatttatttatttgagacaagtcttgctctgttgcccaggctggagtgcagcagtgcaatcattgctcactgaagcctcaaactcctgggctcaagagatcctcctgcctcagcctccaaaatagccaggactacaggcacactccaccatgcccagctaatttttatttttgttttgtagagatggggtcttgctatattgctcaggctggtctcaaatgcctgggctccctcttcagcctcccaaagtactgggattataggcatgagccactgtaccagacccagagctttttaaaggtgaataatgaaagctccagaagtatctttaaaatacatcagaaatagaggtgacaggtgagatgaaaccaaattggcaaaatggtaataactgttgaaactttagtcatgggtagaaggcagttcattacattctctgcttttcattattctatagagttgattattctctccacttttgtgtatgtggtcctcctcaaaattgccagtgaggtaaaggtgccacaagctgataggctgtcgtgtgaggaatgaagtgactgtaaatactcccaggcccttggggagaatgaccttgaagagaagatctgaaggagctgggcttgtcctcaattgtcaaaaagttacatcttgatttcaagtggtttacttaattaatctccatcttttaagatttacaagtttgtgtgtgtgcgtatttatacttatttgcagtttaattttgtgataccaaaagaaaaagcctagcatgacccttgttggagaccacaagccctgggaagttggacttcttccctctcagttcagttgtccctgaagccaagacttttttcttttttgagacagggtcttgctctgttgtccaggctggaatgaagtggtgtgaccatggctcactgaagcctggtcctcctgggctcaagcgatcctcccaccttggcctcccaaatagctggggctataggcatgtgccaccatgctcagctaattttttaatttttaggagagactgggtcttgctatgttgcccaggctggtcttgaactctgggctcaagccattctcctgcctctgcctcctaaagtgctgggattacaggcatgagccaccatgcccagctgaagccaagatttttaatcaccaagaccttctgcaaatctgaagtttgcctctttcaaataaaaattcagagcattcttctcatttataccaagtgaaatagacatgaccttggagaagaagtgccctgcctgcctatagagctgaacttcatggaaggagcgagtggctgtgcatcagaggggtgctaaagactcacacaccatttgtccactggacataaggtcatttctttcaacaaaaagtctgaacttagggaaacctcctgaaagtctccaagaaatgggaaagatcactgatggatgagggaacttgagacacagagaggataaataactcatctcgggagtcacagctagcagaagtgatactgagaaacctttgggacaattcaagaggaggaatgactggaggacaacagcagaaatgtgaagaaaatcagactgacagggttgagtggctattaacactctttctttaaaggatacagacccaggatgaagtcagatgtgagatttcctctccaattgagggtatgtttgcagcccctacctattatagattttggaaagataatcatctacactaataacctgaaaatcattcgaaccccaatggacaagagagattttgtgaggaaaattctccagaaggaagaggaggctgaggaagagtctctgatgaacaaagaagaaagctatggaggcagggaccagcacgatagacctttggtggaggcagaaagcacattaccccaaaaccggtatacacaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagttgcagctggaagctggatggacagatgcaaattttggaattttctcctggttgactgctgtgcttagagttttgatccatcagtggagggaaattgagtgaaaatgatccacatgccaatctgggctggcatctcatcgcttagcccagcgtttgtctcacatcttgtgtgtaatgccagcaactaaatctccaagctcgattagcaatggttacagcccagtgagctcacatccagaaacccccttgaaatgatgtttcatcagggagaactttaaccacaaaacctgcttctgaaccaactgaggaagacacctcaggtactgtgactctaattctggggcagttgttgaataaaatatgccatgactttatggatttattttctctctaagttgcatgagtaaaatgagtcttgtgattttgtaaaacgtagctgtgaaagagacctgaaaatttgagacttgctgggaagagttctttatgcactcaggtgtggaggacaggtgcaggggaaatttgttgtgtgatgctccagtacccattcctgtcttctccctttctccctctaactatatcttgaacatctctcttttctatatgattttggtgtggagttgatctgtcacaaagttcaaggattagactgtaatggacctaagccaatttatatcttctttccctagctgcagttattagtttgggtttagtcaaatgtcccatttcaagacaatgaaagggatcccaagacctggctatgtgctgttggaactgacattttcttttccctggagcatttagggttagcatgtgtggcttgaaactggggcagctatttggttgtcataagagtaaagctgaagctactgtgtgtatttggggcatgtctaccacatggaatctgatgatggaacaatccctatggaagggagagctaagagacagaaggaagatgagacatcaagggtatttggtaataatgtctaaactgctgaatcaacgaagttcacttaaagcccactctgactctggatcaattgcttaaggcatttcagctgagttttaaacactttgcataaaaattcctatctgatacaattaatattactaactctctgctctgaatagattgtgtttgcttggtaatttgtctggcttcttccaaagacttagtatacttgacacttgatggccaatgggtgctgcacagaccagtaaatggtgaatctagcttccaacttggacccagctttctgtttgcatgtctagtgtgcatttttgttagggttgagagttgagtaattgctttatttgatagtatttgctgtgttttaatagaaagggaaataattatatatcaatctgctaaatgactttctttcctccttaagatctacctttaacatttttttctagtgattgtggaactcaagcccacatagaagtggtatcttctctgacttttggctgctgaagttttattaggggtgccctggtaggtagggagtcttgattagtctgtatcacttaagataattcctttccctatgtgcttcttggtttagaagcagccaaatttttgtgacctcattttggccaattgacacaaaacatgaattggaagtctgctgggcatgggggtgcttcaggcaagtttcttaactagttagagaacagaagacccgaatgtcattgaattgctttacctcttgccttcttgtgtgagattttaagctagctgtcagagtttttttctttctttcttaatttatgtcaaagaaagcatcctgatgcattttgcaaggaccacatgaagtagggaattgttgatttccccaaggagggatccaagagccaaaataagaaaaaagaaacagagaaaagaaaaacacatttaacccatctactatagttcctttacttttatcttgatgtcctatttctctgtgcatgattctaccttcagacacagatgagacaaggagtggtctgtgtgatgactagatttgaagggctgttttgtgcaaagtagtggtgcttgaacaccatactcagatgatcataaatttgctagctcactctcatacatacttatgaaaatatcctttttataagtgtttatagggatggcattaaaaatacttaagcattacagtaatacgc

SEQ ID NO: 2289 - DNA, 1435 bp, Homo sapiens
accatgcctggctaatttttgtatttttagtagaaacagggtttcaccatgttgtccaggctggtcttgaactcctgacctccggtgatccacccacctcagcctcccaaagggctgggattacaggtttgagccaccacaactggccagaaaatatgatttttaatcatagtattttacagtgcctgcattaacagtgtacagggtgctttcataagggctgccatggaattctccgaaaacgacctgggaagctttatgacatgaaaatgcccatttgacagaggcgggaaccgaggcttgcagtgatgaagggactgggagcgcagaggccagaggtgtggcaatgccagctggggaattctggtgaccacaccctcctggcagaggtgggaagagacaggctgctcccacgagtgggcagttcttggctgttgcttctcatcagcttccctgtgagatttcgtcagcacctcctccctctccactgccggaagaatccagggctaccaataaaaatgacaattgggtgaggagggctctagcccgtgcttcactgtttgtcctttggtccgggaaggggtctgagcaagaggcaccgtcttgcctgttcggaagggtctgagtgtatgtgtgcaaggatgtgtgaatacatgcgtgagggtgtgtgtgtgagtgtgagtggaggagcgggggggctggggtgtctccagagggcagcagcgcatgggccttggggtctctgggatccccctctcgaggcccgcatttggtgtggagagaggagattaaggggaggcgtgcgcctccagggaagtggccgggcacttcatttccctctgacagctcatcggtattgaggtcacaccgtttctcaggtcaggatggagattgggtctcacagccacacactcccatcccaagatctcttcccacctgaggtcctagattccccagcacagacacaaaccgtccatgctgtggatggtttcatccaaattcacgacccacagatgagcatcataaaatggccatttgacaccaccaagttgggggctgttatttgtgcagcaaaagataactggggcacatctgcacctgtgtctctagggcaaggcttcccctgagcccctggcatgtgcaccttactgcctactggatgccgactcttcccagaatccaaaagctcacagaatcttccccaagtgcatcggcccagagcatccaaggtgaagccattatcttctcatccaaatctgaaaccactggtgacctggacaaaattggaccaagtgaggcccatgaccacctggcaggagggcaggtgcgggcgagatgggtttccagctgtccatgtatgtgcttgccctgttttttgttttttttttttgtttgtttgtttttgttttttgagacatggtctggatctataggc

SEQ ID NO: 2290 - DNA, 8095 bp, Homo sapiens
gaattgtaaatcaaaatcagaatgagatactatttcatatccactagactgactacaataaaaagtaaaaatgacagacaataaaaagtgttaaagtgtgagccactgcgcctggcccgcatgtattacatttataattaaaaattcacaactcaatgtcaagtgtgaaccttgtgttgaccctgatttgagcaagcaataaaaagatatttttgagacatttagattatgaatttcacatttgatgatagttactattaattttgtgaggtgtgatattggcaatgtggttagatgacttcagagaaaaaggaaggtatagttaagcaagtatggcaacatctaataacttgggtctaggtgatgtgtatgggtttcattatactgtcctctttactgttgtatgtatttgaaaacattcatgacaaaaaaactttttaatcagttaaataaaccatgaagaacggttaaagaagtgagcttccaagaagtgtttataataacagtactgaaacacacgaattcactaactagtaagcatctgtattagtcagggttctctagatggacagaataggatatatatagatatatgtaatatgtatataggtaatatgtatatatatgtaatatgtgtatatatatgtatataaaggggagtttattaagtattaacttacatgatcacaaggtcccacaataggctgtctgcaagctgaagagcaaggagagcgagtccgagttccaaaactgaagaacctgaagtccgacgttcgaaggcaggaagcatccagcacaggacaaagatgtaggctgggaggctaggccagtgtctccttttcacattttactgcctgctttatatttgctggcagctgattagattgtgtccaccagaataagggtggatatttcccagcccagactcatatgttaatctcttttggcagcaccctcacaaacacacccaggatcaaactttgtatccttcaatccaatcaagttgacactcagtattaaccatcacggcattcatcactgggattgtaattgtgttagaaaactgtagaaaggcttcctaggagggcatttggacaagactgctttaaggtaattcctccactccccaactaatttaaaaaataactaagtacatattatattgcaaataataaaaataattaccattacttgctttcatggcataaagaaaaaacagacaatactacttatatttattctcatatgctatttaaacaaggctcagaaattttagatttatcagaatcacatcttaacagggtaatttaaaagtgaatgtgcctgattaactcaaaatggattaaagacctaaatgtaagagcttaaaccatttaactcttagaagaaaacaagggaaaagcttcatgacattggatttggcaatgatttcttggatatgatagcaagagtacagaccacagaagtaaacataaattggactatatcaaaattaaaagcttctgtgcatcaaaggccataatcaacagagtgaaaaggcaacctaaggaatgggagaaaatatttacctatcatatctgataagggtgaatatctagaatatataaagagctcctacaactcaacaacaaaaaccaaacaacctgattcaaaaaggggcatattcgctgtttgtatattttctttaaaaaatgtctattcaagtccatgaagagatgcccaacatctttcccctcatcattagggaaaagcaaattaaaaccataatgacattaacacctcacatccattaggatggctactattaaaaaaaaaaaaactagaaaataactagtgttggcaaagatgtagagaaattggaatccttatgaactgtgggtggaatgtaatatggtataccctctatggcagttcctcaaaaatttaaaagtagaggctgggtgtggtggctcacgcctgtaatcccaacactttggaaggctgaggagggtggatcacctgaggtgagtttgagaccagcctggccaacatggcaaaaccctgtctctactaagtaaactacaaaaattagccaggcgtggtggtgggcacctgtaatcccatctacttgggaggctgaggcaggagaactgcttgaacctgggaggcagagtttgcagtgggctgagatcacgccactgcactccagcctgggcgacagagtgagactccatctcaatcagtcaatcaatagaattaccatatgatctagcaatcccatttctgggtgtatacccaaaagaattgaaagcagggtcctcaagaggtatttgtacacacatgttcatagcagcattactcaacccgtgtcacactgatggatgaacaaaatgtggtatatacaactgaatattcagctttaaaaagtaacttctgacacgttacaacatggacaatcttgagaacattatactaagtgaaaaaagccagtcacaaatactgtgattccacttatatgaatccttagtcaaattcagagagagtgagtacaatggtggttgtcaggggatgtggggaggaatggggagttgtttaatggttaagtcagttttgcaagatgaaaaaattctggagattggttgcaaaacaaagtgactacataatacttaaccataaacactttaaaaagattaagatagcgtattttgttacatatattttactacaattttaaagtaggtgaatgtgcttaactttacagggtgataagtacattgcttttgactcaaagctagaaatctgtatcttggcaccaaataacaaattacatagcttctatttttttgagatagtctcgtctgtcgcccaggctggagtgctgtggcatgatctcggctcacggcaacctccaccttctgggttccagcaattctcgtgcctcagcctcctgcgtagctaggactacaggcgcctgccatcatgcctggctaattttttgtatttttagtagagacagggttttgccatattgcccaggctggtctcgaactcctgagctcaggcaatctgcctgcctcagcctcccaaagtgctaggactacaggcctgagccattgtgctgggtctcaaattacataccttcttaataaatgaggaagatttatcaattttggatcaaagccataacaagagctatttaatgaatgccttctaaatgccgtgcacttcacaaatacaatagtacctttaaacctcacaaggcaggtatttctattttagctactgttattattatttttttaagagatggggtctccctgtattgcccaggctggagtacaatggctattcacaggtgtgatcatagcatactacagacttaaactctttggctcaagtgatcctcctgccttggctcctgaatagctgtgactgtaggtgcacaccactgtgcccatcttttctattttataaataggaaaacttaggctcagtaagattttgggcttttgttaggggagaagtggcagagccagaatttaaacccaagtgtgtgtggctccaaagctcatgttcattccccaataccacaggccttgccagacatgcttatgttgggaccatttgattgtggtatttctttagccttagtctgctaaagttctaaaactaaaaaggtagggggaaaaaagagacatcacctttagtcattctagatctatgtagcaggtattattcattacctgtagcagataaaaggcaaccattattattactgatgtcattctaagtagattttaaacatttggatgcaatccttttatcatggaaatatttaattatatcatatattcttaattttagttaaaatcatgtctggcatgatgcctttagcaacttcttaccatccaagaaaaggtccttttccatagtcttaaaataagtagtatttactaagtttacacttttcaatatgtagatactaaaaaaaaagcttgattttataaaaaggtggtaatgtttaattcattatgagacctccatatgtgagattctttctctcttctaatattttctaaatacttactcatagcaggtactgtcctaaatgctttatatgtattggctcagaaactcctccatattatctacgaggtggtaccatttctactcctactttatagatgaggcataaaaaagttaattaatttgctaaaggtttcacaggtgataagtggctgagcagggttttaaagtctgatttgagtttgtggtctggtgggcagtgtggctcagtggacaggaacctgggctttttcctgtagagaagacatagcttttagcataaggattcccccaaactgatgacaagtacaacttgaatgcatatataaataacatttattaacttaggctgtacaatatattgatttagtcaaataaaaaataccgtacacaaaaattgaagtaaaatctgtaagatgccattcagactgaattttatattctgaataagacaagggactgccattcacttaaagcaaaatggctccaattccgtttatctatctatctatctatctatctatctatccatctatctatctatctatctataagtctcgctctgtcacccaggctggagtatctatctatttatttatgagataagtctcgctctgtcacccaggctggagtgcggtggtgcaatctcggctcactgcaacctctgcctcccacgttcaagtgatgctcctgtctcagcctactgaggagctgggattacaggcatgcaccatcacacctggctaatttttgtatttttagtagagatggggtttcaccatgttggccaggctggtctcgagctcctgacctcaggtgatccacccaccttggcctcccaaagtgctgggattacaggcgtgagccactgcgcccggcctccaattccattttgtaggaaagcacataaggctataccaatcaggcactgtggctggtctaatgctcacaccaggggccagcccactgcccagacttagcctccaggtaggctgctttgctatttaaaggcaacagtcttaggatccttattataaaagtttaaacaaaatcccaaagccgtcaagtcttcctggagatggcaatgtactatcagtttggaatgtataccagtttggaagctgaaatcactctgctgtagccttttgagcactggcagcattttccaaaatttttcttttccattcttcataatcctgtgtcagatcttcatctttctgtggtttatgtggcatctcctctaccttctccatttctgacagaaaattatcaaaagcaatttcaaaattcttagcttagaaatgaaatttaaaaaaaggtaaacttgtttaaattgtctaaaatagaaaagatactgaaatgacatggagaaacagcagttatcacttttttttgagatggggtcttgtaatgttgctcaggctgcactcaaattcctaggttcaaatgatcctcccacctccacctcttgagtagctgggaccgtggctgggactataggctcacactatcacacctagcttagctatcacttttttccctcccttacactccaagcattccaagacatctaataatagctaacgtctatcaagcacttaactggtgcttgataggcactgaaccaagtactttaaatagcattatttcatttaacccctactacactccgtaataggtgataatattaatcacattttataggtcaggaaattgaggctcacagaaattatactttcttagaatcccatagccagtggttgggcatagtggctcatgcctgtaatcccagcactttgggaggtgaagggggcgggtcacttgagcccaggagttcaagaccagcctgggtaacatagtgaggtcccatctctatcaaaaatacaaaaattagccaggtgtggtagcacatgcctgtagtcccagctactcgggaggctgaggtgggaggatggtttgagctcaggaggcggaggctgcagtgagccgagaccgtgccactgcactctagcatgggtgagagaaccaggccatgtctcagaaaaagagaaaccaaaaaaccaaaatcaaacaaacaaacaaaaaaaccaaaaaatcacatagccagtaggtggtattaaaacaataatgcagccatttgcctgagattgtctttgtagctaaagctcttataagcaaactggaacctaacttggaaacatttcttttgtcgggggaaaagaacctccgaaagacaaaaataatccccagccaatcacaaacagccaaccagctgacttgttatacaactagggacttcccatcagaccatgcccaggtttaagacaaatacctagctgtagctgcccaggctggtctcgcactcatgggctcaagcaatcctcccgcctcagcctcccaaagtgctgggattacaggaataagccactgtgccagaccagccatattcttaattacccaataacgatgttacttccattactgattgcttggaaaactggtcttatcaaatgattcacagtcagaatgtacttaaaactggactcctgtcaggcaagctgctagagcagcactgggctgttcactgcataaaatgtcaacgtcagtaccgtgttagtaaaacttaccctttgctggggcttcaaccactatcttctttctcttccgtggtggagtagctacatctccaggttctcctttaagaagtgttatcaaggttaatttttctcctgttctcaatttcagtatttgggcatgttttggatcacaaataaaattagacatcttaactgatcaaatatgaggagaagagaaatgatcttagacctctcttttgggcctcttgtcagacttgagaatcattttccaggcatagattcatggaatcataggttagaaacatcaataaaaacatacctggtccacatgtaatacggaatttaggaagcagccagtttacatatttgaaaatatttgacttttacaagcaaaaggactacattttcaaatgacgcattcttgaactacagaatacttactgtcgacctgctgtccaatcttctctagttgtttacacagtcgatcaaatatagctttttttacaccggatgtggctaccattttgtttttatccactttcagctttagaatcctacaaaacaatttcataagttgcttttctcaagacctgtacagttttcttctctgggcaaccagataatcaacttattttctttttgaccatgcttccagagcctctgtctagtttttttccttcattccaaacatgttattatctatgctaagttgtttagttgtttattggactgagagttaaaatgcacatgggatctattttataacaaaaggggcacataaaagacatttgctgtagtgcttcatgacttttagaactctttagtaaatctcagattaatttaatgaatgacaatcataggacttttttgttccactcattttaactcacaggatatttatattacaggaatgtaacaaccccaccccaccctgaaaataaactttcctaataagactccacagcaaccactaattacaaacacaaaataaactttttcttcagaatagacctgtcaagaccttttcttactcagcgtaatatggtttcaaaagtagagttgactattctcactgttttctacaatatcagctgcactccctccgtatatgcacatacttttgttgaattgaagagatgttttccataaatgccaattaatactcctaggtatgtacctaatagagccaagcataccaaaattagtgggtaggtagtgagaaatccattctttaagggccaactacattttgttttctaaggagttttctggcaagataaaaataagataactttagacaaagattatcaacaattactaatatttccaaggtaacatttcagcatacacatagataacccacaattgtaagattcagatgtgataatttatcactaaaatgttataaattccttgaagaacagttgtagccagtgttttgttttttttttaag

SEQ ID NO: 2291 - DNA, 4648 bp, Homo sapiens
gtacttctgacaccagatgtcagggggttccccccaccaccaccagggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgattgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaatgctaa

SEQ ID NO: 2292 - DNA, 3273 bp, Homo sapiens
aaggaagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaagtaagaatacaattctctctcatttaggttatcacgctataatagagaatggactcattaatatgggattacagaggaaggaatggttaagaaaaagacatggcctctgactgctccaaaaaaggataagcagggcttcacagaagaggtgacagcaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccatacaaggaatatttgttgtgtcttctatctacttgctattgtgctgtgcacctgagggacatgggttggtggaggggttacaaaattaaaaagagagacatggatcctgaacacatacagtctagtaggaaagaaaacatagtaaacaaatgaatacgatgctgctcatgaagctatgatagctcatctctaaatccactcttttatttgctcctctgaattgcttgacctgggcctctgcaaacatttcttttgccaggtggatccattctattctctaccaatagggggcactaaggaagaccgaaaggcagtaggaggcaacagggaattgctcctgcctattctttctgttgcccccgcaggaatttattgccatgtggtttactccagcatcactggttgtttgcagctttctagtttcttccatcattcccaggaccagcttctctgcaacctgtcagaagcaccagcaccagccaggtggcaccctcccttagactctgacagccagactctccttcaacctcctgaagtggtgcaggagacaagtggtaccctcagagttctgcgtcccagcctggcagggctcctcctctgaggtctggtaactctcagccaagattgttacagttactatctctgtggtacctgtgtccccttttttgtttttccatcctgccaatgcctgtttagccaattatctatattaaattctctctgttaaaacaaa

SEQ ID NO: 2293 - DNA, 744 bp, Homo sapiens
aatagtgaaataaggtggccaaggaggcagagatggagtcagggactctgtgatcaaccctgaggattgggaaggaactatacataccaggaggcaaggagcactgggggccctcctggaactgcctgtcacagcgtcctcaaaggttttcactctcctaggatgacccaggtatagaatctgcccctatggttcggctccaccctctcacctgtctcttgagagcattgtgaaattctgagacacagcaaggacagaaacagagggcatggaagatgctttcaggttggtttattcttactgattaaattaacacttcatgattgtctcagtctgcacaggctgccataacaaaataccacaaactgggtggcttaacgaaattttcttgcagttctggaggctgaaagtccaagatcagggtaccagcagggctggtttcttctcaggcccctctccgtggcttacagatggcgtcttcttgctgtgtcctcatatggcctttcctctgtgcatggagagagatagatctctggtgtcttctcctgttcttagaaggataccagtcctattagattagggcctcacttttacaatctcatttaaccataatcacttctttaaaggccttatctcccaatacagtcacattgaaggttagggcttcagactacaaattttaggggaacacaattcagtccataataattatccaagtagaaagcaggatacatgagaatgcag

SEQ ID NO: 2294 - DNA, 1807 bp, Homo sapiens
tggaagaaggcttggtccccttggcttggtgagatcatgaaataaaaacatcagtaggaggggaaggaggaaggaaggagaagaaagaggaagaataggaggagaagaggaagagaggaagaagtcgtgaacagccctcctgcattttgcatcagctcacacatcctctccattctctgaattcccacaaagactgttattgctggggctcataaaattatactccaaagtatgacgctttggcatccagagtgctttgaactaaaggagactgaaggccccagaagccaagtttccctctgaccttctcctgccttcctgtcttccaccccctacttttcccctgaagtgagtcctggaaaccagaattcttcttgcccaaagcaagccgtgacaccctggaaatatcactctaaccttccttgcctttccgtgtggcagctggccatgaagaaattctctgacctaccttgtttgatagcagatcacaagaccctggttccagagcggtcctgctttacaccgagggaaaggaatgtcatacagaaaggccaagaagaatctgaagagatgtccaatcacctttgcacgtggctgcccattcttcattgaacctaagcattaaaatagacagtttcccctgggtctttgggtcttcatttctgaagactccatgtcatgtaaaactttgattaaatgaatgtatcatgcattacttttgctaacctgtcttttgttatagtagtgtcgcctgtgacctttatgatgggtaaggaaagatttcacatcttttctacccctacattatcatactgtgaaattttattatatgctgtcttgccctcatagaaagagaattttggagtttgaaagaatcctgctaatcatgaaatctggtcctttatttaacagaaaaattcccagagacatgaaatgattagtactgtttcacagagaagcagagggagagccagaccctcagtcagtccaggctctgctgtctttggaggtggggtttcaggtctccccagcagggttgtgaggtcccaaagaacgggaggcaggccttgggccatagtctcctgcatccctccagagcctgcagcaggagctgggcccaaggatgctgctgagtgagtccacatgactgacatacactgctctggaagcaccattccggcagactagccctcttcttcccatgtaatccaggaaggttgttatagatagtccagatttttctagataatcttgtaacatattcacattcaacatacatacaaaaattcacacttggtatgggtaggagaactgtgcagacttcagtagaatttatttattaaagctttctgtagacggtcatttaaggccagcaaaatgttttcgatctcaggggttaaatggattcaaaacagaaatcagtaaagctgtcattgcagatttctgtaatagagaggcaagtataacaattgattaagaactctatccctttatatctatagaacatataaggcccctggatacccctggacctcaacgctccacattccccatttcagaaatccaggaggacgtgtggcaccgtgaggggaccacagagaccctgtctctcctgtctagtctatgcatcttcactcgcctggcccccacttcacagaacacagaacaggcattcttgctccaaaatcccttgctcattcgctgcccctatcctgctgcttacccagattttaacccgtgagtcaccccacaccctcctgacatctgcttttctcaggacatggaaaatacggacttgggatttgag

SEQ ID NO: 2295 - DNA, 2008 bp, Homo sapiens
cgaattgcagaaatccacattcaaactggatgcatgcgttcagcaactggaagctgagttcatatttcattgcccaactaccctgaccacttgggaatcgcaggtttggaaggacccacagccattctgtggaaatggatctgctttcaggaccgaatctcagacttcttggggaaggtttcagtggctgcctttgctgtgcagacctggagatgggtctgatgatcggacacctgaattatctgtgtggctgagtttcaagaagacctgctggggtgaaatgaaaatggtgcctactagaagccccagtggctttgctggtggagatttgctcctccactggctcttcttgtagacacacgactgctacagtatcaagggtctgatgcagacatgacaatgtcaagaggaagaggagagcctcgctcttcccaggcttttgcttttaagagcagaaaaactttccccagagttccaccagctcacttctcatcttacttctttggccagaactggcccttgtgcccatattgtcagtcaaatgccgacaaaggaaaggggccactatgagtggtttagacttggattggatttgtccttattggattgtccttaagtcctttgaaaaagaagtatacaacagaatgaaatcttgactcagctttcaagaataaagagggtgagatgactgatggatggctagcaaaatcagatgtgggctctgtcctcatggagcatacagtcagaaggggaagatttacctaattacactaacaaacttataactgtggtcagtgttctgaaggaaaggaaatccagttgtatggtaacgtataacaaagaaactgaactaggatggagatgggggtggtaagtgtagttggggaagccagggacatgatctgtaagatggctggcctggattcaaattccactccacttacttgctgtgtgattttagattagtcgcttctcctctctgagctcaacttcatctataacaatctttcctagggttgttaaaggattgaatgagccactctatgtaaccacttgacacatattaggcacttcagtggctccttttccagattaaagaaggagaaaacgtgtatgtttggagttagcacaagacaggatgattcctcatgtttgttttggaaaacaagtcttaaactcacagccatgacagagtctgacatcatcagacatcaggcgtgttaagaattgcactcttaattgaaaatgtccagagtttgtgattaattgcaatccttttcagatcctttccctaagaatttaatttttctccccacccacccggaggtcaggcttttaatgtaacaagtacaatcaatcttccactgaagatggcctctctctagtgcaagctggagcaggactcatctggattagaagcctagacggtttggagtcacctggtgaggtttacgtgcacagctggggcccagcctacctaattaggaccagagagtggttgagaaggggaccggcgcgtattctaggcgccctcctccagtgtctgtttctaataatggcagaaagtagcagaggcggcggggtgagcttggagcgtggtgacatcatccctccagctgttttacacatctgtgacatggctcattaggactctcttaacacctcatccttccctgctccacacagctccagttgcatgagaaaaggtgctcttgcatgtgaggggccccaagactggggctgacttcagggtcaaagattcgcttgggcactctaccagtcatcagaattttcacagagacacccccccaacacacacacccgcagcatgcgctccttgaaagtgctaatagcttcaatatgaggctggcacttctgcatgactgttggtgttcagggccagcctagtcttggggagtaggccatctgtagcagctgcagaaatgtttttgcttattttgagcattctaagtttttcctagccatgaataacaacaatcgaataaat

SEQ ID NO: 2296 - DNA, 6337 bp, Homo sapiens
agagcattaccgtgtgagctccgcctcccgtcacagcattaccgtgtgagctccgcctcccgtcacagcattaccgtgtgagctccgcctcccgtcacagcattaccgtgtgagctccgcctcccgtcacagcattaccgtgtgagctccgcctcccgtcacagcattaccgtgtgagctccgcctcccgtcacagcattaccgtgtgagctccgcctcccgtcacagcattaccgtgtgagctccgcctcccggcagagcattaccgtgtgagctccgcctcccgtcagagcattaccgtgtgagctccgcctcccgccagagcattaccgtgtgagctccgcctcccgacagagcattaccgtgtgagctccgcctcccgtcacagcattaccgtgtgagctccgcctcccgacagagcattaccgtgtgagctccgcctcccgtcagagcattaccgtgtgagctccgcctcccggcagagcattaccgtgtgagctccgcctcctgtccaagcattactgtgtgagatccgccccctgtcatatcattactgggcgagctccgcctcctgccagatcagtggtggcattagattctcataggagtggaaccctgttgtgaactgcacatgcgaaggatctaggttatgcgccgcttatgaaaatctaatgctgatgatctgagatggaaccgtttcatctccaaaccatccccaccatccccacacttgtccgtggaaaaagtgtcttccatgaaaccagtccctggtgccaacaaggttagggaccaccagtttaaataaccaaatactaaaagaactggcatagaagtaaatgggctgctgctttatttttaggctgttctttttagagaacaatgacaattatttccaagtttgtcattagaaagtaatattaggttggtgcaaaagtaattgcagtttttgccattactttcaatggtaaaagccacgattacttttgcaccaacttaatatgataaatttgttccttaaagtgtatttttggtaagaaaaaccttttgtttttccttatattaattttttgttttttttcttggtagagacagagtcttgccatgctgcccaggctggagtgcagtgctgtgatctcggctcactgcaacctccacctccggggctccagcaatcctcccacctcagcctcccaaggagctgagactacaggtgtgagccaccatgcctggctaatttttatattttttacagagacagggtttcaccatcttgcccaggctggtctcaaactcctgggctcaagcagtcctcctgcctcagcctcccagagtattgggattataggtgtgagccactgccagaaaaacttttcctaagacaaggcaggttttacattatatttagattttttttttaatgatgtcttttttggcagtgcacagccagagaacaacacatcacacacaggaaacagttgtgctcatgtgatgggggcctcagcactaggaaggagcggactattggtgcacgcagcagcttgaataaatctgaaagtcactatgctgtgtaagagaagccaaattttaaaagtgcatactgtgtacagagggtgtcgagaatgcctcctacgtgacggaaagcagatccgtggttccctgcagactggcaggagcagattccaaaggcacaggaagaagcttgtgggtagagtgtgttcattatcttctgtgcattacaccataaaaaagctggtcataaaaatgcgaaccaaaaacaaaggtgaaactaggataaaatttctcacctgtgtgattggtaaatgtgcaggtttgacatcatgctttgtttatgaagctgtgggatacaaggactctcatacgtcactgtggaatgcagaacattgcaacctcatggaagaggatttggcagcatctaacaaaagtatgtggcatttgccctttgactcagcaattctagactgcctcaaaaaaaactctggcaaaaaaatgaaaggactttactcacagagttcttttcacgcctaaatatgtttgcaaccaagttcttcactgtggcatttgtaaaactggaaacaatcaaaatgtccatcagtaggggattaggaacattaattcgtacagtggggaactcagtaccagaaggagggatgaggaagacctattgataaggggcagagtacatatcatataatgcaaatatatatttgctttttcttaaaacagtacaaagataaaaaactaaagtggttgctgtggaggacaggggtcaatggtggaagtgagactgaaatagactctgaagtaatatctggactttgaaattataagtgttttacatattaccaaactaagttttaagatagtccctaaaattgaaagaatagtatctgaaatgaatgaatctaaattccttggattgtcttctgcaggtgccaaccctgagaccaaaatttggaaggtggccctgagcagcagctgaagggaagcgggaggtaagacaggaaagaggtgagggcacagggtgtctgggagccggatcccacgtgggcagctgggcccgtgctcattgtgggagctggtgcattccttcaccagcccacgctccacagggtcaggatggtcaattccgggcaccccggcctaatccaggacatgctcctgccaccagagaaagcccctaggcagcatcccgggtgctggtggtgtcagaatcaagtttgagtctgaggagtgacctggggctggctgggctaggcagcatcacagggttctgcagcccaactgcacatcaggctggtgacagtcacacagcctattacttcgtgtgtcatcagagcatcgccagaacgcagcacttcaagtatgcagatttagtgagccatagtttaaagacaaatagagccactgaaatcctaaatttcaatcaatcatctccttgttacttgtcttattggtattaagcctttgaaattatctggggtgggagttaaaactataactaattatgttaatgctaaaactaagatttttctggccaggtgcggtggctcacacctgtaatcccagcactttgggaggccgaggtggacagatcacctgaggccaggagtttaagaccagccttgccaacatggtgaaaccccatctctactaaaattcaaaaattagctgggcatggtggcaggtgcctgtaatcccagctattcaggaggctgaggcaggagaatctcttgaaccaggaggcggaggttgcagtgagcctagattgtgccactgcactctagcctgggcaacaggaacaaaactccatctcaaaaaataaaaaaagatttttctgagaaaaaggtgtaaaaccatatactaaatttgaaatagaaatataagcattaactctgttgttcctttcacatagacacatttcctagctctgccccaggagcagtaggcacatgaagcacctagacttggtctctaatacatgaaaaccatgaattcatagtgatggtttcaaagccaaaaccaaccaaccaaacacatgtaattggtcactcttggaggtacctagggcactaactcctaacactgggagtggacacttgagggaagatcagcgattatcccaccttctgtctacaaattgcaatcagggaaaccttgctgattaggaaaagttctttacagaagaattcctgcaaataagtgagtaaagaatgacagtttaagaattgtcccagcctggccaacatagtgaaaccccatctctaaaaatacaaaacattagccaggcatgatggtgggtgcatgtaatcccagttactcaggaggctgaggcaggagagttgcttgaacccgggaggcggaggttgcagtgagccaagagtgcgccattgcactccagcctgggcaacaagagcgagattctgtctcaaaaaaaaaaaaagagttgtcaaattgccaccccaatgctgtggttctctaacctgtgtaacaggatcacctggagggaccctacccgagaccttccgattcagtcctgggggaaccctaccccagatcttccgattcagtcctggggggaccctaccccagatcttccgattcagtcctgggggaaccccaccccagaccttccgattcagtcctggagggaccctaccccagatcttccggttcagtcctggttcggcctgagaatttgcatttctaacatgtccagggaccacagtttgaaaacctccacagctgacatgtaatgggatgacttggtccaataaatgaaggaaaagtaacaggtggcaacctcaggcagcttcatcccaaccagtaagaaagtaaatccttttgtaaactaagaggaagtattaatatgggcgtttgagcaaacatttaagtgttaggacaaagaattaaaaactagcacaggcacccctgaagcatgataggatggcaacagaagggctgatttagtttccaagaaataactgacaggcagtgttgtgtgtgtgtctactgcttaggaacccaaaacaaaccttcagaccattttcatgagtactgagaccaggaaaaccactgggcagtgggtggtctggaaatgtaaatgtttatagtactccatggagtactatatgagtcatggaacgatgtttcatattgaaaatgttttataaatgtgggtttcaaggttttaaagtgaacccatgtgtgtgaggagaaaggacacaccaaagaagtaaaataattgggtcaatataaaaagaaagtagaatattgcccagagaggagatgtggataattcctaacacggatcaaaggtgagctgtgtctaagacagtcagacctgcaccgtcccgtgcagtagacaccgtggccgctgtgtctgagatattcagaccctcgccgtcccgtgcagtagacacggtggccgctgtctgtaagatattcagaccctcgccgtcccgtgcagtagacacggtggccgctgtgtctaaaatattcagtcccgtgcagtagacacggtggccgctgtgtctaagatattcagacctgcaccatcctgagcagtagccacagtggcaagtagcctctgcactggacagtgcagctacagaatgatgctatcactagaaagttccatcagccagcactgatgcagacctttgcaaatgcccctcacactgaatagcacctagctgatagattgtccactactcagtgaaaagcctgtgttaaaagcagtatttggtagaaaagcaaaaaaggggaaaaaattaaaagtggtaagtcattgtcttccttactgaattctagcagaagaatgttggaaggaagatgggagtcacgggagaaagtatcattgtcccaggacaggagggggtgccaggcatggttggctctgtccctggaattctatggcgggaatctggaaaaaggaaaagtgactggagaagaaaagattctgtgtgcaaatgtcatgatgcagccatcagtcatcctgagaaaataagcgaacaaagtggcttcagatggatgctgttggatacatgtacagatacaatgtacacttgcatatgcttgttcacacaaaggacaggatggttatctgttcatttaacaaatacttgttgagggcctatatgtgccaaagacatcagatgcataagagggtgcactatggaaagcctcaggaacacaagtgcccagaaacatttagaaaaattctaatgaaaacagaaaaggcattttcaaattagctgagagaaacgagaccaaaggaaagactgacccagtatttggatacattatgtgatgaaccttaatgcagggaggaaagtgttatctttcagttaatttctcaacttctggagagcttagaacagacctggctaggaggaaattgaatctgaggcagatgaggagatagtggtgccttgatgcttccagtgattgggtcagcagaaccaggggtgggagatgatctctctttttgttggcagatggtggtctctgctgtagctttgtcccctggtgacgggactcaggcagcaacccccatcattggcaatacccccacctctgagaatgtggagaggacttgtgaagacaatgttgtcccaagcagcacagcccagagttttgcacttgttgcccaggcctggagtgcaatggcccgatctcggatcactgcaacctcctcctcccggtttcaagcaattctcctgcctcagcctcccgagtagctgggattacaggtgtgcaccatcacgcccggttagttttgtatttttagtagatacggggtgtctcccaattggcc

SEQ ID NO: 2297 - DNA, 650 bp, Homo sapiens
gagtcactcactgtttgcatctggaataacagcttccagagtcagacttttgctaaggagatgatttgacatgttggaaagatgcagattctggatccagagagacgtaagttcaatccctgttacatccgctagcatttctgtagccttaggtatattacataactcacagagtctcagctccctcctctgtaaaatgcagaaagtgatacctccctcaaagggcagataaaggataagggcaaataaaaactctattgttggggaagacagaggatggatatggcctttcctatcttatatttcagatccattcattcatctgtccattcagctgttgagtccatgagagcttactgggtgcttctgagtaccaggacatgtaatgggtgggacacaaacacaaataagaccccatcccaccctcaaaaagccagacagggactgacttcagtctttgtcaggggtggatggtgggtgcaacagagcccactcaggcctcctggcacctgcctaccgatccaccctcatgtgaaagagtctttgtgcatcctggtggcggtgttgcgggtggcaggaagctctgatggccctccgggcttggcttctgccacactcccagggactgctaaggagtcgctttccagccg

SEQ ID NO: 2298 - DNA, 5714 bp, Homo sapiens
aaaataaaaacatgagtattcaagcaaagaacatgtattttaaagacttctcaactgactaaagtctcaaacaggaaaatacttaccataacagcaggctgaaatttcaagtaaaaactaaagggtaattttttttttagtgtgtattggaatgaatcagccaaaggtgggttcaaattaatgcctgtaaccttgataaattacttaccctaattttttgttttcttaaccaaaaagagcagggatgataatatctacagctggagttgttgagcattttaattaagatattatataagttttctagcctcagtttccccaaatggaaaatgaggataacaattctcacttcaggattgttatgggtatatgacaatgtatacaaagtgtttagcatgatcctggcacataggaaatgattacttaaggagagtgacttttctatatcactaatggcagaaagcatggtgagagtggtcataatacctggagcagtagtagtggtcatcaaatgttggtttccactcctttatcttataggggccaaatttggcagagagcttaagtaatctgtctatacttttattgaaatctactttgaaattccaccaggtttctcacccaatgggactgggtggggaaatgtccagatgtaagacattatcatctagtggtgtgtgtgtttgtgtgtctgtgtgtgtgtgtgtgtgtgacaaagagagagacagagagcacttgagtgtactctgttatattatacatgccacttcctaaagattctgaggtgtgagccaccgcgcccagccagtttccctcatatctttattccccaggcctcgtatactccctggcacataatgagtgtttagtcaacatgactgagtgaattaatgaatgcttgaataaatgaacaggtagtagagaatgaatatattggatatcgttatgaaagcaaattttcatagaaaaagagcataaagccataggaacccccgcagaagacacgaaaaacaaactcactccctgcttttgcccagagcaggcttacagctggcttcactttagtttatcctagatttctcttaggacattgaagacagaaaagatgtttgtaacctgaagtgtcagggaacaaagccagaaggtgcaacatgcagaagaaaacatattcaatgagtttctgaatgctatcctgtttttctcttcaaacagaaagaaaaactctctctctctcggccccccaccccctacactccccttctccctctctgtctttccagtcaaagagactgcagcggatggcatgccttaagtgcctgcatgtgccgatctgatccgcccaagctaagtggccaaataggatactccaggcaatacccccaagcccccctgcagctcagtgagaaagacgatgcaggaatacctgtgcctgcgtcgtgtgccgccactaggggtccccagcagcaggcgatgtgaactgggaattgggtagcagaggcggcctccctttgtctgcaccccaggtgtggactcctctttgttcagaggcagggccgctacctgcggcgtctgagctgcctgctcattaacccatcctgggccgtctgtgcacctcctgaggaaacagcgggtttctcagctcctgcccctagtgacgcctgcctcagaagagccaatgcgttctctttctcaggactaggtgtctttgtatttgaaataaggcttaaactacagagcgaaatatttctcactacagcaaaagagcattttgatgttgagaaattgatggcaaaaggaccactttcagggtacggtagagtacttgccataaaatatttaaagctagttgacgaatagccctgctattctcctgtgaatgcccaccactggattaatcttgaaagtaaggaatacagtatttcattctgtgtttagcacagggaaagggaatgaccttcactaaaaaacactccagaatgcctgcagtgagggagcacagctcctgctatgacagccacgttcaccctgcagtgctttcttgtctgcttttaaacttcaaaagaatggtgaaacaaaataaacaaattacaccaccataagagctaccctgcaaacaataaatcatgtgaattgtaacagccggtgaaggagggtggggtggggattgcaaatatttactccatcaagattttattcttatgtttcaccgtttcagtcttttttgatcacagcaaaggtagtatccttacatgaccgtcaagttctttcttttgctgcagatgtgttgttactcattgtcttgtagctcagtggtcacagctactaacgtggaaaggaactggcatacaagagaaccatttacagatgtccttaatttgctcatttactcaatgagtaaacaattgaacaacatccactgagcacctattgtatgcaaagtatggtagacaatacaggggctgggcaaacaaggatcctgcccccaccatgcttttttttttttccctgagacagggcctcactctgtctcccaggctggggtgcagtggcatcaacagagctcactgcatccttgaacttctggactcaagcaattctcccccctcagcctcccaagtagctaggactacaggttaactacaacgcctggctaatttattttttatgtttttagagatgaggcctcatgttgctcaggatggtctcaaactcctggcctcaagggatcctcccacctcaacttactgagtcactgggattataggcatgagccaccaggccaagcccgctattaatggactaaggtaatgaaatatataccaaaagtaccattaaaataagacagagcatgagatctgcccattgagaggtacagtagatggactagagaaatccaacagaagaagagttattttctgccttgggaatcagggaaaactttccagagaaggtgcattctggttgaacccttttggtatgtaggatgggaagcaggaaggaatggcagaatccagtgctgctagccccaagggcataggccaccatgaaagagggttgcctttgtgaaaggggggaacagagattagattggaaaggtaagtttggaaggctttgaatgccaggtgaaagctaagttaaaacaaaatgataatttttattcttaagaagcccacattatccacaagactccgtttatcccataagtcttttaatatttgaagaaaaaaggcagaaatgtcttttaaaattctactttccaaacaattaagatttctgtagcaccaatattctttccactggcaaataggtattacctagaattaaggcaacacataaatgaataaaatagatgataactttttcattgtttcatttggagaaatactttagaaggtccacaaacaggtccctgagcctaccaaagagggatgttagcattttatttccagcatgtcctgataacttactgatactaaacatttttgcaaggagcagccagccttcaggctcctgaatctaagaaggatgatagtgaatgattattcatgttgagttttctgcattggttatggctttatcaatccagatgatcaatcaactttcagattttagttctgaacctggagctttctgtttggtattcaaaataatgggtgtcaaagttatagctcatatcacaccgacagactgggcctcccccatcagcacttctctgttcagcaagcgtgtttgttggccttgtattcctcttctggccccaggatccaggaaaacatgagtctcagcttttttctacttctgtacagcacagggccttcaggtggtgccttcacagcaaatacccccgtcccttcatctgtcaatttaggacaataaaaataatctgcctcacagagccatgctttactttctccagttaaaacactatgaagggaaatatgagtatccgaactgcagaaacataatctgttgtccttttgtgaaatttcagagatgaataatgaaacctgttaccctattgcacaatttgggacaagaaatataagccatagattgaagataagacatttccccctagtagaacaggtcacagttgattagttatctccagatgcaatgaagaaagcaaaaatttttcaaactatacattccttccttaaagtgagcaacttacaatcactttggaacacaaacttcatgccaggtacactgtagctttccacatagcatcttatttaatcttcacagcatcctgtgttatcagatttttgtggcaggtgtagaaactgaggctcagtaggtctaagtaatttgctcaagttcgcagctaagtgacagaaccagagtttgaacccagttgtcttcgaagcccagatggtaaaattctaccgggcgacatagccaagtcagatagtccaccatctaaagatctggggggctacatagattactagtcaaacaagtaagtgctgttttctatcagaagaactctggggaaacagtaagttccttctgatctgatcaacaagccaagtgtgtgatgggtcacgtgtccctgaaggctccagattaggaactgcatcatttcgtgcagtccacaaaatgaaggatagtggtaggggctgggaaaatgcgggcgcttgggtctccttagaccagccagggctgtttcaaggtccatacagttgaggggtaggaagacgcagtcccacgtgactgaagagtgctcacactcctttaacagtttagcaaggtgtatttttaaaaaatggaccttaatgagaagacacactgggatagtatcctggagggatttttttttttaagttctaatcaactagaaaatgtgacgtgggtgcgtactgtgattatttaacattcattattcactgtatgttaggtccttggttgatgtggatccccagggcctagctgctgttctgtgtcactcctgataatttttaaattgactatgttcttttaaccatgttttaaaaagttgaactaccccaatgtgaacactttccatttttgctatataatgagagtactttcattcctttaatgtttgctttttcctttgatctaacaatttctcttcaaatttcacagttttctgttgctttaggattgaaagaaccgattagcccgctgggagcgtgaaacagacttaaaaaaaatctgcatggtatttcctcccagtgaaattaatttaggtttaaatacagggggaagggacacaccttgtgctcgagtctctttctctcacacacctgagcagttcctatcctgaaagggcacagtcggacctgctgccaagtcttaagtcttttgtgagaatctttttttgcaaggcacggagaacctctttctctttgacaccagctttgtgtgggcctgatgacacgtttggacggctctatttctttgaaggccaacctcagaggcccacggacgcgtcgggcactgtccgtggctgggttacttaagtgtagctgggttggcttcccgggtgttttaggaaacgcaccttcttgcagggcagggaccgtcagctccagagcaacaaaggacaatttggagaggagtggaaggagcgctccatagtggctctgtcatcccaggttcccttctgcctagcaccgtggccctagtgatcccgccttcgccctctggatcccccacccccactgtctcgctgctcgagagcccgg

SEQ ID NO: 2299 - DNA, 1516 bp, Homo sapiens
ctggatggtaattttccaggggagacgtggtccaagaatgttaaggaaagaacaagtgtatgtctggcttctactgagtgggccataatcatggaaaatgggcaaaaggaggctgacttgcttatcatgaaagaaaaacgagctgccacttcttggaatgagagtaatccttaaggactgtgtgaaggctaacaaatgctgatgtatctagaatccctcaggttgccagaatgaagactgaagatcttgcacattaaggacataaaggaagaatgaatgacctctgagcagagttgaagtgctccttaaataccatcggaacaaaatgggaggatgacttaagactatccttcagtttctactgactcaggagcccatgtccttgaacttctgagtttgctctaaggagctagaagacctgagctcacgcctggccatgtggccttagacaaggcttccacctttcctgcatctcggtttctctacccagaaaaccaggtcatttttgtccagagacttattttaaaaagcaaaacttactagggttatgggacgcgggggtggaggggtatcattagcaccacagctgactcacgtgactgaagaagccaccctctgaagaatgagtggaaagcagggtgagcagctattagtcactggcaacaacacatgagcaaggaaggaaggagaaaaggggacacgtatcagtcatctaccttcttctggacacgtcatcaaggatgatgaactcagcacaaaaatgcagaacaattctccctcccccttcctaaaatgtatgaaatgtcagaatgtttactgggctattcagaaggaaaaaaagtccatataaacacatttcaaggccaggtgcggtggctcacgcctgtaatcccagcactttgtgaggctaaggtagatggatcatttgaggttaggagttcgagaacagtctggccaatgtggtgaaaccgtgtatctactaaaaatacaaaaattagctgggcgtggtggcgggcacctataatcccagctactgcactccggtctgggcgacagagtgagactgtctcaaaaaaataaaaaaccaaaaaaaaccccacaaaaaacccaaacatttcaggtgtacagtaacctcaaccattcataagaaagctacaaaccaggtggtaactaaaaaaggctgcagggccgaattcagggaggctatagagcatagtcaaaaccttgctgggcttcccgagtgtcctggttttaaaaggacagcaagggaacaagctgggcctctgttccctcaatccctgaatactggattgaatccagggcaagagagcccatcagctaactttacttcacttcttgaagttaaagggctctgaatgctgtatgtagatttttatgcagatgagtctgtgaatcacctccctgtgtctactaaaaaaatctggtaaccctttctccctttggagagctttaattttccctgttgcagagaagtggcatttctaaagtcttgtcc

SEQ ID NO: 2300 - DNA, 604 bp, Homo sapiens
agtgcaatcttcggttgcctggactagcgctccggtttttctgtgctgaacctcaggggacgccgacacacgtacacgtcccttcgatagctcagctggtagagcggaggactgtagctacttcctcagcaggagacatccttaggtcgctggttcgattccggctcgaaggagacaagtgcggtttttttctccagctcccgatgacttatggcactttccttgggtgccttcagtgacacattgcattccaacgagcagtttgaaagtctagcgctttctccccattttgggcctcccagcctgcacgggactcatctgaggctaagctgcccatagttcggggagacccacagggaaaacaaaacaagaaacagagaacttggaaacggacgctgattactttgaacgtttgctcaaccgaggaagcaggaactgttcggccccatctcaagtccgcagggcggactgcctggctctgggcagatccgaggtggataggacaaggcaaaaggtagccctggagagaggcagccaccctctttctcacttccagtgggcacaagaaagcaagaatacttcctttctaccttagaggctgagc

SEQ ID NO: 2301 - DNA, 252 bp, Homo sapiens
actgtaacattattaataaattaacatgatgttttgcaaaatgtaaattaaactgagagcagaagtgacatcgccctgacataaaacagtgaagcagtgctattattcttacaatacaaggcaaattgtcttgattttccctcataaagggtgtagattaacaaatattcaccaaatgacgagccccgtaaaaagtgccagaagctatgctctgctctgtgaagacagtacatcctagaaagcatttgtgag

SEQ ID NO: 2302 - DNA, 1449 bp, Homo sapiens
gccaaatcttttctccattccctatgccaagattctccggcataaacacctatggctgccaaaccttcctgctcttgtcccaacataagcaaactgaagatgactaccctttgcgctctctgcaatttgctttgtatatccagttgccagatgcctgcagaatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccttggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcagtgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactctttatttatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttagggaacatggtttgactcatcttatatgggaaaccatgtagcagtgagtcatatcttaatatatttctaaatgtttggcatgtaaatgtaaactcagca

SEQ ID NO: 2303 - DNA, 6890 bp, Homo sapiens
ggaaatccaaaagggattcggttggaatctgcttattaccttatcttgcaccctggcctggttcctgctccatgacttgactctgttggatcttggcattaactctggccaggacctggtgactgttccctgtaatgaccttcagtttcattggaaggggaaactacagataatagacataggaacctaacagctcccagaagccagactgagaaagaaaagcataaaggacacgcaacagcatgatgcctgagcaaggaatgtggatggagaagggaatattggacaaggtcaggaccgccacttctagagaaatgtgataccgggacaagatatgactaaaaatgtctgcagagcagcagagagtgcctacctcaagttaagtaacatgaatttgcggtgaattcagtgcatttcataatactagagttattattaaaaagacactgtttattatttaattggttttgaattgtttcttatgaattaactttgtctctccaattataactttcttaggcaagaggacatttctgacataatgtttatatcttccattgcacttattacagtgctagcgatataacacatacccagcagaaggttgatagcatataaacaactacattttcaacttggcctttatgatgtccctgcttctggattttgtttagttcttctgctattttccaggtaggccagagagatgcattaatttccttatagaaatcggttgattaccaacaaagttcagagagaagaaaggacagcacagacactcttgtgtttactaacagtggatcatatgtggcaaactcatcatgggatagcatccgatagtccatgaatatataggataataaaatttattcaacatcctcctaagaataatgtaattaaaaaagaaatccacttctcaaataccccaaattttaccccaaagtctaattggcatttgaattattcactatcttgagttactcttatcaccacttcctatcaggggatatccaagatatgactacaccttaagtgccaaccacttctccaaggttgcggactagtgataccagagaagcaagtgctctcatcagaagaggacattttgaactgcagcttttctccaggctcacaagtttaatttcagcctaacagctgcactgcagtccatgaaatatttacattgtttcttgcaaaattatatacattatttaccataccatctattaaatatttaccacctttccaaatacgtcatgtagcacactccactgctcttgtttcttttagcattaaaatagaaaaggccaagccctgcaggagcctggagaaagtagctatgacaaagaagaaagcagaggaggaaaaatgtgaaaggaagcagaaggcagctatctaaaaacaggctcagtattacacactccctattttcttcactttgccttcccctaactggaatgatcatttctttcacttggagaaggtatttttcccccaataatttatatatacaaacagcctaatagaaactgttctggaaataagctatattatcttcaggagccatattccaaaatagccaggtatgtaaaatcatctattaagaaaggcttatggtgatatcagaagtcaagacatcatcccaccttattcagaactcttccctacagaaaacagaataattgaattaattcggtataatataatataatataatataatataatataatataaatgaaatacattcagcactccctaagcaatgcgatctttcactctctggtaaatatgaaaattactaatagatgtgttgtcaataagacatatatggtacttgtgatcagtaaaaggtgcccaactatgaaaactgttgatggtgtcagggatgcaaaacaacaaaagaactaattggtttccagttaagcaagattttccttaacttgctcattgtccccaaagtaggctttttagagattgctagttagctaccaactatgtattctcctctactgaaattaacagaaacttgatgtttacaggtacacaccaaaagaccgtattttccagttttcctggcacctgcaggtagcatataaatatgtttccaccaatagaagtaagtggaaatgctgtgtgagacttccagaggtgcctttataatggagggatacatagcttgcttgctttcttcctccgtcctgctgtttgaaagctgaagatgatgactgctgcagcagtagccatcttgaatcataaaaataaaggccatatcatcggaatcaaactgataaaaactggacaagtctggcgttctgatgatggtggagctgccacaccatcccttaatggtctacctcaacactggtttcacatgagagagaaataactctgtcacatttaaactactataatttaggtcacttctacatgtagccagacttaaactataccaatacaactaggtgtatgcactatttctccctctcaaccatttcaacctacaagtattgtgtatccttatgtaggtctatttgctatcaatttttttctgagcacaattacttacatcttagtggtgcaagtactatgggtaatttcagtcatggttatctgtctactcagcatgaaagactgtctttgtttctactcatctgaagtcagagaatacccttctatagtaattatgaacaacctaaattatttttcctccaatttagattggactgggttacaaatgggttagtgctgccaatatgctgaaacatattatttatgtccatatccttggagctgtcaagaccttgctggttaattttcatttgttggattgagtagttatttgcaactaccatgcagatataaatgcattaatacatttgacttagacccagaaattaaattcctaaagcctcatttgtttcccatacaaaatagtttgaaaattttcttaaactacacttcaggtcaacaaacaatttttggatgcttatcatatgttaccatatgttaggaaatataaagcatgcttagatgagattcaacaagtccaaaacacataagtagaatctcaagagggagagggggcagacaatttgttattattatcattttaattggtcaataatattgtgtgtttttatcacgtacaacatgatgttttgaagtatatatattgtggaatggtgcaatatctcacacagctatcatttttgtgtaacatcacatagcatccattctctttacatcttaatacactataacattattaactatagtcaccttattatacaatagatctcttgaaatttatttctctaatttaaccgtagttacgtattccttgaccaatatctccctatctctcctcccaaccagcctagcttctagtacacagcattctactctctacttctatgagatcaacttttctagattccacaaatgagtgagatcatgcagtatttatttctctgggcctgacttatttcatttaatataatgtcctccaggttcatccttgttgtcacaaatgacaggatttcatttctttttatggctgaatagtattccattgtgcatatataccacattttctttatcaattaatctgtttatggtcatttaggttgactctgtgtcttggctattgtgtatagggctgcaataaacatgggggtgcaaatatgttttagagatcctgatttcattttctttggatatatacccagaaatgggattgctggatcatatggtagttttatttttaattttttgaggaacccccatactgtttttcataatggctgtgctaatttacacttgcagacagttttgaagaaagcatttgaattaaaattatccttaaatgaatggatactgtaattgcatttttgcaccaaatgtagtcatctatggcatcaatacctctttttaaattttctagattttctattttgcttttctgaaatacattgaatcacttcatattgcagctgggatttcctgaattctctactttttaacattgaaatttcccaaagtgcattgcaggtgtttttataagaaggatactctttaagattggattgaatagatcataatagcttttgattaagacagatggtttcataaacgtctccaagactatttctatactagcaacatcttcggaagaatcaagtaaatatcattgactttgattattttgatgtttaaggtgaacaggtctattttatgtcattaataatatagacaattgcctgagttttcctctttgcaagagcgagcaaagcaaaagtgttctcaaggctgcattcataaatggtatactgctttgtagttaaccaaatgctgcaatataaaacaagattggtgagaacattagcaatgaatggcattatttttagatcttggccaaatgtgatttagtttggttttgtttagcctaatttcttgacttagactgagcaagtcttagctctgtgccctcttcagtgtggagttggcctttatgcatttgcatgtcacttttataattttctaatgtacagacttaatagtttctggctccccattgactactttgggaatggggactaactatccaatccttgaatgagagtgttagagattccaagtctactttatatatgtgaacactgttctattctgtaccccttaattgtataacaggataggctgatgaaggaaatacggaacttcgaatcaactcaaaagcccaacccagtatacattatacagatggtttgctgtattcccagcctgacctctgttcttgtcatttgcaatcaattatgaaattgtgaattaccttactttaaatctagtgaaacttactttagaaaatccatacatagatcagtatatttttgttcaaagagcatcaaaaatacagaggattttcttctaatttaaagtgagctgtcatgtcacttgattcaagtttctaattgtgggatgattttaaaataaattttgggaattactcagtctccaaaaagtattcatccaaaaggattgcaaaaatccaatgtctaaaatgcactggaatggtcatactctcaagatgaattacctttctttttatatcctagttgttgtgtctctgcagttcttcctctctgcaccaatatactttcaattgtacctacttacagtgttttggagaggatctgaagagagagagagctgaggtctaaggttttaatggagattttgtccagactgactttttttttactgatattttactgcttgagattagaaaagagaaatatcaaagggcaactcttttcataacactatttttcttacagtttatcctatatagaaatctgctcagttcactaattttaggcaattttaaatctattttctacattggcatttaggagttatttgagtgccaaagtataaaagggggaattacgttcctatatgtaatataggaacataattaattaaaacacaagctttatcggttcatccatagaaaacaaatttattttagaaaataaggaaatcaagtgctatttaaaagtacaagaacagtttaatttcaccaaagaaataaaccaactctggcattcaaccaactccaccagcttccttggggactaaattctgtctgcacatcaatgaaagaatcagtatttgagacacgaagtaacttttggcagacattgaaaaaggcaccaaatggtctctgtctttgctgtgatcaactgtgaaatgaaaacctaccatttaaatcacttctactgaaacctaattcgttctccttcagcacaatacagaataaatctcagtgccctctggcccatggaatttttcttaaaataaagccaacaatatgaagtttctgtggttggaacatcgtcccaatctgcacgtatacttgatatctcaaccatagtttgaaatctagtttatcagtgcattgtctggtgtgtacagtgccaacctcatttaagtgctggttctaccactagctacctagtcaggtcatttttcttctatggccttcattttcttcagtgataaattttaaaaaatcaaactaatttcaaagatttctttcagcttttactttttaaacattttatttttattgctacataacagatgtacatgttttccttccagctttaggggcctgtgagcccagctgatttttcactatataaaacagttatttggtggtatttagtcatggatttaaattgtctttccctcctctctccaactttcaactatcaaacacaattttacaaaagaatttagctactgatatgtgaaataggactggtcttacttattcaaggagtagatatttaccttcataaggcaatatgctcgtacttcatacaaaagccctctgcagagaagcaagcctccaagacacttcatatttgtgtttctttgtcttatgataattttgtctacatgcaacctaattcttggaagtaaagtataggatctcttactgaaagcaagtatattttcaatgtggtttggcaactataataaaaagtatacttggttattaaatataactatggactccacagcaaaataatcttataaaagaggtgaaaacttccacttgtaaagatgaatgtggtcattggactttaggagacattgtatatacctctaaatgagggaaacctctgaaaactacatttagggtcaagcaacaaaggaatttcaatactagggaaaagcaggtgcttaagttgatcaaatattcaaaattgatcaaatgcaatacaacatcactggagtatcaaaatggttatgaaaaacttatttacttccttaaactaaaatttatttattactaaatttattgaggcacacatacac

SEQ ID NO: 2304 - DNA, 1817 bp, Homo sapiens
aggccagagccatgatcagagggcgcgcagtgaggacgcccccagcccgcctcggagcttggggccgcgctggggtcaagcggagcgcacagaggcctgttatctgccagggttaggagccaccgtggccaggtgccctggagcgggccctggacctgcgcgatcgctgcgggacagaagagcggagacgcggttcactgcctggcgcctacaaccagcgtgaactaagtggcgagtggaagagaataatttgccaaaagagggaggatttgctggtctactggcggaactggaacccactatacccacatccccattcacgagcgcccaccttgaaggcgtagagacgccatggttgtcatagaaacactcgtgctgggccgctgacatgagcctgcggcgtggagtgagtctctgaatcttgcccagccccaagtgctccctccaggatcttcctctggactctccatctctcccctttccctaagaagatcacccgggtcctgcctctccaagactgctcgtgggaatacacactgtcacccacacaagacagcctgctcaacgagtacttgcatcgccagcatccacagtctgcagaggtcagcaacagtttttatttctgaaacacatagcttttctcatccaacttgcccagaaatccaggaggtagatatcattcccattttacagacgaggaaacagaagcctggggaggttaagtaactcctccagtatcacatgtaataagtgacagaaccagcactcaaacccaggcagtcaagctctttcccctccccaaggagtctcacagagcagcagtttaaagaaccatgtctgggtgatatcttctggtgcttctatgagcattcatggaattgttgcatatgtgatgtgcaggtcatgagaatgtgtgatgttcttgcatcattttatgctgctttggacttgaagcagcatttctcagatacagaaattatgttggcaagttaagttggatgacaactacctacacccgtattttcttttattaatcaaatacaaatgtagctgaggtatatggcctcattcgatcctcacaaccccttatgagactgaaacagtggtaaagtgattccttcttccacattgtgaatttccttcacggaaaattctgaacatacagtacttcaaaacgtaaatcttttccacagtgtcacagatttcaaactaattataaatactacatataaatgctgtgtaaatatgacatatacacacacacacactataaatgctatatatttatatggtaacatctaaatgccaggtactgctctaaacactttccatagtaactcatttaataattacaatcaccctatgaagtagaaacttatttttttcaaagatatttttaaattattaatttttatggctgcataggtgtatctatttaggggtacataagatattttgatacaggcatataatgcataataatcacatcaggaactgggcgcggtggctcatgcctgtaatctcagtactttgggaggccgaggcaggcagatcacgaggtcaagagatcgagaccatcctggccaacatgatgaaaccccatctctactaaaaatacaaaaattagctgggcatggtggcgtgtgcctgtagtcccagctactcaggaggctgaggcaggagaatcccttgaacctgggaggcagaggttgcagtgagccaagatcgtgccactgcactccagcctggtgacagatcgagactgtgtctcaaaaaaaaataaaaataaaaatgacattagggtaagtgtgttatct

SEQ ID NO: 2305 - DNA, 17771 bp, Homo sapiens
catttgtgtttttcttcatttgcatatttttaaatcatgaatggctattgaattctatctaactcttacttcaccaagtaggattatttaaaaattttgtttatcttctaatcatcttttaatcttttaatgttattaattgcttgataattttttctaatgttgccctatctgtattcttgaaatgaatgcagtagatgaaattgaggtcatcacttttgtagacattgcttgctaaatgtggtagtcattagtgctactcactgatatttgtttcttctcttctttcttccctaactttaattaggcatagccaattcatggtgaatggaagacctgtgtgtcacttctgggctgcaatatttaattacaagtctgaactgtccagaacgatcttcctccttccaaagagatcttggaagcacatgttgcaatagagcttgtgagcttctagttcactgaatgactcattgaatagagttctttcgacaaccagaaaatgggcataagggaaaataaactttttttttctgttaaacatatgagatttgggagctttttataccacagcattacctgacctatctaagtgatagagtgagagtcaataagaatcaatattcataaatcagactcgcctataattttcatttgtcaaactatccttttctagtgtcagataacgttgcactgttttcatagaataatatacattttcatatctttggatgaattttatgatcttggaatgatgtactccttttacatctgctaaatctcaagtgtaaatttttttttttttagtttgtgggaagattttagcaaatgttcatgttgaaggctttttctaactttcctaagttctttgaagagataatgctagtatttcatataaagaagatatgtagaaaagcgatttgagaatggagataaaaagaatcaaatgtttactcatgctgagaaatggcagatccttgggctgcagaaagagaggatgggatttgttcgttgttctctgaccttaccttaggaaatttgtaagacctcacacaaatattaggttggcacgaaagtaattgcagtttttaccattacttttaatggcaaaagccacaattacttttgtgccaacctaatatttggcatctatggggtttaccactgaagcatgacatcttctaaaagattatcattctcaaagcaaagaaaaagaaaaccagatgcataggatctgaaacagtcatgctggcttgtaccttgtgtattccagtggcaatcaatgtgcgcccacactgaaggatcagggggatttcctaaagcaaattgttctaattctctgtaggattctagaaacttgacataatttagaaaaactttttgattacaatagaaatataattttccataatttctgtgggtttactatcagatacaaataaagattgatttaaataaataaaaaatgtgatatttgcacacattaatttctaattgacatacttacatttagatttttattttaacagaaataatgtaaacaaactcctgggaattgctcttcaactttgttcttgaataaatacataagtcaaattcttagaagagaggcagacatatcaggcttcacactgcttagtggcttgtagcatctcttgatatcaatatagaaataatacaaaagcctttgaaatttttagtattcaacaatgaaaagcctgagttctccaggaaaaaaaaagaatctgtcccagagcagttgttgaagaggccagatgagggagcctgtacagagagtcatttcccattgagggaaactttgatgaaatggagggaggagatgagaagcaaatggaggataaattctctcttagaacgccccctgggtgaactgtgtggagatgcaggagttcatacagcttttctcatgatgtctagcaagaccgaaaaatcagatgtgcttcttaagaagtacataactaaaatggaaataaaagtggagtggttgttaagtcaattctctcatgacaatttacgcaacttcctctattttctattttcttacatccatatgatctgctttctctcatggctctcattttagaaacacctcttggcagtgtgcaatgacatttttgcttgttttgaaacaaccaaaaactcaggttgcttaactccctatctcatctagttccttaaattattcagtcttgtagaacttggcaaaggaaaaatgagaaaatggtcctgctcagtagaaatctgttgatttctatccactgaaatccattagtctttgaagttaactctttcttaatgtgtccttatgttacagtaagtatggtgattccatttatggatagatacacattattttgtttccagaaatattttagaaaaataatgtacacttcaatctatattggcaaccaataatccatggtattttgtcgtccgctttcagagaccttgcaatatttgagatttgttttctactaaatttaatttcttactaatatagaccttctgtgttagactcctatctgatttcatatatgagtttgaaacattatcacatgactgaatcaactttgtgagcaaattattccaaaaaaacaaatatttactcatattaatcaccttctcaaaaaattttgatagtttcatatcagagaaaaatttcctataaaccaaagtaaactcagtgtccaagaccccctaacatcaggttccaactaatctttcaagacttacttcatcaaactccattagaaaaacagtctggtcttacagctttttcaaaaactagcaatttagtttaattaattcccatttatgaattttttgttgcttatattttaaggtcttggtcatgattattattattattattttttgcctagacaaatgtcccaaagagtttttctaggctttcttctagtattttagtcattttaggtcctgcatgtgtttaatccatcttgagtgaatttttgtatggtaagaaataggggatcagtttgatgtttctgcatatagcaagcaatccaatttttccgaacaccatttattgaaaagggtgtcccttccccagtgtatgagtttgtcaactttgtcaaagatcagttggcttctgtacagcaaaagaaataaccaatagtgaacagacaacctgcagcataggagaaaatatttgcaaattatgcatcctacatggattaatatttagaatttacaaggaattcacacaaagcaataaataaataaataattccattaaaaatagtcaaaggacaggaatacacatttttcagcagaagacgtacaaatgaccaagagacatatgaaaaaaaacttagtgtaacaaatcatcagacaaatgcaaattaaaagcacaatgagataccgtattataccagtcagaatagttatcacaaaaaagacagaaaataacaaatgttgatgaggatgcacagaaaagggaacatttatacactcttactgagactgtaaactagtaccacttctatggaaaataatatagaggatcctcagagaactaaaactagaactaccatttgatccagcaatcccattactgagtatctacccaaaggaaaataaatcatgatagcaaaagataccctcacttgtatgtttatggcagcactattcacaaaagaaaagatatggaatcaacctaactgtccattagcagaagatcagatgaagaaaatgtagtataggtacactatggaatactactcagatattaaaaaaatgaaatcatgtcttttgcagcaacatgagtgggactggacgtcattattttatgcgaaacaactcagaaatgggcaaataccacatgctctcacttataagttggagccaaataatgtgtacacgtaggcatagaatgtgaaatgatagataattgaaacttggaagggcggcgaggatgggagaggatgagtgatgagaaattacctaatgggtacaatgtacagtatttgagtggtgtatgcactaaaagccataacttcaccactatgcaatatattcatgttacaaaattatacttgcaccccttaaatttatacaaatgaaaaacaagaaaccctagacattttagataaacattttgtgacatttaaatacagtgaattgaagctctcttatctttttcataatatacctctttctttaaaattttactaaaagctaaactagtgttaactttcctttttaattccactcatgccaaaatatttttaaactatttaaacatgaaggaatctttacagtattattcataattataagtaactcttaaataaattatttaccagccctaaaccagagccaataggaaatgagattgtggaagaaacttaaatgaccagaaaagatagacaaaatatactgagagtaaaaaggagcaggttatcaataagtatatactgtataattctatatttgcataaagtaaattcacaaaggttatcatctgcaatttatattttcatgtaatgagaaaaatgttaatagaaacctccctaaaagaaaataattttatgtcatactaagagagaaacattataataattattagttttttggggaggggtagagggatgctgtggtccatgcctgtctctaagacattcattcattaatctgctctttgcctagttctgaatgaaaggcagaaaatatggtgatgcactatgcagatatatgtcggcctgttaataaaaactgagcaataaataattatcttttttcctaaaaataactttaatttttcatgcatgtttaataatgtttgtttctagaagtaacatgtaataaaaagatatatttaatatctttaaatggacaggcatgaaaatatcatctgttctatccttcactttccaagctagactcaatgaaaaatgttagatgaaaaataaacactcagaaatatttccatgtcaatatttttggcaaaaatattaggtcattttgcatgaatacttactggaaatatacataattctgtgggaaaaaatgatgatttttgtgtttatggttcatacctcaagaacatagttattcaattaagcttgcctactcaaacaatataacaggtttactagacattttttaataagtaaaagtatttgatgtctttattatctgctccagatatgaagatcaaatccacactcaacaacacacaatttgagctcagagtctttattgtaattggaaaatacatggcctgcttgccaaaaactaaggagtctctgactatgtgatgtaatttaatgagtgtttaatcccagattttactactgaagagcatcaaatcccttcattagtataaatttattgtgagctgcagtcttagttttcttatttttattttcccagttcttgcatactacttgtcatgtagcacttagcctatacagatttgttgatagacttctccttaagtgtttttaatgtgcacatgcatttcaactagatttggtcattattggctagatgattaatacttgcacactaatataccctccctagccaagggtactaaaaaaaaaaaagggtagctaattgttcatgaaaattagaagatacacagaaaggaaatttctaggaggttgtatgttggcgggcagggagtaaaactaagcaaagcagaaaagactgagaacaaaatgagcagctttgatgaagcaggaagataccgagtttctgagttgaagaaggggagtaaaatgaaaattagaattatgctatggactaaattgtgtctgcccaaaattcatgtgctgaatcccaatcccccattatgaccctatttaaatatagggcttttacagaagtaatctaagttaaatgaagtcataagctagggccctgattctgtagggtgagtgtcctcataagaaaagataacagaaagtgtggctcgctttctctgccatgtgaggacacagcaagaaggcagccatctgcaactctgaaagtggactctcactagaattcaactatgctgtcatcttggtctcaaatttccagcctacagaactgtgagaaaataaatttctgttgtttaagtcaccctgttatggcattttgtatggcagccttagctaagataaagtgtgaaagaaagtaaaagttatttaaagttaaatataccagattaaaaacatatatttgcctcaaattcctttcaataaaatggatgcattttcaaaagaaaaaaaaaagagagagaaaatgttacaactagatgcaggcaagcacaagtgctggctacatacgaaaggtgacaccccagggaacaatgacagaaaccagcaagacattgaaagagctgtgagaatcctggaggaggctgttttgaaaaggtgtgtgtacaagggaggagggatgtgaggggggcagaaagcagccctgccttgtggtgaaagaataaaaataggaaagaacttgttggaatttttgttcctgcctcctcccactctgcatgggaccgacaacgccagcctccacaccagcagtgacacacatttctggtgcaggttttctctagagtaaaatcacagcaacacaaaaaccatgggtagatgaggacttgagaaaaacaggttttttttttttttctttgagacaaaatctcattctgttggctggagtgcagtggcatgatcttggctcactgcaacccccgcctcctgggttcaagcagttctcgtgcctcagcctcccgagtagctaggattacaggcactcaccaccacgtccagctaatttttgtatttttagtagacggggtttcaccacgttggccaggctggtctcaaaccctgacctcaggtgatccactagcctcggcttcccaaagtgctgggatttatttacaggcgtgagccatagcactcggcagagaaaagcaggttttgaaggtttaatgtgccttggacaggtgtttccccaactcttctctatactcctctaagcctggagaacaagaggacaaagttctccctctcacttttgtatctctttttgcttagctagggatggcttcctgagctgaggagctaagacaggattaactatgattttttgctgttgttgctttctatgtttcagtgtactcattctacatcttattattcagggtacaactaggaaaggagaaagcatgttacggcaccaggaaattattataggagtgataccttgaactattttggaaagatctgggaaaagaaattaaggtctccaaggaggaactggagaatcaatgagtgactggcctggtcaccctgagcagcaaaacactgaagtgggactacaaaaaaggaagttggcacagggatatatggaaactgttgactccgaggctcctcagccacatgtttagtgatgggcccagagctgttgttgctcagcaagaccagcattttggaagaagatgtgagcacaaagctgagaagatctggggagagcaaaggcacactggaacccctggttggttacatcatggccgtctctcattgcttctcactataatggcctccagagagtgatagttgctcttttgcttctgtaaattcctcttttgaaatattctaacctagaaccataaagaccagggaggttgtggaatgtcaatttgatctaaacaaactgatgaagcacaaaccactctgctacattttgagctcattggaactgaacttgcttagggcctggtattgccctttgtgtattttctgacagagaagtagacaatcacataacaacaagtgtggggaacagtctcataaaatagctaggcattgtggcattatttcaaatgagagacaatatactgtatgactgatttgctcataggtagaattatttcattgaaggagtcaaaagtttcaaaacaagcctaataataatacaaaaagggataagaaagatacagaataaaaagaaaagtataaacataagcgaaatattaaactaaaaaatacaattgttgaatcgaagaacatgtttgttggaataaagtgtggaaaggatgtatctgaaggataaatgtgtgtattaggagctaaggatagttgatgtacaaacaacaaagaagaacaaaaaatatataaacctctggatttaagaatcagaagaactgggttcaggctttagctctgtgtctctcagaaacaggagtgaatttaggtgagttgctgcttctatttgaatattcattataattttttccttaaactttttgttgagggttaacatatatatgaaagtgccttgcccactgctgtgcaaataacatgttaatattccagaaatcctcatttctttaacagataagaggaggaggaggaataattcctttcttttgggtatttttgcttaaagtccttgtgggagtcagtagcattccatgaaacagattttaagtaaaagcaaattagtacagtgctaaagctataactttacttgccacccactatcaaatgttatttgtggaataccattgtataaagattagcaagggaaaatacagataggcagagcaattgattttacatacttctcaaaaatgaaaactacaggtggatctcaagctggcctaacatcatccaagatttatcttacttttgggtggatttgacttggtaaggtgcattgcctgactacagagactattccctattcttccctctctgtcagcagactatttgctagcatgtcaatcatcagttttgtcattgaacgtggtctctaccagtggtaattaggaaagtaaattcaacagtgaaaatcagcaagcaaaactcatcaatcagcagctcttaaaaagagagatcacaatcatagcagcaaaagctgggagatcatgtccctcagggcattaggagttttatataaaaatgtacgtgatgactttgcaatagggacacccactgtgcaaagcccaatgtgtggctctcattttcaattcagatatcgtcagtctgaagtcttataatatgatcacagttacaacagaaagatattcaaatcataatgactgatgagcaacaaaaccaatttattactagatctgtctccccacacactctgaagaattcctggggatgtttacatttgctcatgaaaccatttgtattgctatgctaaaaaagcagaaactcagacatcagcacttgcaaccaatgttgtaaatgctgccctctggaagcccactggtgaggctgtgtccataccacccttggtaccattagtaatatggaggtaagctttaatcttgaaccaaaatgaaaaaagtgctgtgatagcaactccagcagtctccttttgtttagtacttccacaaacagcaatgcagtttctgctaatgcacccaagcctgggtgactctacttcaccaaagagctggtaaaccttcagtattgagcctagtttgggaaactcctgagtacaggctttaagaccacaaagaggccgagttgcagcaaatgcatcttagaatttacacacagccattttcccaaaggcagagcactggtgtacaggggaaggggagataacagagaaaaagtggactgcatattgtgcccaggatctattatcacttcagatctcagtaaatttgcaatgattttcttacattcaaaatgtcagaaagaatttatcttacttcttgccagtgggtctaaaactcacatgcatgttttgaggtgtattctcataatagtgaataagtctcacgagatctgatggttttaaaaagaggagtttccctgcacaagctctcttctcttgtctgccaccatgtgagatatacctttcaccttccaccatgattgtgaggcttccccagctacgtggaactgtaagtccaataaacttctttctttggtaaattgcccagtcccaggtatgtttttatcagcagcatgaaaatggtaaattggtaccagtagagtggggtgctgctgaaaagatacctgaaaatgtggaagtgattttggaactgggtaacaggcagaggttggaacagtttggagtgcacagaaaaggacaggaaaatgtgggaaaggttggaacttcctagagacttgtttaatagctttgtccaaaatgctgatagcaatatggacaataaagtccaggcggaggtggtctcagatggagacaaggaacttgttgagaactggaggaaaaggtgactctgttatttttttagcaaagagactggtggcattttgcctctgccctagagatttgtggaactttgaacttgagagagatgatttagagtatctggcacaggaaatttctaagcagcaaagcattcaagatgtaacttgggtgctgttaaaggcatttggttttaaaagggaaacaggcataagagtttggaaaatttgcagcctgacaatgcaataaaaaagaaaatcccattttctgaggaaaaattaaagctggctgcagaaatttgcataaataaggaagagcctaatgttagtcacaaagacaatggaaaaaaatgtctccagtgcatgtcagagacctttgaggcaacccctctcatcacatgccaggaggtttaggaggaaaaaatggtttcatgagccaggcccagggtccttgggctgtgtgcagcctagggacttggtgccctatgtcctagctgctccagccagggctgaaaggggccaatgtaaagtttgggtcatggcttcagagggtgtaagccccaagacttggcagcttccacgtggtgttgagccagtgggtgcacagggtcaagaactggggtttgggaacctctgcctagatttcagaggatgtatggaaatacctggaatcccagacagaagtttgctgcaacagtggggccctcatagagaacctctgctagggcagtgcaaaagggaaatgtggggtcagagcccccatatagattccctactggggcactgcctagtgaagctgtgagaagagggccaccatcctccagaccccagaatggtagctccattaaaagcttgcactgtgcacctggaaaagccacaggcactctccagcctgtgaaagcagtcaggagaggggctataccctgcaaagccacagggacagagctgcccaagaccatgggaactcacctcttgcatcagcatgacctagatgtaagacatggagtcaaaagatatcattttggagctataagatttgattttcctgctgggttttgtacttgcatggggcctgtagctcccttgttttggccaatttctcccatttggaatggttgtatttacccaatacctgtactccaattgtatctaggaagtaactaacttgcttttgattttacaggttcataggcagaaggtacttgccttgtctcagctgagatgttggattgtggactttagagttaatgctgaaataacttaagactttggaggactgttgagaagtcataattggttttgaaatgtgaggacatgagatttgggaggagccagaggaagaatgatatggttcggcttgtctctacccaaatcttatctagaattgtaactcctccaattcccatgtcatgggagggacccagtgggaggtaattgaatcatgggggctggtctttctcgtgctattcttgtaataatgaataagtctcatgagatctgatggttttaaaaagagagtttccctgcacaagctctctgcttttttctgccaccatgcgagatgtgcctttcaccttctaccatgattgtgaggccttcccagccacatggaactataagtcgaataagcctatttcttttgtaaattgcccagtcttgggtatgtctttatcagaagtgtgaaaacagactaatacaaagtgtaactgcatgttaccttccccagattcagtgcttttctatgcaattgattagaaacattgccactactgcaactgcatactgcaactgccaaaaaaaaatgtttgatggaaccactggttcttatactgactctatgtggcctgggacagctcatcatcaccccctaaacctactctgaaattcctcattcttcagaatgtgaatttcaagagggaaggcagcacctctcttctaagtttcaagtcggttttctttgcctcaggagaaactattttccagtatgatttgcaataggagtatacattcatttcaaagcaaaactacagtccatacatttgtggttgtttttcctacagaagctcaataggtaattgaaataatgtcaggaaatttaccagtgtgtttaagagccaggctccctggcctatgtctcagttcattatttattcaccgtgtaaccttgggcaagacacctaccttctctatgccttgatatgttaatctgagaacaaaagggatatcaacagtatatcacagggctgttgtgaaggtgtatttaaggtacaaagaataatgcttgacctatagtaaatgttctatagtttattttttactctgacacaggtttgtctcacaaatctgttatagttaattatatctagggacacattttaacagtagccactatatgtatatcatatcacaagaggtgacaaaaatggaaaagagtagacaggttctgcagaaaaaagaaaatgaaagaaagtagataaggacttaaaactgtacacctcaaatgacctttgcttaaatcctgcacttttgggttactacagacatttttccttcaaacactgcttaaattctccaacctttcaaggatagtggtaaattacagcattttaaaaataaaatcattgcactgtaaacatatgtatatcttatgtgtgttttgggattttttgttgttgttgttggatgatggctattgtagtctttttgagacacaaatgtatgtgatagctcaagccttgtcaactaaagacctccaaaaataactctctggcaggggactttcagagacttttaccttttcttttatatcaagcaactgttcccaattattcttttgtgctgtcatttataaacagtgaatggctatgaaggaagagcttttcagcaaaggaaagcagtaacatccaacccttagctgccacattctattttctgattcccttatttgagacagtcatgaaaatgccagcatttaaattgtaagacttagtgacgatatttcgataggcttctgaaaaagcttataggtacttcagttcaactcttttatcgaataatagaagttctttatattcattgtacaaaatgtaaaattcaaaatgcaaacgagtgaatagaattaaaagtcatctgcaatccaataagcagacacaaccatttaaaaaatattatgtgtatactacacacatgcgccagagacaactaattttcacacttcacaatatatttatcacaattagacagataggcagaattcctacatgttatataaataggagacaaagaaatttgaatcattctaaaaaccaatgttggtatcatttatttggcattcattaatactatatcatgaggactttttcatgtctttggatatgcttgtagcatgatttttaaaggctgcagaaatgtttttatatacagacaccatctttttcttaacctaaactctatttatttatttatttatttattgagatgagatctcactctgtcacccagcctggagtgcagtgacacaatcatggctcactgcagcctcgacctcctgggctcaagtgattctctcacttcagcttccagtgtagctgggtctacaggcatgtgccaccacacaggctaattttttttttaaattattcgtaaagatgaggtcttgctatgttgcccaggctgatctcaaactcctggcctcaagctatacatctgcctcagcctcccaaaatgctgggattacagatgtgagccatcgtgcacagccaagattatttaatgtgtttaacatttctctgttgctgaatattaggttgtttctattatcttttaattttaattaatattttgaagaactatctagaacataaaacacagtttgattcttgattatttttattggtaaaactaccaattaaaagaacaaatttccctccaaaaagcttcagccagtttttatttgtactagaagtatagtattaattactagttttaggcttagctagttagaaagataaaaatatcctattgttcttttaatttgcatttttaaaattatcgatgaaagtgaacatttttctcattttatttctttgccttttaaacattggaatgccattttacttatgtttgggaaattgcttcacatattttattaaaatatacattcaaaatatttccgctaatcatttatctattggtttatttgtcatggctttgaatttatcaactttgaaataccaggtaaaacattattcgcattacttatttttgtagggggtatttaccaatgcatttatagtatattttatcatattgttttacataaaagttattatttgacttctttaaacctgtggaatttatttgggtatatatgataaggaaatacaccaacttaaaaattcccaagtaacctctatttcccacaccattgtgtaactctcccatcagtagggcatataatgaactcagtttcaagactgaatagtctgttctgtttacctacctattaaattttatgcaaactaactttttacattattctattttacaacatattttaaaatcttgtaggaaaattacatttttgtatttttcaaagtatctttatttgaataatttaatgataatagccgctacactctgatacccctactacctgtactacaatgcttcctgattacattgaatttaaaaattattttgccaagctctaataaaaatccctgtgaagaggtgttatatgtctttttacatctataaattaatttgagaaaacataaatgcttacactattctgtttttcttccatctcttaatttattaaaaggcacttttcgtttattcaaacatatggtgtatctatggagtgtatctattgagtcactgtgttccagatgctactcttaagttttgggaatatagcagtgatataacagatgaaaaaaccctgccttcatatggtttatattctaaacggaacacaaagacaatgaaaaacaaacaactaaaagtaaaacttatatcacagctttatgaaacctatgtaagaaagcagaagacggaaggaggataaagattatatgtgcctgtgggatgttgaggaaatagctcactgagaaaggaatatcttagccggggcctgatgctggggacaccactagccagtctaatatctgaaggaagagtgctccaggcaaagggaaccaactagttgaaccttttttatttaatgtaacagcctttcaggtttttcttatttagatggactctaatcctaccttgcagagttattttgatgtattttatattttttggtatgaaaagtaaaataaattcctgtaattagtatcattaatattattgtaccatctaggttactgctgtttgtagaagagaaattgattttttctacttctcattcaatttttattggtactagaacactatttaaaatagatacccattgacatgtaagcaaaaatagaggccttgtctagctctccctactcccaattcaggcaccccacaagtaaaaacttactattgttgcctatgtcttcagatggttccatccatatttctaaatactatgcttaggctaccatttagtgaattttcagttttagatacttaagaaccttctcccatcaccatcctctatacatacttacttctgatagtgttcccaatacaattatattatgatttgtattaaatcaatattctgtgattacattactataactaagcaagtattcagatctgtacaacttagttatgatgtttaatttttttcttgaatgacttttctgattttgttttaaacagttaataattatttattttcctgttcattttttcctaggcagactcagatgttttgacttaatgattttttgacttagcaatggtacaaaagcaatacacattcagtttgttcctcaacttacaatggggctacatctggataaactcatcctaagttgaaaatattgttaaatcaaagacacactttcaacatacagtattttcaatttacagtgggtttatcagaacatagccccatcaaggaggggctgtactcgtaagtcaaggagcacccatactcattatgattccttctctccaagactccaacaaaccttataattcttctcaagatcaacacattgagaaatctgtaatttctattttgttttgtttggctttgtttcattgttttctttggtgacatgtctctggggcatatatctggacggtgaaatatattatatctggaggatatgttgaatatgttacgtcctccagatatacatggaatggaggattgacaattaaggctgaaacaagtgtcccagagacaccatcctggaatgtccatcctcctgttccaaccttgactagtggatcttgaggccaactacatcactgttttcttagaatttcccttcatcttcctcctggggattccctttgcctcctacctgtattggattctctgtgtccttgattttataactccctctttcaaagttaattctatccggaaggaactcatcttccagtagctcagtggtcagcaaactatgggcctgcaggataaatctggctctccatctatttttgtaaaactcacaagctaagaatgatatttacatttttaagtggctggagaaagaggaatattttatgacatgtgatcgttacacgaaattcaaatttaagtgttcacaaataacactcatttggaatataggtatacccattcctttatattgtttgtagctgcttttacactacaagggcagaactgagtggctgcaacaagaattgtattgtccacaaagtctgtaatatttattaactgtgcttttacagaaaaagtttgtcgacagctgaaacaacccacaaagtgtggagcatgacatggaattgttctgaaatttttgcatctaaaaatgtctttattctaccctcatgtctaatttttagtttagctaattatgaatttctaatttgtaaatcacatttccacaaatattcaaggtcttcagtgttcagggctgttattgagaggtctaataacattttagctctctctcctggtatttttcctctttataagttatgttgttatgttttctcaagtgctttagaatcttcttaatttattttactgagatctcagtaatagtgtgttcattttttattatttttaatctggtaatacatgttcttcaattctgggaagcttctttgaagcattcctttgataattttctcccttccattttctcagtttgcccttgttgcaactctttttatttagaaattgggccttccgggctgatcttttctcttttatctcctattttatattttatattttatctcctgatattaattcctttatattttagttgtctctgggatgttgtttcaaccttagttgtcaatcctccatttcatataaatatacctcttacagatataacatatttaattctccagatatatacaaagacacatacacatgaacaaacacaaaataaatagaag

SEQ ID NO: 2306 - DNA, 2475 bp, Homo sapiens
aggtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaaacatgtaacaagagtaacatgtgtgaaagcagcaaagaggcactggcagaaaacaacctgaaccttccaaagatggctgaaaaagatggatgcttccaatctggattcaatgaggtaccaacttgtcgcactcacttttcactattccttaggcaaaacttctccctcttgcatgcagtgcctgtatacatatagatccaggcagcaacaaaaagtgggtaaatgtaaagaatgttatgtaaatttcatgaggaggccaacttcaagcttttttaaaggcagtttattcttggacaggtatggccagagatggtgccactgtggtgagattttaacaactgtcaaatgtttaaaactcccacaggtttaattagttcatcctgggaaaggtactctcagggccttttccctctctggctgcccctggcagggtccaggtctgccctccctccctgcccagctcattctccacagtgagataacctgcactgtcttctgattattttataaaaggaggttccagcccagcattaacaagggcaagagtgcaggaagaacatcaagggggacaatcagagaaggatccccattgccacattctagcatctgttgggctttggataaaactaattacatggggcctctgattgtccagttatttaaaatggtgctgtccaatgtcccaaaacatgctgcctaagaggtacttgaagttctctagaggagcagagggaaaagatgtcgaactgtggcaattttaacttttcaaattgattctatctcctggcgataaccaattttcccaccatctttcctcttaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaataactgtattttaaactatatattaactgaggtggattttaacatcaatttttaatagtgcaagagatttaaaaccaaaggcgggggggcgggcagaaaaaagtgcatccaactccagccagtgatccacagaaacaaagaccaaggagcacaaaatgattttaagattttagtcattgccaagtgacattcttctcactgtggttgtttcaattctttttcctaccttttaccagagagttagttcagagaaatggtcagagactcaagggtggaaagaggtaccaaaggctttggccaccagtagctggctattcagacagcagggagtagacttgctggctagcatgtggaggagccaaagctcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaaggccttccacaagttacttatcccatatggtgggtctatggaaaggtgtttcccagtcctctttacaccaccggatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttca

SEQ ID NO: 2307 - DNA, 7689 bp, Homo sapiens
ggattttgccccagctgaagggttgtacaattgagtctaagttggggtttggggcatggacacgcatttggaaatggaaaactttcccataggataacagctctaagtctgcggccgtgtgcttgtgctcccctccaggcagggaggacatgcactgctcagggttccgagctgacccaagcctcttacctcaaccccctcctcctggtgagagagccccactgggttccgcagagaagaggaagaggatgtgactcaaagattctgggcttccttggttccctgggctggaagtcagagagataatggaatccaggcaaaccacttcaatagaacatggctggcggccatatggacatatttgaatccaacaattaattcagcaaagaaagctgcttgtggcaagttttgaatgtgccattccaggtagtgctttgatgataaatgaggagaagattgcaaagaaaatgacagcaacatttataaaagggtctcatgaatataacacgatgcccagcacatagaaagcatacaataagtgtttgttggataactgtggacagttcagtcgaccagcaaattcctcttaggactctagatgcacggagagtggccagattaatacagactggcaaaagaagaacttggcaaagtgatttgatcacacacttctcaccctcacatctcctgacagttcccctaatccctgccccacttccccgccatgggcttccatcaggaaactccttgatatcatcttcgagaagaaaactgaggcatagaacatttgggaatgaatctaagactacacatctagaatagcagagttacaggaatgcagatgtgattcctatggatgagggtaacctagaggctagaagaacaataggacagaagaagcctgggtccctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataattctaccttgtgccttgacaacatcaggtattattcatgcccttttctctccctgtaatgtctcttatccacgggtagaaattatattttccatctaaggtttgctcaaatattatctacttaagtagctcttaccaattttgcctctcctcctgagctgaccctatgccttctatgctgttccaggtaatattaatctcttcctttgtacttctttcacagaacatacttttttgtctaacataataactataggcataagtgtatagattccactaggggcttcagaacagaaactatcatcttattaatttttttctccctgatatctagggaaatatgttatatataataggcccttagtaatcccataaatgtttgtgagatattcactgactataagccatactctgtatttatttagctaaaacagacgtctttcatatttagttagcagaaaatgctcacatttactcctttcctgtttaccaaatgaaagggtaattgttttttcacagattgcactagaaaagtgtcttctctctctttttcaaatagattgtctttaaaacatatgacaggaaaagtgactattgttaggataagataattacgattgtaacagctagtttaaaagaagtgtcagttgctcctgttttatttttcacaggatagagctgcggcctgtctcagtatgatgttttcaggatctggtatatatttttattttcctacatgaatctttcatccttttactgacatttattcattttatctaattatcctaaaaggaaagctctggccaggcaaattggttgttgtctgcctctgaagagacattcatatcgcgtcgcttagctttcaagttttgtgatcaggaaccctcaggcccatttttaaggaggtttcaggctagctgagcttcactgtctcccaaaatgtacaaaatgagattacatgagggacaagatcaatttactggaaggtacttaagcagtaaatctggagctttttgtccagtcactattgctttcaagctttgtagcagaaaattaagccacaagagctttgacaaattagatattactacctctaattgtgtatgtttaagcttatcacactgaattgcagcattgtaactgactattatgccaacaaggccttcgtttaatcagcgcagtgccatttaatcgcaattaatcactcaactaaaatgtcatattaaggtcacagaaacttgaagggctaaaagaaaagagaacattaaagtcagctgatggaggaaaagagcatggtgtgccaagggaagttctgagcactctttttcattagaagctggtagaacatttaatgagaattcagtcttaactttcagctgagatcagaacaacgtgcctcacttggttaagcaggagactattctgcccattcttagcgggcttctgtctgtaaataggatactcctgcccacagaatacctgaaattttacagattcatgatttttatttctattattctttggctttctggcattttcccctttcctattacttttaagaaggaaagaaatcagatatgatatggtactgaagacaagatgaaataaatagcatcattttgcacagtcacttacaaggtatttataaaaaggaacaattggattcacttgtttgccaggaagattttatttcccagaaaacttgtcaaatcgaatgttatagtgcaaaaagaaaatgactgaagcttttgttttttaaattttaatactcaagaagtactatgccagtctgaaagatctctgttagcccctcacaggacaaaacttgtgagaagtaatttcacccggaggaccgggactctgccacccatggctcattccttatgctttaaccctgcctagccctaagaaatattgttccactaactgattgactctgaaaacagagccatggtaaagggtatatagacaaagggcacacttaaggtctctctttgttaaggagtagtaggtaattttattttattttgttttattttattttattttatttatttatttatttattatactttaagttctagggtacatgtgcataacgtgcagttctgttacatatgtatacatgtgccatgttggtgtgctgcatccattgactttttcagcaacgtggatggaactggaggccattatgttaagtgaaataagccaagcccagagggacaaatattgcatgttcccactcatatgtgggagcaaaaacagtggatcttagaagacaaaaactagaatggtagttaccagaggccaggaagtgtagggggaaagaagacgaaggagaaaaaagaatataaatgtatttattaccatgaactgtacacttaaaatggtaaagatggtaaattgtatacatgcatctcctcagtaataaatagttttttaaaaaactgactctaatgaccactcttcaaacttgcaataaatagcacagacactggaaacaatgaccacctccaacaggaaaaatgaatttcagttttcatacccactgagcctatgaagcttggtgagcaagatgtctgtgtttgagcaaggctcgctcaaaccgtctcctgcagacctgtgtggaacggtgcagtccactagccacacgaggctactgagcacttgaaatgtgactagtataaattgacatgcactgcaaagatgaaatacacactaaatttcaaagactgactttaaaaaaagaatgtaaactcattaataattttttgttgattacatggtgaaataccaattttggagtatactgagttaaatgaaatatgttattaaaattaatttcatctgtttcttttcactcttttcaatgtggctactaggacgtttaaaattatgtgtatagctcatatcatatttctattggacagtgtttgtatagaccaatgagaagagtcacttacatcggtatcaccactgacctggaccagatgtgatccagtaacccagaggagaaacatttctgacctattctaatcctctaagccaaacaggctcttaatcaaagagctagtgtttttacaatatcaaatggaaaataaatataataacctcaatagtacacttgaaaaaatgaaggattaattttagaaagacaggaactggcattattcagattgaaggaaaaaacaacaaggcgaaatttaataaatatctcctggggacatatgagacaggttaagattgcagcatgaaggctggaggttaacttaaatgatttcttaagagtcagggttgtttaacacttgatacaggttgtgactcttcttttcctggagggcaatgataataaggcaaggcctcctctgaagtcctagataagcataagattggagaagccaatttaagatagctatgccatatcagcacttattcagatactttgagtgcctctgaaagttggtgatgagacgggactagattaccagccctttcaaacacactgagcctcagtcagagccatctttaatttctctccttaggtgttaataaaattcatcttaaaatttattactttatgatatctcaacattctcttacaaaatttgcacttaaaagcttatcaaaatcttatacctggaaattgaatggaagcaccttacaagctgaaacagtgtctttatttataacagtaaaaattacctttttattataacacacccttgtacgcatgtaactatatcatacatgttatataactaaatgtgtatgtgcactataggatatagtagccattcaaaaacatttgatgagtgaatatatgttcactcacaattgaaaaaaaaaccaaatgtccgcatttccacagctgaggtagagaaggcagctgaagtgtggcagaaagcccagcctctccagttctggtccagtgcatttatattgcaaaacgttgataagcaaatgctgcacatgggtataataaagtttggaaattttaccaatgagatgtagtgttagaacaattttatgccttggtaaattatcaataacttctctaaaaatatcgatgttttaaaatctcttgcaaggtaacttcctcagagagcatggctttatattagtaagtaaaggaatagtcactacataggtcagtatgagaaaaccaaatggaaccacaaatctctttctaaaaattctacctaaataaaagttcctgatcaagttaaaagcctagtttatagcacatgatgctttgtctgatctacatccaaggtaacttcttgagtggaagactttgggcttttttagacaaaggtttctggcctccatttttataaagcctagttaatttatatgctgaggtcttcggtggatcacaggtgtattttctctatatttataaccacacatcaatttttaaatggaaacatctgagctttcagtggctatgagccagtcttgagtgaggaagccatactcacacaaaacttggtataataaccaggtgtagccaaaataaggcacatccatatgcatgttgagtttctgccacataaggaatttataatagagtttatcacttatcagaatgtatttgggcttacactgactccattaccaaggaaaagcaattttaacgaggctttcctgtaaggaatctattgtttcttcttcctaaactatcaacttcacctgaaaatacttctaaaaatgagaaaaatagttaattttcagccattgagtctacctttggctggatgtattcctttaatttcagtgccaacgcataactatttggccttttataaaggttgcgtatttttcttctgagtagagttgccctcactatgtcagaaaacatgcatatgtactcttccaaatgaggggagggccttatagcctcactgatgatgagcccagagtgagtcactcaggatcttgatattgttttttgaaaacaacaacaacaaaaatactggtgtctgtatagaaaatgcctaattctttccaggtatcaataaattactttgctagtcagagtatcaatgttggatggtgttgtgaggtttacatccatgtctagaaaaccacatttatgctgcaagcaagctattataaaaagacgaaaaataatatatttttaaaggactttccaacaagttattggaactgttcctttaaatattaggaaagcactccaactagtatacctagtatactacctggtaaaaattaaaataactactacacgctttttttggaagatctgagtgatatttccaagtgtcctaaaaaacaattcttcttccccatctcaatccctaacctcttttgaaggaacagccattgtttgagccaggcaatttaattcttaggacttttatcaacatgacaggtctcagcctaaaccagggaacttttttttttccttttatttgttttcttttcaagatatagatgatatgcccctatccaatgtacagtttagtgagatggatgacacttcactcactggcagttcaaggaagtcttagcctagcttgtttacatgaacacgttttagaacagccatatagcttccagccagctctaccctgctgcccagcactaagggggaaagcaggcagtgagcccataggtcgctgataaactaactccccatttggcaagcagggaagggaatgataagggctctgatttatgttttatctgtcgctaagttttcagccagcctgaaatgacttggttctgttatcacctcagatgccacaggtttcttaagtgaggcagattctttggcgacttttaaaaagaactttatttcacctcttgcagaaggttagcttagcgatggatgctgctttaaaacactcccatctggcttcataaactgtgaggctataaaccagcttgtgggctctattccatggttagttcttgacatcacctgcatgtaactatgctacccttttggaaacacaaagctgggtgtgatgcatataatgacagggatgcttgaatcttttaaaaaaattacatacctaaaaatgtgttaatatgaaaattgcatacatcatcctacccaaacttatctaaaaagaaaactttctacaaattaattttctgtcaacatacgttgacttcagatagtaaaaagaaatgaagaagaaaaatctgtcttgagggagaaaaagagtgtcagtggatacaattagaaagcaaaaaaaaaaaaaaagcccctgttttctgtgatggatgctgcagggcagctctgggggtcagtgggagattagctgacataaaagcaagggagtgtatccttatctagtaaactaacacaagtcagtaaatgaaagccctcggtccccaacctatttcaagttgtttccccctaagtttaaattggcttgtcgttttacaaggatggatgggtattatttttaagcctttattttacaatggaagaatgtgagtgtttcacaagtgaaatgttcccatggagaagggaatagcaatgaatcataaacagtgtaaacactcccaagcttcttatatatgtaag

SEQ ID NO: 2308 - DNA, 1741 bp, Homo sapiens
ttctaatctggctgccaggcacagacggcacgtctgcagcacctgccagcccacgcactggcctgcctggacatcacaagtgaccagggttactcggcactatcatatctctcaaagaagaaacaactcctccaacggcaacatctgtggggctgcttttgaactatcagcaattcatttgagcaagagctgggagcatttttcccctgggcctgatcatgaggaagtgtttgcccctctggaggacacagcaacaaggaccatcttggaagcagagacctggccctcaccagacaccatacctgccggcaccttgatcttgaacttctcagcctccagaagtccagcagtgaaagtgcaacgactaaaagggaatggagtgacacagacaagtgtctacaagagaccctggggctgctactccaaatgctgtcactttgcaaggttactgggtagaacttcaatcttactactcacctgctcaacaacctgcaatggctccctattgttgcctttcccaacaaggcctcatttcatggatgattttccatcgtctggccctatcctaaaagagagtggagcctcttgctcagagtcaggctttggtctcaactgccttgtttcacattctcactatgccagtccccagctgggtgatgatgagtaagttacttagcctctctgggcactggcttccttacttattaaatgtagataatattaggttggtgcaaagtaactgcagcttttcccattaaaagtaataatatctcacttataaaattattttgagaatttaaaatcatgcacggtccctgtgaatatgctacaaaccgctgatttatacaacttaaaatggtaattttatggtatgtgactaatatttcaaaaaaaaaaagtaagcatggtgtctggcccagatctttgaaaataaaacgatgctaattattgttatgaacaaggtttcccaaggccctgtcactgggccaggcacacagcagatgctcagtaaacactcctggaatgaatggagaacatattccacaagcatgctttgagcattgtttatgccaggtatgtgggggatggggaacatagagattccgagttcagttttgcatcctcaggaagggaagacagaattattctccttggagtggggcctcctgacccagctgtgcctggctgtcaggggaattaacagcctctgtcccttgctgcctgttccaggaggcagaacccagtccagctgattctgagccatggggaaattgtaacaggcagaggaatgtgttcttgtatttatctttgactgacagtatctgatgttccaggaattgacttcaaacagaatccggaggagccccttatggtcccgctgccacaaacaaggcccagagagcgcaactctgcccagcccagcaccaggtttttggcctccccgccggcccgaggcacatcggcttcgatgtgccaggcggtgggcgaggaagtggaggttccagctcggcaaagcttaggctgaggctgaggatgggctagagtcaagtctacgtgtgcagccttactcagggagacgcctctgcgctgcaacctcatgcccgggagggcaaggctgggctagggcgggggatcgcgaggggcttggctgggaagaggactgcaggagaggtgtcccaactctcccctcgctcgccaggcacacagcacgcgcctactcggtgctggctgcatagaagcc

SEQ ID NO: 2309 - DNA, 1894 bp, Homo sapiens
ggaaaatgacctgcaggattttacatggagcttcctgtgtgcatgctggtgactgttggcaacaaggtgtcaggaagaaagacattgctttccaaactccttttcccaaatgatcctttcttacccagtctgccttacctgcttctgtactgttcaacagaggagggggaacagggaaaagcaggggcagttgtgaaaaatagaagggaaacttgagtgtgcctttttcttctccttctctttctccaccctcagtcatcattaacagaaaaatatttttaaaagatcccttgatggcatccccaaatgttaagtctgacattttcttagctgatggcctcctttgtgaaggtactttgtgtccgcccagcatgcctgctggatccctggtttgccgcagttgctgaggtaaatactctttccattaagcaccacagcccaagagtggcctaaagctcaaataaatgaccaagaagcaacttaaacattccctggggcgattttaacctatgcaatggctttttgaaaaaattgcctattttttcatgttttggccgggggggtgtctcttattcccttcttttttattttcctttcagctgagtacaccttctctttcatttattcatgcactgcatgaaggatggaagcaggatgaataaatcacagagcattgcccctctccccactcagggtctgtgaagagagctggagcagaatacagtccaggcattatgtcaactttcaggggacctggggcaggtggccgattctcacagagaccccacttccctttcctgtgaaaaataccacagcccaacagccactggagaacagtgttcttctggaagcttcctctgggcaggaggagtcaaagatcctggtcctcagggacacttgagatgggtgtgcccaaagctgtgcaggatggtttggtttgttttgtttttctttgcctcaggaagaatgtgttcacaaacctcaggacaaatcgtttaaaaaagtgtcctgacagttgtcatgcttcatcacttgatttagaggcaataggacagccttattttcttctaatctctggtggttgaggagtctggttggcctggcagaaggctgagattggctgagggagtcatgagcgagcaggggcctctggtgcctgaagcgcccctcaggaagagcgggtctcaccggaaggccacactcatctccttcctggttacccagtgtggggatttgctactttgctgagtgtgttttgtctacattcatggtgctccagaactgtgtctgtgtttctcacattctctttcgtgtctgccagagcaacattctcagcaaaccatctgaatgcaactcctgtgatcacaaaagtcaatcactgatggaaatgaagaccacgaccctgattcctcaggtgccggattgatggaacctcaaatgtgtaaagtcttgcacaggaaaccccccagcatggccattcagaggctctcaactcctgctggacccaaacacaagaaaccaggaggcccagaccccgtctctcattttgcacctcagtaaacagtacctcgaaagagaactccattttcttttcttaacgttcttcagctaaaacaagagtgtagggaaggggctacttggaaaagagattctctaaattgcctgaaaaatcgatcacaacccaagaaccaagtattttgaaacacagcatatttaggaagtttgaggaagctttaaaatatctccagaaggtttgtgtttagcccagcacgatgtctgtcttgtgacccaaaggtttatcttccgaaccttacttgagcaacttcattaataaaaacatttttgagaatgcacatctaacacgtatatacttattataacttttgtacacata

SEQ ID NO: 2310 - DNA, 865 bp, Homo sapiens
cacgcggccgcctgcacagggggttccagccacccgcgctctcccaggtttgccgaccttacgggcccttctccgccagccctggctgggtcacccccacgacccgggactcccccgccgttccctcccgggctgcctgcagtgaggtccgctcctgaggcctcagcctcgccgggggtagggccctctcccgccgtcgccgcagctcctttccgtcccggggcctggggggcaccgtcccacgggtgagggccgcctccagcgcctggcccagccatgcgaacgcctggagcccgcgagctgcagctgcggccctgaaggtgccgcatatcctgccgagtgggtgaagcgtggcactttggaaaacaaatcgggtgatccgcccacctcggcctcccaaagtgctggaattacaggcatgaaccacggtgcccggctgacacaaggaactttctatgaggtcctaggaatgaaggaaaacaggcaataaggcaagaatcgctgtcgaaggagtctgcgccacctgctcgcacagctcacttgtgccttctgagcctgctggagcccagtgtacatatgccgtctccgcgtgattagagattgctgctgcacgtgcccaatcccgtggcggggctggaacacaaacggggtggtgttccagctgcaaccatgcagatgaagactataccctaggagatggaggaacaacagacaagaaagaaacctgggttcctgaataaccacgtggagccaagcagcttacttatctcaagccactgttgcccacctccagattgaactgtctgcaaacaaatctttacttgatgagaagtttaaatataattaaatctagaatattacatga

SEQ ID NO: 2311 - DNA, 2415 bp, Homo sapiens
cttttgattcactcctaagattttttcagaatattttctttttctttctttctttttttttttttgatggagttttgctcttgttgcccaggctggagtgcaatggtgcaatctcggctcactgcaacctccacctcccaggttcaagtgattctccttcctcagcctcccgagtagctgggattacaggcatgtgccaccatgccaggataacttttttttgtatttttggtagagatgggtttctccatgttggtcaggctggtctcgaactcccgacctcaggtgacccaccctcctcggcctcccaaagtactgagattacaggcgtgagcccccatgcccagccccaggatattttcatgagggaaaccacttgaatattgtttagatatggatgctttgggtaaagtgcttttttgtttttctttttgaaattaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatactttcttcagtgcctcaggacagaaaaacttgagaattattttattcctgaattcaatctattctctagcaacttaattgacaaaagaagtaaggaatttctgacaaagcaaattgaatatgaaagaaacaatgagtttccagtttttgatgaattttgagattgtatttttagaaagatctaagaactagagtcaccctaaatcctggagaatacaagaaaaatttgaaaaggggccagacgctgtggctcacacctgtaatcccagctctttggaggccgaggcaggcggatcacttgaggtcaggagtttgagaccagcctgaccaacatggtgaaactccatctctactaaaaatataaaaattagccgggcatggtgatgcatgcctgtaatcccagctactcgggaggcttagacatgagaatcacttgaacccaggaggtggaggttgcagtgagtcaagatggcaccactgcactccatcctgggtgacagagcaagacttcctctcaaaaaataaataaataaataagaaaaataaattaggaaattattaaaataattttttagaaaagcaacaaaataacaaaaattagtgactgtaataattggaatgtttgaaatttgtcacagcaataattgactaaaatgaatgtaaataattattcagttttcagtttgttgtaataaactctaatcagtataaaggattgactatcctaggaaaaagattagtcaaggaataagaagcaaaagtagtatttgaaatctaaaaacattaccatgtttgctttatcatgcaggcaaataaataaataaatgacatttttaggttggaataaaaaaagataaagtacatattgccttaattaaattcatcaagttcttactgaaaaacagctctccgccgtgcctggccaggaaatacataattttttttttttttttttagatggagtctcgctctgtcgcccaggctggagtccagtggcatgatcttggctcactgcaagctctgcttcctgggttcatgccattctcctgcctcagccttccgagtagctgggactacaggtgcccgccaccacatccggctaattttttgtatttttagtaaagatggggtttcaccatgttagccaggatggtctcgatctccttaccttgtgatccgcccgccttggcctcccaaagtgctgggattacaggtgtgagccaccacgcctggctgaaatacataatcttaaaagaaaacataagatactttattttaatatacgtgactaaatgtaaaacctaacttattttctgttatctatttatttttactttcagtaacactttttttattttaggtagcattcagcctagaggcaactgctgtttgttaaatatttcctgttcatatattttgcacattttcttatgggttagttttcttctcattgttttgggaagttcttaatatatttggggtatttatctttcattcgttgtctgtgtaacaaataacttctgccatatgggttgtctgcacattttttggtgtcttttagtaaacaaggtttttttgttttgtattgttttgtttattgtaaagatttttaaattttaatggagttgatttcttttctcattcaagcttttgagaataaattggagttgaatttttta

SEQ ID NO: 2312 - DNA, 17171 bp, Homo sapiens
cctggaggtggggtggggagaagtgaagaatctcttcctttttaatagattttcaagatgggaaaatcatattgcaacccacaggcatttggaaacaatttgtgccgaagacagaaagtacacctaacgttaagctgaaaaaactggacgctcccagcaaactcactttgcagactcctggttgtcagaagaaaacgccagaggatttcacttggcattgacctcttactacttccagccacttaccctgggcagtagaaagaaggaacagaaagcagagtagattaagaggagcaagtacaaatggcgtgggacttcaaatcaccacctaagattacttctttgatttctgaaaaagtaggtcaaaggaagatgtcaggggcaagaaaccaattgggtgttgtgcctaagaacgtggaccctgtggccagactgcttggatcagtgtcctccctccaccactttgtagccatctgacctcaggcaagttacttcacctctctatgccttggctcctcatttataaactggtgatatgaacagagcctgtgttctaggattgctgtgacaattacatagaaatgagtcaacatgtacatagcacacagaacaatgccaggcacacagcaagtgctatttatgttcttctttcttcctcctcctcctcttcctcctcctcttcttactttatgccattctgataaacactattttatttattttataatttaggaactgattctaaactacattaagtaatttgtttaaggtcgagcatctagtgagtgttgggcactgtgttggagcttcagtctgtctgacttcaaggcctgtgctcctttcaaggtgaggtgtttgacacatcccctgcttgccatcctggtggcattctctcaaccaccaaagcttatgaaaacatgccactcaggttagcttccaccggacactgacagaggagcaattatacctccgccaaagaaaattctcaatgccaataagggttctggctactgtggtatacttagaggaaatgaatttaggaagttttaattaagatttcaaggatgagaagaggaaaatatgaaggagacggaataaatattcttctactttgattgggagggtcaaaattcgctttcgctgtcttatgaaggttgaagttctaggattcaggaataggattctttgctattgggtattaaaaagcaatagagctccaaatatatgcaatcaatccatcccatctttagggaaacctaaatctaagccacctagtatagagagccacttgtcctgtgagtaaagacttttacaagatttaacagagaataggagcaggaaagagaccaacgtaaggcagttgctagaacaacagaattgctttacagttctgacttcacaacctcattttcctgacctgatagttctgagacgaacttctctgggtgcatctagaatctattccttctgtgaggtggtcaccaggcctggtgaccttttaagtttaatgtattagagccagctgggtctttgagccagtggaaggagactgtgtgaacacttgtaagccatgtgcctttgtccagtagcgtttcagtgctacctaagcatctctacagctattgtgtctgacctgctctggggattgaaacatatagttggaacaggaggcagtggctttttttttttcttcgatagatttctaaaacctttaaatgaagtactgcatatatacagaaaagtacatagagcataagtatatagtccagtgagctatcacaaaatgaatgtacctgtgtaagtgccactcaggttaaagaatagagcattatcagcacccaagaaacccactgaatattccctccaatttatcatgctcttccttctctccaaaggttaccactgtcctgacttataacgccataggttagttttatttgcatttgagccacatataattagaatgatacattctgtattctttcaggtctggtgactttcacttactgttacatttgaaagttttagtagatttgcatgtaataggagttcatgtatttttactgctgaatagttttccattctataaatatactatgagttatttacccattcaactgtccctttaatggacatttaggttgtttaaaatttgaggttattatgaataatgctgccacaaacattcttatacatgtcttttgtgtatatttctgtgggagtacatatctgcaagtggaattgctgagtcagaaagtatgcatgtagtactcagcgttagaggaaccttgccaaagagttttccaaagtggaaatgtgccagtttacgcttccaccaacagtgtgtatgttcaaaatccttgctaacatttggtattgtcaggcttttaaattatgattgttccaataggtgtgtagtagcatgtcattgtggttttaatttttattttcctgaagactgataaagttgagtacctttggaaatgttaattggcaatttggctacctttggtgaagtgcctgaacatggcactgggttatttgtcttccttattaatttgtagttttcacttatcctggacatgcgttatatgtgttgcaaataatttctcccactatgtgggttgcctcttcggtactttaatggtattttggggtgaacagaacgtcttaaaattaaaggaccacaatgtatctttgcctttttgattaggacattttgtgactatttaaaaatcttctaagatcataaagatattctcccatgttaacttctagaacaggggttggcaaactatggactgtgatccaaatccattctgccaactgtttttgtaaataaagttttattgggatacagtcatgctcattcatttacacatcacccatgactacttttgtgctacaacagaccttatggcacacaaagcccagaatgtttattctctggctctttacagaaaaagtttgccaaaccctctagaagatttattgttttgcctttcacatttggaatggtatttgtgtatagtgtgtgatagggatcaagattttttttccatatgaatatgtaattgaaccagtgtcatttattaagggcttagcctttccccatgattccctatgtcataaatcaaatcaagtatacatatatgtgtggatctgtttccagattttcaattctttttattggtccatttttctatcccatgaccaatacgactctgttttacttggtgcacttttaaaagtgagtcacgatatcttcccacttcatttttcttcaaggttgtctctgttactgttaagacttgacatatctgtattagtttttgaataggcctgtcaatttcctcaaaacaccttcctgggatttagattggcattatattgattctgtagatcaatttggagaggtttgacttatttacagtgatgagatccttccagttcataaaagtgatgtattttttaatttatttaggtcttcttcaatttctttcaataatatttagacctgactttgatatcctgtacatattttgattggtttatttctaggtatctttgatgctatgataatttatgtcaacactagcttttgtgtaaaagaaaaaaactactaactagtcacctactgatatggtttagctctgtgtccccatccaaatctcatggcaaattgtaatccccaatgttggaggaggggtctggtgggaggtgatttgatcctgggggcagattttccccctgctattctcacaacagtgagttctcacgtgatctagttgtttagaagggtgtagcacttaccccttcttattcttcctccttctctggccatgtaagatgcgcctccttcctcttcatcttctactgatgattgtcagtttcctgaggcctcccagccatgctccctgtgcagcctgcagaatcaggagccaattaaacctcttttctttgtaaattacccagtctcaggtagttctttatagcaatgtgagaacagactaatacacccagcaaatgccatgctgtagtggaaatactgtggagaccaaaacaatgttacatgctctaagaaataaaaattgttgggtggtaaagggaaatgacaagcctggcaggaaaaaatcatcacacacagcacatttatatacacacactcacttaagtgtctgtctcttccatgggttgagaatgcatactggtattggctcttaagactccatgacagaatggaaagagtgctagtggaatgtcaggactcctggatcctaagcttggttcttcacaaactagttgtgaaatttcaggcatagctctacttaacctccttagatctcagtttttacacctctaaaaagtgagttggctctaacattgacttataaataaggaaagggaaccctttggttcctggtgagttctgacatagggatgtcctgggcatgatttgtatgatttggggggcggggtctgcctgccaagagatttcttaaagaaaagctatcttcctactagtttgtgaatgcttagtaaattctttgacagaacaaatgtctctgagagaggggatcccctgaggtgaataagcagaggaataacagatgcaagaagacatcacaaggatcaggcacaggtgccttacctgaagtacgttccagaggtggagaaggttcaggaaaaagcatagaggcagaagtgcaatgaagctggcagtgtccatgcagggacttccctttgaatcatgaaagtttcatagaagagatgaattgagattctgccttaaaagtctttaaagaaagagttacaatcaatggacaaaaagtgctgccatttctctttgtgtctaacagtgatgatgaggagtgggtagagcagcaaaggctgtttgtcaaaattcatggtcctcctcacctagtaaaatattcaccctggaatatttcctgatctttgatccctgatccctgctgcccaatcagagactccattcccagcacacccctgcatttgtgttgagccagtagaatatatagaattagtatttgttacttctgaaccacgaccattaagaagcatgtgtgccttctccatcttttgtttctctttccatggctagaacctaaggactcccagttcccaggagataatggagcctcaagatgtaaggagcccgtctaagctttgtgctgctataacagaatacctgggactgggtaattaattaagaacagaaatttatttctcacagttctggaggctggaaagtccaagatcaatgcaccagcatgttaattgcttggtgagggtctagtctctgcttccaagatggtgccttcaatgctgcaacccctgaggggaaaaagagatgtatcctcacatggtagatagcagaagggcaaaaagggatgaacttcctctatcaacacctattataaggacagctaatatcattcctgagagtagagaccttatggcctaatcacttcttcaaggccctatctttgaatactatcaatcacactggcaacactcgaattttggatgggacacattcaagccatagcagagcctcaatctttgagttatctcattgaggaaagtggtgtgcccaccgggaatacttccaccagactgttctgtgaatgagaaataaaattctgttgttgtgttaagtcacaaaagtttgaggtttatttgttacagcagccaatgttaacctaaaaaatgcagtttgtttccgaaacaattcacagtagtgacaggaaaggaataaaagcacaatgttcttatattactgccatttcacctaggaaaagagagaaaatgtgaaaggaggataattaaaaaaaaaagtttccccaaactttttaaagttactggagaatgttcacaatttatataaaaataggatgataataatgtcaacacgtaatatctgtgcctaatagattttcactcccccaagttgcattttaattttcctaaattggctcatgacatattcttatgtgggattcaacatttagcaacaaataagacttccctctctcttggcacttcttactcctccctttcccccacgcatccatatccctgctgccttctccttcccacaaagctcatttttggcaaagtggtttttataaaccacacattttaatgaattaagtgtagtcccacgatcacacttacattctcctacagtcccctgacttccacactcctccagctatgggaattttccctcacacctccagaaaggaaaaaaatgaattgaaaattttgtctataagtagaaaagttatgcacagaatgtgatggctctcccacttttctttttttctttttctttttttttttaatgcaagaaggaagatgattttcaaacattgcacgtcctctgagaaactaaaatattcagtgctgtttttcttttggcagtagcataattggttgtgatcataaacccacatagttccttttatcctttttagtggcagcttcatggattgtcttctaccctgtcaaagaagagagttggggtgtttgacagcaaagaaatttaggagaatttcagagcagaaaaggactttgtacatcatagtttccaaacttcttattttaccgctgtggatactgaggttcacaggtggtttaacttgccgaaagtcatggggttagccaatagcttctgcgaaattaagctatacccaacttttacagtttgtatcacatgaagtttcaatcacacaatcttcttggatccttgcaacagctgcatgatggtactagaaccaccctctgctagtgaagtgacataagaatgctcatcagagtgctaggacttagaattgcatccctggccaggtgcggtggctcacgcctgtaatcccggcactttgggaggctgaggccggtggatcacgaggtcagcagatcgagaccatcctggctaacatggtgaaaccccgtctctactaaaaaatacaaaaaattagccaggcgtggtggcacatgcctgtagtcccagctacttgggaggctgaggcaggagaatggcgtgaacccgggaggcggagcttgcagtgagctgagatcgtgccactgcactccagcctgggtgaaagagcaagacttcgtctcaaaaaaaaaaaaaaaaaaaaaaaagaattgcatccctgaccactgagtccatattctcaagtccacctagcctttttttttttttttttttttttatgtttttgtggtgtcaccaacaaagcattagacgcttggccagggtctggagttacctagacaaagggcataatctatgctctctaagagcacacagtttagtgagggcagataaataaacaggtgattccagcccagtatgatcaatgcttctatcttttgcacttggcatgcaatcatttcagaagcaatggttgcatttcccaagaaaaaaaacaacaacaaaataactaacagcagtggtggtagcagcagcagcagcagcagcagcagccgattgctgactcatcaaacgaggaggcaccaacagctttgcctcccaactaaggaacatcttactcaatctccttcccaccccccatcaccacctgtaggcttggaaccaataaaggctttggaaatgaaagataatgtgctaataggatgttaaaacaaaaccactctcaccacccaccaccagaggtagtttgtgtaaaggcgttattcccgagcctcgtgcttcatttcatgactccaacttgtggcactttgctaggtttgcaagtgttgcttatccagagagctcagagattgtttttggcaaaggactcaaagcaggcagatccaacccctctcgctgtctctttcttgttgccaaaacataagactcttagttttatggaaaagtcgtgtgaattttgcttccaaggaataacctgagattacagttaaaattaagtagtagaggaagattgggaattagaaaaactaagatctggtcctgaaaattaatactgtgtataccataccgttaatgctgtgtattaattttaactcttgaacaaggctattcacctcttggttttagtttttccatctttgaaataagaagagtgaactaaatattttctaaagtctccaacaattctggcatgtatgcattcaaaattttgttatttaattttagagaatatttattgagttcagttaccattagttatgtgccaatcactgtggtacacactggtgaaaagaggtgaaaggcccagctgcctttcatatggctgagagacgagctagggagtggagcagttaaaatttagcaggaggcgtgggtttgaagaggtgtgcacaggaagctgtggggcacagaaaaagggcactgggcacctccagatttactagatctttctccactgataggaatcagaacttgccactctaaaacaggcaactttagcatattgattattttgagctgaatgaacagcagctgtaggaaaggctctctgatctctccctttctacccaaaagctggcacagacttcctacaagaaaagtgccttcctttcccttaccagggagaagagaacattcctattactgaagacagagagtcaatgtcaagatgaatctgtacaaacaaacctacgaaaacaacctttatcttccactagtttctccaatatttcctagtcactttcccacaatttgctgccccagccccaactcctttcgctccacagttgatctttcacatctccacagttgatcattctttgttgaaatggtatataccctctcgggccttttcatttcttttttctgtgaagtctcctatgccatgcaaaaatattaacatcaaataaaatgtctatgcttttctcctgtttctctgtcttttgtcagtttaattctcaggcccagctgcagaacctaagagggtagaggaaaaagctttcctcccttacaccacctttgctcttccctgggagattggtctacatggaccacgtcaacaagactcctgggccgtctggtttcttgttggcttcaactgacaggcagcactttaggagactggggcagagaggagaggcagctctggagtatttctttctctccttgggaagatgactccatcaaatatcactgctcatcccaaactcacctactgtctcccttaccttctcccttacgacctacagataatgagagctccactgctgctgctagtccaaagtttctgtaccagttcctgtagtttcacttaactacacccacaactttataattagttgcttgtaaataaactttcctcatatttagattgatcagagggtgtcatctgttttctgttgggaccctggatgatgtaggcatgaaaaccacttttgaggtgtgtgtatattggaggtagtgaaggagcagttagttaaaaggaaagaaagggcaggagaatggggaaagcgtcccaaaggaaaacagagctaagtcttaaaagatgtcttgaaaagacacaatgtcttgaaagaaataatgagaagggagaaataatttcagagagaaacatgtggaggctcagagacttgaaaatgtcctggggaaggtgcaaatgatcaaggtgactgcagggaaggactggtaggtaggaggatggtaagcgatgaggttggaggggaggcgagggagagatcatgaaggactctgtatgttctgtgaatgcgtttgggttctatcctgaagacaatgggaaattactgaaagatttttaagcagaaaagtaacataatctggttggaatttcaaaagattcctctggtatgtagtgtgggagaaagcaggactagaagcagggagattgtttggcatgttccttcaatgatcaacacaagagtcagtgacaatatgaaatttggcagtggtggtggggcagcaggaagtatatgtgagaactattgaggaatttggtgaggaattgggtccggtagtaagtctgagatgatgcccagatgtttgggttgggccagttaaaagatggtggaatcattcacaaacagacgggatcctaaagggggaactgtattaatctgttctcgcattgctataaagaaatacctgaaactgggtaatttataaagaaaagaggtttaactggcttacagttccacaggctctacaggaagcatagtggcatctgcttctggggaggcttcaggaaacttacaatcatggtagaaggcaaaaggggagccaatactacacggccagagcaggagaaagagagaaagagggaagaggtgctacacacttttaaacaaccagatctcatgataactcactcacccactattatgaaaacagcactgaggggatggtttaacctatccatgagaactacacccccttgatccaatcacctcccatcaggctctatctccaacactgagggttagaagtcaacatgagatttgatggggacacagattcaaaccatatcaagagccaaactcaattaactcctcattcgttttttcccagtaccctcaggaacgtcccctgatcactggctttttttcaacattcagcttgcatattgcccttcagtggcctctgctattacgacccagccagtggggggccatatcagttccttcctcacatttaaaaactactgagtgaatacatgcacagttccaggcacagagttaaacattgaatagaggttactatgaaaaccaatgtgtaaactcagtccaaaataagtatggttataaaacgtctttgctcattcaataaatcctttttgagtgcctactttgtgccttttgttgtttattccttatgtgggcaactgtcaaaaagctgtgagaaagggcttatgctatttaaataatttcttctctctctttgtattcttctccatttctccttttgttctcccccctttctcctcctcttcctcctccttcatttccttcggctttctttttcctatatgcatacagtttttgtgtccgggagaaaaaaggtctagagagctagatttttagagagcattaaaaaaaacttgcctgaattattgattcatagctttataatgcacccagtatagtaaggacatttatagatttcatgagctgtttaatatctatttgtggagtaccaccatgtgcaatcatcttggactcattatgtttctttggctgcccagtgagtcataacgagcctctgaaaaaatgtagaataatggtttagaactagagggaatgaaataacagtcaaagtcaaatatgaaattattagtacatgtagtctgtaagagcaatcaagacaaggaagggatagagggcctattattacatgcacatgtgtgcacacacatgtgcatgcacaaactttaaagggttttcagtaaagggggaggtagctggggagccctatgaagaagattcttaaaagtgaagggttgcagctctatttttccattaagattcaagcacgtgggggtagggagctcaaattatggggaggaaatagaaaagccaatggaggcccttctgagaagagggagccctgtactgagaggatgaaagagactttattctccagcagttaaaatgaagaggaagagatcatttctaaacagggcacaagaaatggcttcatttctccctattaacctctgttcccctaaagaaagccagttgaagcaagcaggacaaaagaattctatgtaagcctagtgaagaataccttctatgatgggagccatattttgaaaaaatattaatgtaattttctctttcaattgtgcaagtatagatctttatttctaattggttccaaggtcatcagcccagaggtctgtgggtgtgttctatggtgtgcaaagggaaaaaaagaggatattcagcatttgatatttaaaacaggatttcaagcaagataatagtcttgaaagaagactttttttttcttcctgagacccatctgaattgctttatctcctcctttggcctatgtactgaattcttatcattttatgttatctttgcatccattttgaatataaattggactttctcatacagaagcagggctttatcttcttcgacacagtttccagttttctgcctcctcccagttcctcaagctggttaatccagacatctgccctatacaactcctttcccctggcaaccacctccctagggaacagttagacacagcctacttgacttgcctcactgacccccacaccccatgtggactgcacagatgtgcaccagtgaccacttctcagtcacagcacaactccatggaattcgtgtctgcttgctctgaactcaccagttagaactcccccagggaaacctgcttagataatgctctggaccccaataaaggctttgacccacaggtttttctcccttccttgctctctgcccactgagtgagcacatatgtccctgaaggttcctctgttctgctggtcctgcaaaacgtgctgccctcctttctctgggatctgtaagtaataaactgcttctggtatttcatgtgttttgtggagttgcctcctctgtgtctctcctgaccaacacacgtgaacctaacttctttccaaatcatggttctcctatagaatggctatcttggcaggagtaaactggacacagtccagataaaagccacaagggcatctgatagtataaacaaattttctgtgagaggggcacctggtcacaggttgaacacttaggcatgaggctgtccaccaagataaagaagcaccccaagaaaggcacactgtaaacatctacaggaaaatccctggagccctgtcaagtcagcactagagtttatattcactgtccggagagagacctcaagaacaaattagaaatacaacagcctattcagcaccaacaagaatcacccagatctacaagtttccctgcagggtagaaaagttattcttttggagacaacaggtaggccatgaagcttgctggtccatgggaagaggagataccacagaggaagacaggcaagccctactcttcctgtcccaggagatgatgagaggaaaaatgaagagagagtgaaggggagggggctgatttaggactatcccaaaggagttaatgcaaacaccaaggaggcactgagacaaaatagaggagcattgtcaaggggatggattggggttggggagaaatttgcccttctggaagactccatcagttgctatctggtaaaggaagattgaatatacaaatggacaatgaccagaccatacttaaaaatagaactctggccgggtgcggtggcttgtgcctgtaatcccaacactttgggaggctgaggcaagtggatcacctgaggttgggagtttgagaccagcctgaccagcatggagaaaccctgtttctactgaaaatacaaaattagctaggcatggtagtgcatgcttgtaatcccagctactcgggaggctgaggcagaagaattgtttgaacctgggaagcagaagttgcagtgagctgagatcacgccattgcactccagcctgggcaacaagagtgaaactccgtctgaaaaaaaaaaaaaaaatagaactctgacccacaatctgcaggaatctgcccaccttatctatataacaccccccttatctacaataaccagcctaggaagccagcctgcctgaagtcagacttgcaggaggccagattgctgtctctagtaacaatcaatgaagctgaatagtaacttctgtaataatctgcaaaaaatgaccagaactttatgaataatggacagcttccctaatttttgtccatgcttccaacgtagggccaaccagagaaaggcaaatattcacccctaagtaatcacttaggatgcccccgctcctagtgagccagccacctccagcttcccatgccaacagcctccaatcagcatacacctggagccttcccttcatgccactctaaggctcctccactcctctgcccgcctttgcattgctgccaaaagtgacagtggcagactcccttgctatagaaagctctgaataaatagcctttgcttttctcatttggttggtcttcgtttatttctacagtagagaagcttagaatagagtcagttggtctaacatgagggcctctatggcaggaaatagattgtctaggctggagaattgaatgaggaatcagagtgtgttacaaatggctattgctgagggaagataaagtcacccagagagagctgtcaggcctgaccaagtgagaggaaccagaacaagtattatcctggctgtgagcttgagctatgaactccagtggggtaagtggcaagcgagagactccaggaaccagaccctggaccttgacctgtctattcttccttctgtaagaagacacgtaagtcacatcccttcccctatataccaagaaactatctgggagaggagctgcagagaaaagtagaagtgtgaaaaattggagtgattgggcatttttacttaaagatgtggggtatccattaaaggggctgtttaaatgactgcatcatcagctttgctgttacttccccactaaccagctcacccataaaagcatatcagttatgggaaaaatattaaaaccatattttctctgcatgttgaagttgtagttaagcaaattttgtaattccataagaactgaaactaatgtattttcttgttccttagctaaacaactctgggataaagaataggcttttagttgaacaatgctgagatcaggcaaaaacaactcagctacttgctccagtggatacccgctcctggaaaataagactgtggagctactgaaacagctgacttatcaggactaacgggtcactcatcaaagctcactttcatattctcaccttgtggtgcctaccagtccaaagctattgtgccataaattctgcccaatcccaaccagttccctgcctttgaagacccacctaagaatcacccagcctaggccctaaaaccctaaataatcctcccctgacttctctcttctgagatgctactggattctgtatctagatcaagctgatgttctctcttattgcaataagtctattaaaaacccagctttgcttaaccaacactttttcttttctggtggtctttttggacactccatagccagtgccattatgctttaaattgcatagtctggctatggaatactaggggaaaacagccacaggcaacaagttaagctcatagctacaggaaacagatgaattctttctgagcaaaagtaactacaacccagaagaccaaacgttagaagtgtacatccaggagaagctataaacacctatcctagtaacaaagacataagacatgtagtttctatacacggagtagaccaatcacaccacttttattttcagtgatttcctgtacacacaaagagcatcaattaaatttaagaagaaaacagtatacaaaagaacatataaaatatctacataaatgtatgcacagatatgatgcatagttgggaccatgcaagtccaggggttctttttccataccttgtattaaattcacccagtatttagggaagatgacatggtttgactgtgtccccacccaaatctcatcttgaattacagctcccataacccccaagtgtcatggggggacctcttgggaggtaattgaataatgggagtgggttttcccatgctgttctcatgatagtgaataagtctcatgaaatctgatggttttataaagagcagttcctccacacacactctcttgcctgccaccatgtaagacgtgcctttgctcctctttcaccttccactatgattgtgaggcatccccagccatgtagaactctgagtccattaaacctcattttctttataaattacccaatcttgggtatttcttcatagcagtatgaaaatggactaacacagaagaaaaggaaggaggaagagaaggagaagaaggccctgattttcctaaggctcctgtagaccagattacttcacgctctccttttcagagctctcacatagaaaagctaaaaggacaggcccatggatatggaaaaagctggacaagcacgtacatccagtgatgcctgcttaatatgttcactttgcacaccctcttagcccagtcccttcccatggcccccaggctcatgcttcatgttgtccacataagcatttctattgtgtcttgacaccaagcatcaattcctcagttaccacaatttgcaattctcatccatgtcatcctcaacacataatgctttattccctctccttggctgtcagtgagaacttggagggcacttgcttctatagttaactctcagatgagggttggctgaatcttggaagcggctagaacatttgctcagtgccgcctcagatgagttgtcatctccctgctctgctgtcagttctgattgcaccgccctggtttcttgggctgccgctgcctcatgtcaggccctctgaaagacctcgtcctgcagctggtatctcttgctttctctggacacggtgtctgcccacccgggaggcccagagaaactaaaccctccagcgtgactcagcagaaaagaactgggttgctgttgctggccgacaccatcctgtttctatttttctcctcatacagctgtgactagcccagaaagtcactttctgtccccaaacatctgttctccaaacatctctttgcctgtcagtcctcccaccctatagattttcatatttcatcaccgtagtaccatcttgttacagcaaaactggttgaaaggagtaagattatataagatgggggacaaaaagatttctcataggaaaacaaatatgtaactttaagtgcttaaaagttaaaaacaaaaacaaaaacaaaaaacttttctttagagatggggtcttgctctgttgcccaggctggttttgaactcctgggctcaaatgattctcccaagtaactgcgactataggaatgagccaccacatctggctctaagaaagtttttttgtttgtttgttttttaaagaaaatattgcacttattttgtgtaacttcgtagcactgaaacagttggtggaaattatagaaatg

SEQ ID NO: 2313 - DNA, 1286 bp, Homo sapiens
agaagaggcacgctgactatgatgttgatgacaatggttggcaatatgagagggtcaacatggtggctggagttgacaaagtgggttgttgccagtgattagtgtagtaatgaagctatgtctcctgaacagtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgag

SEQ ID NO: 2314 - DNA, 8860 bp, Homo sapiens
ccgaatgagggtctaggtcgcggcgagcgggttcactccgggttctgggtgtcgggagccagcgtcagggtcctactcccctgctgccgtgataagtcctttggctcgcgggaagtttcgaattgtttcacatccccctccccacggcggggacccaaatccccccgcgtccccaggctgtgggataatgggggcgcccccgggggggtgtcaggaaagtggaaaagtggctctagaggcccttgggtcggggcctcagaggaggctgtccaggcgccacgcctgagccggctcctcctgccctcgcagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcggggtacgtggactccccaatctgcctcttaccgtgtgtatagcccttttattcctctcatttatcataaccagagattgaccctgaccttagctggcctcaaagaatggcggccccagggctccggcttctacaagcaccccaagggcttggacccatgtagggctgtttcccccttggctcccagttgcctcctagtcctcaaactaaaggggagccagacacgcctcaaatccacctcttcagccatctgcctcatcttccactggcttttggtgtccttgccattgaggagggtgggggcctagggtcaccttcaaggccaggccagctggccagtacctggccacctcctcacacttaccccggggcctgtctgcctcctccctggcagaagtctgcccttctttggccacctgggatcagaacagtctctgctgtactgttgatgtgcatcgtgctgtggaatttgggtttacgtcttgctgtcccatgcgcgaagctgcctggctgagcattcatcatgtacgcttgtgaactccagctggggagctgagactggttttcctgactttctagaagtcccgtctcccctttacacaggaagacatacccaagagtgctctgtgaggcccacttccggactggccccttagtggaaaagggaagctgggtctacctggcttgtatctttaatgcatttcttaggttcaagtggcatctttctcctgcttgctgctttggtgtgaggctagtgacatttaagataagcacctgaggaagaagagtctttttagtgtgactttgggcaaggctcttacccttggggtgtacctgtccacctttcatctctgaaatgaagagggtggacaggatcactgcttcccagtccacggaggagcttctggacggtacagatacaggggcacttgccccagaggtcttttccataggtctggggatgggactggaaatctgtgttcctaacgatttctagatcattctgaagtgtagttaggcttgggaagcagtagactgattcaactctaacattctgggaacctggttggtcttctttcctctttctgttctcgtgggaagtcactatttcaaggtggaactgaaggccccacaattttcctctgcttggtaggatacatgatgactcttgacttttccgcctggggcagagacctggaggtctgtgttttagtcatggttctcccccgatgtgacctttggcaagtcccttctcttccttgggcctcagtttctgtatctgtaaagggagaacgtacaccggctcatctctttgggcactcctgactcctaccaggaatgctgggaggctggaatcacagaatgacacttatggacaccggcccttccatcacactgtcaggacccgtgatggttgcagagtcctttgatgaaggcagcacagtgggtttgtccttctgggctgagcccatagggacacttctcagtgctgcttgggcaggtgggggatgcaagcattggcctggtttgaatcctggcctactgtgtggaatgggcagagaggagtcttgaaactggaacgtgaagaagtgttcagtgctggaaggcagcaccccaagaggggaaatcatgatattttaatgtttaaagtatcatcagagatcatctagcccggggatcgtcaaccttgacactgttgaaatttggggccagatcattctttgccatcctgtgcattgtgggatgttcagcagcatccttggcctgtagccactagatgtcaataacaccctgacaccctgatattcataggaggcaaaatggcccttggttaagaacctctgatctagctcaatgcccttgttttacagagaggggaagtgattatgatgtttaggaggaaagccaggccagaggcccaggtggctgactcgcagcccagggctcttcccctggccctggtgcagccctggagggtggcctgtgtcatctgtctcagtgaccagctctcagcttggtggtggttctgctagtggtagcagggggctgcagggttgggacataccttgtgaattctgttttccgacatttctcctcttccagctcctcaccccatcccctttcaaccatcttcttgaggtttccaggccaactcctcctacccctgcggtggccacagcagggtcccctctcaccctctgcccccctctttggaattaaaatcctcttatgaaaataattttttttaagttttaagaaaggagtaaaactgggggagaagcactgcttggattagctgtatttcccttaagtagtattcaggaagctacaagttaggtcgaggcagctcgaggcagacattggaattcaattaaagccaacgagtggggcctgtgacccccattttcaaggtaattgcttctccagctccaagtgaatgcagccatcgccctgtcattaagcaggcagccgtctaatcgctgcgcctgacagagcctcacaaggcaggaattacggacagccgagtcgtgctcgcactggggagccgtgcttgactgcactcccgcgaaggagtccgctaatctagtcagggcgttctttatctcctcctcgaggagagcagagagcgagcctgcagctgagctgcctctgggaagcaaggtgaagaaggataacggggtgcagagccatgggctgagcaaaagggcaggcatcctggccccagcaggaaagggcaggagagagagggtcccaagaggctcttggcagctttcagtggctacccccactgcactgttggatttgctgctctggaaggagacacagcctggcatcctggtcttggacttagaggagggctttgggcaagtcactttgttcctccaggcctcagtttctccatctgccctaattgtttagtggctctcttgctcattggatttgaaagattctgaggttgtggctcggctcaactcaactcaaagagaaatcagatacctccggcatgggcagggaggtagctggtggcatatttatcatgaggattagagtattcctggggtcttccttcctggtgagaaagggcaggatccaaggtcagggtggcatgtgtgaaaaggggaaggaaagacagacagagggaaccaggctctcaagccaagcctacccactcccctgctggaccacagggaactcaagtgtctaccgagggaagagaagtggaagattgtctctcttctagctggggcctggcaagacttggttacagtagccctgtttctgttacatgcttcttggatccaattaacaggaggggctttagaaggacaagattcctgagcacgaggagggaaatttgacacttggtcagcaacctgcagaaggcagcatctatatttcccaagcagatttaagaccctttgagccgatatatcacccatttctggaaccctcttgttacattgctatatcatggcccaagatctttggactggaaagtggaggaggtctcatctgcttacctactgacaatttggtcttcattcccttggaaattaacagtaggggagatgtcacagagcattgacttgattttttttttaagtgggagggaggagaggaagagggacgttgtagcttgtcacaaaatacacaggatattttgaagccatacctaaggtattcactccaggatgtggatgagctgcattcagttgactgaattttgtgtgaggggaaaggatggccaagagaatgtgccttaggatccgtctttcagccaggcagccatggtggaaggaggtaacgctgagtttgagtctgggctctggttgctgatggcttcatggagctgttcagcctcccgagcctgttcaccatctctgaagtggggatcacaagggttgttgtgagcactaaaagctattaccaaccccagaagctcaatgcgtgtggagctatggtgcccactgagtgatgtgaaagagaaggagcagtcggaggcctggagctgttctcgctgtccttggagggcaggaagtgttcattttacgctgtcaggaccctgtctgactcctctggtgggagcccttggcgggtcttggctctggaaatgcttagacaacttcactacgttcaacccaaatcatgaacctgagaaacgcagcattaaatcacctagcgaaggcctaaggcgtgatgtgcataatccaattacacgtactctgcaagcaagatcttcccttcaacctctcctggaagtgactgcaccttctgagccaggccatgggtgcttatcacttgtgtggagtacatgttcgttgtcctatttgtgctctggcaggaaatgttcaaggagggaaaagtgaacgcccatgcatgggcttggttccaggctcctagcgcctctttggggttagggatgcaagagggaattattgacttcctttcatattgtggatggaggagttcccatattggaaggaatggtataagctggagacaggcggtctctgattgtggaattgattccatttctctgccatggggaaagctacccagttgaaaacagtatcagcctcccactcagacatcactgtgtttgagcacattgtgctctgaagccagcagacgtgttgcaggggataggaatacagcctgaggatagctgtgcccgcctgcctgcagaggtgctgagctgtgatagggacgggggtcaggtggggctttgcccactggcccccacacctgtcagggaaaaatcttcgtttcactctctgttgtacccaagattgttgttagcggaccctccgtctgacaagccctggcatctgctcttgcactgaggaaggagccttggaggttggctctcctgtccctgcttcccagagtctgctggaccggtccttgctgtgccttcaaaccaccccaaggagacctcgagggagtttctggctctttgcagcaggttgctcttgcactcagagatgaggaacgcttcagttttgcatgggagattccttttctcttttgcaaagaggacgctcctacctgacaacactaaggcagaaaaccagcctctcagccttggaagcttaacagctttgaaagccactgtctgccaaacagccgctgctgcctttgttccaagtttctgacgtcggttcactggttcatgttttgggcaagcaggacacctcatgaccccattgatgcttcctgtcccaactaactgttctagctgcgtctaattgggccttggaaggaaggcatggagctgggaggcggttggcacctgtggacaccatttctcagcctcttcatataccttttccaaaattttcactaatttacccacaagacatgtactgagcaaacatgccaggcactgttagaggtgctaggatggagaagacacagtctctgtttctggaactcacaggttgccaagcagtgcacaaaggcaaaagaaacagtgtacacctgggatctgtctgtttgctaagattgagcacctgctccatttttacctgtagtcacacatgtgatcctggcacaacacagagaggtcggctgacttgtccaaggactcatagctgataaaggatagagctggaagtctgccttattctgcctggctccattgtctgtgccgttagagctcttagaacagagaaatccattctgacctgaagtgggagggcattcagaggatatggcctttgaactgggcaaagctgagcctagaaggttgggtaggagaagagacctttcctggtaagataagagtcagggtgcgtggagctattcaactccatcttgccttgggtacaaatgttcagtgcacattttctctagaaacagacttgttcatgaaaggagttagctgtgtctgcaggcagcaaagctacttctttgaagccttctttcccctcctcttctttgtctcttcctcaagggatcttattggctctgcactataaaatgtggattaaataccttgctttcagtccttgctttctgggattttactaaatagttatcaccagcagaattaacgggcctaccaacaatttgtctaaacaaaggggccctactggagactcattttaaaaccaggtatccagataaagttgtattgtccgaccacaccagggaatactaggtagccattaaaaaggacaagaaaatttcttcagaacattcctaaattaaaatcaagctgtatagcagtatggttcacaggagtccatttctgtataaatacatttgaaatgtgtagattttcataaagaaaaacctaggcagatttaacagtagaatcttccgagggtaggattgaagggtaattttaaaaactttttaatgtctacttatttttagtattttcttaaaatgggcatgtattagttttgtaataagatattaaaaattacattttcttaaaaaagaaaaagtggaggagctcagagtaagcgcccatcctagaggagctggagtttcttagctgggaggggttggatctccgcattggactctgtgatgctggctccaggggcccccatagctttgtgtctgccatagtgtctcagtgcagatgtggggtcagaccaccctgggacagtgcccatgaactgcctagcaacagacgtcacagaagtgctctgacagctttgaacaacggccgcagtgccagcctttcacccagaactgacaaagggagccctctggggccaggagtgccatggcttctgtggctgccgttaactttgggatgaggccaggtgggcagtttgcagcttagctgggggagagtagggccctttatccataacctgaaatgcttactgcctcctcctgccagagccatgggccttcactgtgttctgttatctgttcgcggttgccagaaaaccatctcatattgacaggcgagctcccttagtaaggtgtgagatctggaagcttctcagatctattctctatggcactttccaccaacccctcttgctttggggatcttcttaggaatgagcattctttggatgaggggtggtggttgacagatttactagtggtgggatttggccaattactagctacctactccagccccctaagcatctattaaatggccacaacccctcccttgccaggtggttggaaggtgcccaggcattcattcaggcattcagtaaatgttagttttcttctcttgcactagttgagaagaaagatgtgtgcataggtggataccagcatacctaacttctctttcagtagtggagaagaagttgggtggggcgaagggagaggaaagagaagcccaagcccctgaggctagtgttgagtggggaagttgggcctctggagccagggcagcggagtccttgactggggaggagacagggagaattgcattgttgttgataatactgacttgctgcatggcaagtttttagaagggttcagcaatccattttaaactctttgtaaatgttagctactgccatgaggcttagtagctgtgcgccatgagctgctgcaaacattatcttacaataatcctctggggtctgctgctttccccctttacagataaggaaatttgaggctccaggacttgaagtaacctgccccaggccacacagctaggaagtgccagagctgggatttcaatcctgttctgtctagttccaaagcctccactcttccagttaccccgttttccaccactgatgtccggtgacgttagctctcattccactggcccccagctcatctggctctggggcctttgctgtgatgacctgccctgcccctgctctgtaaggcaggcttggagttcctaagaaataaggagccttccccagggtccagcctcagggtggaagatgctggcagctaatgctgaaggcatgtatgcatgagcaaacactgccagggctgtgagcttaaaaatggatccctctctactcagagggaaccccatgactctgcggttttttaaatgcatgcattctttatctcaggcttggaaacaaacattgagaaattatttgtgaaacgggggtgcagggagttggggggtgcttgaagacataaatctttacattacagtctattaacagacttccttcagcgagacattcatgtgaactgagctgggggcaaaggttttgggggtgcttccccctgccacccacccagtgaaggagcaagaggaatgggaagagccactccctccctccctcctgaggtggccacgcctcccctgccctccccaactcagctgtactcaccaccgac

SEQ ID NO: 2315 - DNA, 8523 bp, Homo sapiens
gggaaactactcagcttggagtcacaagacttgggttccagtccagcctctgccccacgctgagctgggagctcacagtccagtctcattctttggagcctgcgttttctcactggaggagggggcttgacaactgtgcaaccgggtgctcttgcaggttctggggtggctcgtgagtgacagcagtactggtatgctggtgagtgcctcagcaggagctccctctgtccccctaccaactccccgatgtctggacggcaccagagcccgcctgggaggccacgagctaacactctcaagaggaaaacagggggatcaaaccaatgacccaagggcctacagctaagaactgctggagccaggctctgaactgagctctgcctgactccagaggtggtttctaccaccaggcaatacaacagggagacacgcaggtgtgtcagagagcagtcctcacagtgcgagcacagaaaccagaggccaaggctgaagattttcctggactcgcggtgctgcccaggaatcttctgagaaaacctgtcagttgcctatttgttggtgtggaactgcctgtgaagtcattctgcaggggtggaaagtgggggccagctctctgtgggcaacagggaccatcccagagacaaagggcagcctcagcccacagaccacttcggacttgaatcaaggcctcaaagggcgagacctgggccactgtcaatgtgagggcagggctgaagccagggatttggaaaattggtggaaaacactcctatgagctggggcttgctctgctgtggaaaactgccagcatcagcacttctcccaaggctgtgccgagtcagcagtcagcccactctggagctgcctctgaggaccaggtgcctacaggaccctgtaaggagcttgaagagttgtggctgacggagggatttctgtcctgggctctaggaattctagactgggcccttcctcaaggagctttcagtctggcggagcagacagacatgggcaaataagcccacaactaactgtgccatcactgcagaaggaagtgccacggaggagcatgagggccagttgcaggaaggagccagggccagcatgtgcctgtaaaagccagatagtaaatagttcacgctctgcaggccacagggtctttgtcccaagcactcaactctgccactgctgcatgaaaacagccacaggcgatatgtcaaccaaagaggggtggttgtgcccatatgaaaacagagggtggatctgtcccacagtttgccacagcctggctgttagacggcctgacctgattgggggtgggggtgatagtggggagaaggcttccccgaggcagtgatatttagctaaaagctgcaggctgaggcaatgatggaggcagaatcacaatatgacaattatgataatcacatcaccatgatcaagttccacctaacacgtgtgttctatgttgcgcactgtgctaataacaacactaccctgtgaaggaggaagattttatgcccactttacagatagagacactgaggcttggcagtatgctgagtagtctgttcacacaattcagctgcattttttgccctgcccacttgccacttctgttcgggggaggctgacccctgagatgcatctcctggaccccttgcccccagctttctattggatttggccaatgaaaggctctggtggcagactgagggctggaggaaagggaggccagggatttttctctgctcgctcctgcttccccctccctgcccacagaccctgcacagccaatcatcctccagaactcagccatccctgggattggtaacacttcttccccatgccctttagcctagggctccaccctccccaggaccctgggccggcccatgggtgcctcgccatgctttattggttctgttcattaaagtctcttcatgtgaaccatctggggtccattctgtcccctgccagggctctgatgctggaggttggctggcttgctggtttctggtctcacatggctaataaacaacagagccaagtagaggtgtgggtggattgtgggaaaggaggctgtacctgaggaggctgggccagggctggctcctagctgcccagctgacttccaggacagtcaggggtcaaaggaggccaggaaatgcagtgcctcctttcctgccccagggaccagtgagtgaccccattcttgaggcccccaattagcacttttagttttctaagcctggctccaggtctgcaacctcctgttcttctccctacccctagcagcgggagccagtgttgctcagcgcagacctgggctgggggctagggctgaggctgaggctgaggctgaggctgaggctgaggcagggccctgggctcttcctcagggaggagatagtggggcagatggtggtgaaatgcagggaccagctgggtcacatagatgcctggaggggaagaggaagcctctgtcgccatcgccctggcaggaagcagcatgcaggcgtgttgaatggctggtgccagggagagccaggctggcagatgagggcttgggctggaggtgaagggtggaggcaccagggaggaggagagccctctgaggctcagtcgtgaggctgcagcaacaggatctcctccacacttgggctagtgtataccaggggcccacccagagctgcagcctggctcttcatccacccatctatccacccacccacccactcacccatccatccctctcctccaaaaaccctacgaaaattgagcatctacaaagggcaggcataatgccaggtgctaaagatccaacaaggaatgagtcgggcccagtgaccagacagagaataatgacaagttgtggtgagtgccataaagaagccaagagctgaaataaaggccaccctgagcccaacaggatgagcaggagcagaccacaaaaacaagggggagaatgtctaaggcttgagcgaggggcctggggaggagaacttcacagaggccttgctactctcaggcagaggtgaggctagggtgtggcctgtggatggacagagccactagggaaaggcagagttggctcacaccaaggcgaacaccatcctgtgcctgaccctgggctctcccacctctccctgctcagtggctccagcatggaatcaggcagcaggaaggggcaccgggagatgggtattccagagctgtctgaaggacagcaagtgtggcatggagacttcttggcatttaaagaagtccagggatgtggctcatcctgtgaaggctattgaactgaagaggctgcaaaggccaaacaggcctcttattcacactaatttggaggggactcggaaggacagaccaccactttcattttgctccagaattctggcactatctcccgatgcaataggctagtctttgctagcattccttctgtagctcttaacaactgctgtctcctacagtcttctgataggaaccctgccctgctccctcctcgtcccccacaggtcagttgtaggtgactgcgcacctaaaaggagcaatgctgaccgagggggaaggtgttctagaatggcagaaatgacaaagtagagacaagaccagcactaggagctttccttctggccacctttgctgggggtcacctgccacatatggaaggcaatggatttggaagactgcaagagatattttaatactgggcttatggaaaccctgtgaaaatcaagcttctgccaggactgtcttgaggtatagacaatagcatttccggagaccccgagaatcaaccagcatgtctctctaagatatcagaggcccccaggggtgctggaggcagggtctggcttgtccaatgcagccaggagaggctggaaaaggcaagcagcccggagtcccccctgggaatcagggcagagccttactgggtggggctcatgagaggctgccacactggccctatgggctctgtggtcctgtgtccagcaggagctgttacagaggttggcctggcaccagagagtggggagagtggcttgagcaggtcaacgggctaggggaggtgtggcaccacgtagcagcttgtagcagccacccccttacaaacagggcacatcagactctgagccgagtgccttccaaatagtattttgtttttgacattccaacgttcctgggaggaaggtttcatcatcccattttataggataaaaaaaaaaaaaaaaaaaaaaaaggaggcccaaaggggttaagtcacttgtccaagactgcagtggcctagaacccagggtggtatgacctagagcgcaaaccagggggaggaagtgctgttgggttccccttgaccccccacgcccccgacctctccctggacagcagtggagatcagctcctgtcgttgagagtcagttggaatatgagtaaaaagtaaccattaaataataacgatgaagcagccaacactgagcacactttcacaatgtcagtgtgagcagagcactttacaggcaggcatgagcttactcaggcatcacaacaacccgagaaggtaagtcgtcatattatcttcattctgtggatgaggccactgaagattacaggtaaagtgacaaagccaggaaacagcggagctcgggcttgactgcaaagcctgggctcaaatcactaggggacagtgtatgtgtgtgtgtttcacaagtctgatgagccacctgcatctggtggcaccagataccctgggcatcctccgcacccctccagggcacataaacccaagcctgggcagcagccccgctaagggtctggagagcctggagaagatgctggggctttctctaccttgtgtgtgctcccaacttggggctctgatcctgcctctcttggggctgttcaggcccaggctctaacactcaggctcttccagggagccccggcacagaggggaaccacagaagtcccgcatgatcaggagcctgggcaggctggtgcaggagggctgtgaacagggatagctgagtctgctaagctgcaaacttgatttgcccttggcctccccggtcaaggccaactctggcagccacaattaggctattaagtgggtttgctcccactcgaggtagctacgatacctgcaagatcttccttggaagagactagtcttggagagctgcttcctggttcgattctgagcgacagtctgaaaacaaagattttcataagatcagatgggctctggtttaccacacaggaacctgtttggggctgggaaaagctactatagtcacagaagccaggaatactgtgagatctgctccagatcacagtcacttccctctgaggtctccgggggtttccacagccaagaaacaatggttaagaaagacaaagtgaaaaggagttgagtgtggcctactctctactgagcacagatgtgttcactctgaaccagtacattttctagatgaggaaactgaggagtggtgaggttaagcagcttccccaaattcataggattagcaagtggcagagtaggggatcaaacccaggaatgtgtgaccctgaaccagagttagttttttctttcttttctttttttttctttctttctttctctttctttctctttctttctttctctctctctctttttctttctttcttttctctctctctctctgtctttctttctttcttttgatggagtcttgctctgtcgccaggctggaatgcagtgattctcctgcctcagcctcccaagtagctggctgggaatacaggcatgcgtccccaaccccagctaatttttgtattcttagtagagacggggttccaccatgttggccaggatggtctcaatctcttgaccttatgatctgcccgcctcggcctccccttttttgagacagagtctcgctctgtcgcccaagctacagtgcagtggcaagatctcgcctcactgcaccctctgcctcccaggttcaagcgattctcatacctcagcctcccaagtaggtgggattacaggcgtgtgccaccatgcctggctaatttttgtatttttagtagaggtggggtttcaccgtgttgcccaggttggtctcgaactcctgagctcaagtgaccagcccgctttggcctcccaaagtgctgggattacaggcatgagccaccgcacgtggcctctcaactggagtgtttaatgattacactgcactccccatgatcagatgcccttagagaggcacaaggcaacggacatgctatgaggactggcccttcaatatatctttttgaagcaccgaataggaacttctgggtgaaaatgacagagtgagactagatgccagactctccctctcctcccaaaaccaacaaaaaattataaaagcttacaagtaaaagaactcaccaggtgcaactaaacaagggaaggggcataatttaaagccatgaacttcaaagaattagagttaaggaaagaaaaagaggattctgaaactggaccaagagttgcatcatggcatggctcctgtcaagcccaatgaggggtctcactgggtctgagtgggggtccttatcgctccctctgctgaatggcaccagctgctaaggaactaggtggagagcacggcagctcctctgatggaaatgaaggctccacggggcatgatgtgaaacctgagggtacctctttctggaatgggatacagctccccaacgaggtgaaggaaactccaacataggccttttgccagaacacacatatgtgaaacagactgcttgcttactgcctccacagagcctgagccttctactcccacaggctacagaagaggagaaagactaaaacccctggacctcccagctagcagtaagggtttcccccctcacacacatgggaggagggccagacatctctcccaccctcggatcacacccatggaacatccagacagagcttctcaaatgggagccagaagaaaagaaatggtatggcaatacagccaacatcctcttgcaaaagaaggaaagagaacaggtgagcattgcccaatggcccaaccgagaaggcagccccaggagcagacgaaatcccctcaagtgcttagagcagtggaacaacttattacaaacacaagtaaaacaaaacccgaaaaatgagatgctaaaacaaaggaatgagaagaaaaaaggagattgaagacctagggggaacaaatccaggactgaaataagagagtgctgaatgaatacctaagtagaaatagacaatcccagttacagctgatgaacaagatggaggttgccgctgttagcaagaagcgaatggctatgacgggcagagagcatccaacacggacggattcctggaatccctggaagagagaagccacgaaatggcacagaagtagtcaaagatataaacaaaaggaattcttctgccatgaagaaagatgacgacaccatggtctggggaaatctggtacagaaccctctactctgaggcattctcttatgaagcttttgaactttaaggaattcttcacctaccaggcagacaggacccttaacaagaggaaaaaaaaaattagatgggctcattctctacagcaacacccaaagcccagaggcaacggcacacggcctgcagtgctgagggagagaaacaaaggagggcagccagcaaggccgggtctagtccaacacagacatttctctgagggaatgcagggcatgcgggccctgtgagcacttttatttttctggtggagcagtaggtagggggtcctacttcctgatgaaacgcagctaaattaagggactgattaaaataaagactccaggaatggaaaaactatggagaaacaacaggtggtaaaaactgaatctgtttaaaaatactaaacagtaagaattatgattcctgaacatgcttatgttatagacttggactatgtggtaataataacacaactaacaaaaagttggaagctggtgaagtggaggttaaggaaggggagagggctaatattctcatctttcataaccagagttggctgacactgttcacaatggaaacctagttaaaataaaacttattgactcaagcctcctaatgtttttcctgatctcttttattattattattttttttgagatggagtctcactgtcacctaggctggagtgcagtggcgcaatctcagctcactgcaacctctgcctcccaggttcaagtgattctcttgcctcagcctcccgagtaggtaggactacaggcgtgcgccaccacgccagactaatttttgtatttttagtagagacggggctcaccatgttggtcaggctgttcttgaactcctgacttcaggtgatccgccctccttggccttccaaagtgctgggcttacaggcgtgaacaggcatgagccactgtgcccggccctcttttattaattttagaaggctcttttggaaaataatctctcttttggtaaataaatatttaaag

SEQ ID NO: 2316 - DNA, 427 bp, Homo sapiens
cttttcagcaaggtgtttggatggtcctgtgcaatgtctttgagggcaagatggtgctatgtggactggacagtagcagcatgtggtgatttgcagctgacccttgaatgcctggacagtggatggcggacaggtgttcatccagagagaaagttccagagaagcagaggactgattaaaacagcagatacgcatcaaaacagggaggaatcagcttgggacagtcaccaggtgggaggaaaggagtccaaggggacagccgagccaagaatctgaaacccaagctgtagagactcaacttgcagataacctgtgagtggttatttttatagcacccattagctgacactcttgaaacactaaggagaacttatcctctcttctcctcttacacgctctaaagtatgtgatcacttttccatcttgc

SEQ ID NO: 2317 - DNA, 3729 bp, Homo sapiens
ccctggggatggctgctgtggacgccagcccagtgcggagaggccagtgtgatctcacccatcatgacctcaaggtccttctttgagggatcttgccaggaagttcagttggcaggatggcagcagcagacacacagggtggttaagaacaacaaacacaggtaacatctgctgaaggcttctacaagctgagcactaacaggcaaaccacttcaatagaacatggctggcggccatatggacatatttgaatccaacaattaattcagcaaagaaagctgcttgtggcaagttttgaatgtgccattccaggtagtgctttgatgataaatgaggagaagattgcaaagaaaatgacagcaacatttataaaaggattcctcttaggactctagatgcacggagagtggccagattaatacagactggcaaaagaagaacttggcaaagtgatttgatcacacacttctcaccctcacatctcctgacagttcccctaatccctgccccacttccccgccatgggcttccatcaggaaactccttgatatcatcttcgagaagaaaactgaggcatagaacatttgggaatgaatctaagactacacatctagaatagcagagttacaggaatgcagatgtgattcctatggatgagggtaacctagaggctagaagaacaataggacagaagaagcctgggtccctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataattctaccttgtgccttgacaacatcaggtattattcatgcccttttctctccctgtaatgtctcttatccacgggtagaaattatattttccatctaaggtttgctcaaatattatctacttaagtagctcttaccaattttgcctctcctcctgagctgaccctatgccttctatgctgttccaggtaatattaatctcttcctttgtacttctttcacagaacatacttttttgtctaacataataactataggcataagtgtatagattccactaggggcttcagaacagaaactatcatcttattaatttttttctccctgatatctagggaaatatgttatatataataggcccttagtaatcccataaatgtttgtgagatattcactgactataagccatactctgtatttatttagctaaaacagacgtctttcatatttagttagcagaaaatgctcacatttactcctttcctgtttaccaaatgaaagggtaattgttttttcacagattgcactagaaaagtgtcttctctctctttttcaaatagattgtctttaaaacatatgacaggaaaagtgactattgttaggataagataattacgattgtaacagctagtttaaaagaagtgtcagttgctcctgttttatttttcacaggatagagctgcggcctgtctcagtatgatgttttcaggatctggtatatatttttattttcctacatgaatctttcatccttttactgacatttattcattttatctaattatcctaaaaggaaagctctggccaggcaaattggttgttgtctgcctctgaagagacattcatatcgcgtcgcttagctttcaagttttgtgatcaggaaccctcaggcccatttttaaggaggtttcaggctagctgagcttcactgtctcccaaaatgtacaaaatgagattacatgagggacaagatcaatttactggaaggtacttaagcagtaaatctggagctttttgtccagtcactattgctttcaagctttgtagcagaaaattaagccacaagagctttgacaaattagatattactacctctaattgtgtatgtttaagcttatcacactgaattgcagcattgtaactgactattatgccaacaaggccttcgtttaatcagcgcagtgccatttaatcgcaattaatcactcaactaaaatgtcatattaaggtcacagaaacttgaagggctaaaagaaaagagaacattaaagtcagctgatggaggaaaagagcatggtgtgccaagggaagttctgagcactctttttcattagaagctggtagaacatttaatgagaattcagtcttaactttcagctgagatcagaacaacgtgcctcacttggttaagcaggagactattctgcccattcttagcgggcttctgtctgtaaataggatactcctgcccacagaatacctgaaattttacagattcatgatttttatttctattattctttggctttctggcattttcccctttcctattacttttaagaaggaaagaaatcagatatgatatggtactgaagacaagatgaaataaatagcatcattttgcacagtcacttacaaggtatttataaaaaggaacaattggattcacttgtttgccaggaagattttatttcccagaaaacttgtcaaatcgaatgttatagtgcaaaaagaaaatgactgaagcttttgttttttaaattttaatactcaagaagtactatgccagtctgaaagatctctgttagcccctcacaggacaaaacttgtgagaagtaatttcacccggaggaccgggactctgccacccatggctcattccttatgctttaaccctgcctagccctaagaaatattgttccactaactgattgactctgaaaacagagccatggtaaagggtatatagacaaagggcacacttaaggtctctctttgttaaggagtagtaggtaattttattttattttgttttattttattttattttatttatttatttatttattatactttaagttctagggtacatgtgcataacgtgcagttctgttacatatgtatacatgtgccatgttggtgtgctgcatccattgactttttcagcaacgtggatggaactggaggccattatgttaagtgaaataagccaagcccagagggacaaatattgcatgttcccactcatatgtgggagcaaaaacagtggatcttagaagacaaaaactagaatggtagttaccagaggccaggaagtgtagggggaaagaagacgaaggagaaaaaagaatataaatgtatttattaccatgaactgtacacttaaaatggtaaagatggtaaattgtatacatgcatctcctcagtaataaatagttttttaaaaaactgactctaatgaccactcttcaaacttgcaataaatagcacagacactggaaacaatgaccacctccaacaggaaaaatgaatttcagttttcatacccactgagcctatgaagcttggtgagcaagatgtctgtgtttgagcaaggctcgctcaaaccgtctcctgcagacctgtgtggaacggtgcagtccactagccacacgaggctactgagcacttgaaatgtgactagtataaattgacatgcactgcaaagatgaaatacacactaaatttcaaagactgactttaaaaaaagaatgtaaactcattaataattttttgttgattacatggtgaaataccaattttggag

SEQ ID NO: 2318 - DNA, 1558 bp, Homo sapiens
atttcccaggcccagacctctgggaaatccctgctccagccctgcagagatttataggaaagtcccaggacgcccatctgcttgcttcctcacattaatttcagggctaggattttgttttctaaaggaattcaactatgatgccaacaaaaatctataggaattgaagagttccgtattttaagtcacatttttaaaatgtttgcttctttgtatattgagacccagtaagaccctagtaagcccagttactccatcacctccaacaatattaatcaagtagaagacacgcggattttaaaagctgtgtgatccttgaaaaatcttcagactgtcaggggtcctgggtgcctccaactgtgaaaggagggttggacaaggcgattccttagatctctctcgggtatctatttctctaattccaaattccaacaggcatccaatgattgctacccacgtccaagctttagactcatagcccgaaaagggcgaagcgcagcgtggtagagatcgcaaaggagacaggaagagaagcaagcatgcacttttagaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 2319 - DNA, 4969 bp, Homo sapiens
cactcttatcacccaggttggagtgcagcggcatgatctcagctcactgcaaccttggcctcccaggttcaagtgatcctcctatctcagctttctgagtagctgggactataggcatgcaccaccacgcctggctaatttttgtatttttttgtagaggtggggtttcaccatgttacctaggctggtttcaaactcttgagctcaagctttggcctcccaaagtgctgggattacacatgtgagccactgcacttagcctatattattaatactattattattgttgacttctttttacaaaacagaaagcttgagtcttaggctgattgcttccctaaggcttagatggcctatggatttgattccaggtagcctatctccacattttgtactcttgaacattttctaatttatttactaattcctcagtcacgtaaatgtcatccatgaaaaatattagagttttggtatctcagagatggttccttagagctctcagccctaaatggaaacacatctttttgatagtgtgttttattttccaaatcccaagaatctgtgaaattagtagtgttcttgaccaacagttagatagcctctgcttgaatgcttctaataactggagagctcaccacttcatggtgacaacatttttcattcttgcataaattcttcctaaatttgagctatcctgaaggtcagtttagctttcctatcgtctaaagtactgtatattgctgtctgaaaacacacagacaactaaatgctccagttgctttttttcccttttggtgacagctttattgagatagaattcatatagtatacagtttactcatttaaagtattttgcatatattcaaagagttgtataatgatcttattttagaacatttttattatacccgaaagaaaccttatacccattagcagttacctattttcgttaaacacctccagccctaagcatctactaattactatcttataaattcgcctattctggacatttcatttaataggtggccttttgtgtctgacttctttcacttagcaaaatattttcaaggttcatctatcttgttgtatcagtactttttttgttgtatttttagtagagactgggtttcaccatgttggtcaggctggtctcgaactcccggcctcaagtgatctgcctgccttggcttcccaaagtgctgggattacaggcgtgagccaccacgcccagccttgttgtatcaatacttcatttattttatggacaaataaaagtccactctatggatataccacattttgtttatactctcatttctttatgggtatttgggtagtttccacttttgactatcatgaatagtgctgatctaaacatttgtttcaaatgctttttttttgtatgaaacactgctctgtctgctcctgcactgtgatgattttttgattaatctcatgtagtattttacttggtaaaatctcatactgttggtattagtctggttccgccttgctggaagtttgaaattttgattctttgattgatcatatgatttgttcatttcaaccttgggtactatgccaattggttaaatctccattctctgtcctcatccatgtcagtgatcagtatactgattgctgagtggtgtggcctctctgccacatagcttattgctgtggaggaaagagagtcttctcttagccattgttctgtgtggagttggcggactaacacatttttatattcatatgcaatattttcaattctaaaaatccttatgtttgtaccagaactaagatgtcctggcattatggaattattcatgtcagttgcctatctctggtcaggtagttagttgtgacatccagcagctcagactacaatttgaattctggctcttgtcccacttattatcagaatgacctttggcaaatgacttgaaggttaacttgggtaattttctcatctggataatgcggatagtagaaggacttaacctcataaggtttttgagaggactgagtgaagcagtccccacaatacaccatcatgtgctgggcatgttggtaagggctggatttcaaggatgaaaacagaggccagagaactttctgtggctttctgaatgtcaaaactgagactgtgcagatcaagcagaacgctttctgttccttccaaggcttgttcccttcaggtttcagtttcagacggaagcgaagttgtttgtgatgccggagcacacacctgcgggaactgtagacttcttaggagtccaccggggttgcgtcgcattgcttccacgcctctgtcctcaccagtgttgccaactgtggatttgtgtgtgtgtgtttatcgttgttggccatgcaccagaaacagagatatcagtcacatttaaactctgctgcccaggaaactcctgcctacaaacccagcccagccctttgagaacctcaccgaccaagatgctgaggaccttggaaattgaggcactgaagctgaagtggcaagggcaagtgtgaattgcatcagatctttttctctcagggtaatttcttcatatcccaggtaaggtagcatttggatttctagtctttatatttattggtggtgagtaattctccccaaaaatggagggggagaaactagtatgcaaatgatgacaaaatagaagaaatctatctcattttgcagtgttcttatcccatcataaaaattagttgatcagataaattgaagttttaacctgattccatttatttcctactagacgcattttggaaatctcagtttgtgttctgaagattttctagctagaaagttttagtggggttagaaatagtgttcctctcaattgcttctgaatgaaagcatactccattggaaggaccatcagcaagggccatacattctaacaagtctcattgtttttcccatgctattcttcagcttcctttttctttggacactgtctcaaccatcccctgggtttggtgatgccagacttccttctggcattatccgcaaccgacaatggactttacttgttacgacaatatcaccagctttcattgcatgcggcagatggcctggaatgcagtttgtcactatcacttcttggaaatgcagaggcctcctggttcttcaaggccactaagcccaggaagggagcaagtgtgagatggcaaagaccccctaaggaacagcatcagatccctttctgggtgtttgttgcagggtggctcacttgctgcttttctccaggataaatggcaattgcttgatgcttgatagggacgtattaaatacaacggctgtctcaggaccctgtctgccttgtttttcatcacctggacgtctgatacatgcaaagtggaggaattactgcaaagagtggaagacaggttaaacaaacattcaccacaactaactgtttaagcttaagtcactaaaacactcattgtgtttttgctctgaaggtccatgaagggatagattcgtccatcctccttctccgtcatcacacatcaaggccaggattgtgccatttatggattccacatcctaagagaaaactgttcactcagatggtttctggtagtgactcctcttctctttgaaatgcccttcaaagtatttagccagaaacaaagctttttggtttttgggcttgtgtcaggcttttgctagagagtgatttttttttttcaaggaaattaatagatgatacagtcaatgctagacaattttagatctcagagctgtcttccttgaaaggtacattactgtttcttttacatctctgagatgagactgctcagagaatgattgattttggggtgaattgctatgtttttacatagacaaaataaaaccacagaatccttcaatagaggaaataaaatatggcacgccatcaatgtggaatattaggcaccctcaagtgtaagtctatgtatatatgacatggaaaaatgtttaagatgtggttgggtgactttaaaacaagttgcagtttgggcacagtgcctcatgcctttagtcccagcactttgagaggctgaagtgggaggattgcttgaacccaggagtttgagaccaccctgggcaacatagagagaccccatctctacaaaaataattagctgggtgtggtggcacatacctgtagtcccatctactctggaggctgatacaagaggatcgcttaagcccaggacataaaggctacagtgagttgtgatcacaccactgcactccagcctgggagacagagggagaccctgtctcaaacaaacaaaaaacaagttgcagaacaatgtgcaaaatggagtgtgatcctatttgtgcttcatatatatgaggatcaggaccatcctaaatatgtatgtatatctctgtgtgtgtctgtgtaattgcttagaaaaatgactaaaatggtatgaatcaaactgtgttccttcaggcaacactagggggaagtggacagagggtgaccattgcgttttgtgtacatctgtgtattgtcctgatctcatacaatgagaaatatttatacactatggataaacaaattttggaaaatatcccagcaacgttagtaatgcaacagtgctttccctggggccaccattttggttctcaccaagaacagatggtagcatcaagtatttcagtaaaattttaatatcataaaaagcatatggggctttcctaaggtctgagaggcacagtataatcatgttaaataaagaggacttacatttaaccttggattcattaacaatttattgctgggaggataaaaaggggatgtttacatcacacacgggtcgaagacaaatacattttcggttgcagagagtatataaggcaagtagaatgaagaatgagtatttcatgatacattttttacttttattaatttttgagtacattccagtgctaagcagtgaatagtat

SEQ ID NO: 2320 - DNA, 11796 bp, Homo sapiens
agcacacagatacaagtatgtgcttgatatgtaaccaaagtaagttaaactccttatttaatcttagcacctgtctaaaggctgggtgactgtatttatagatgaggaaaactgaaaattgggggccaaggggcagtgaagtgaagtgacttgttctatgatacacagctagtaggaatattagcactggaatttgaatttcatgccatcccattccaaccctgggtgtttactacttcccactatctcccaagcatgggtattttaggaaatatagaacattttctcagcaatacagacttatttctctattctcctttccacatactctcttttcccttaacaacaacagagatggagtcttgctatgttgcccaggctagactcaaatgatcttcctatctcagtctcctgagttgctgggactactaggcatgagctaccatgcctggcttcacatcatttattcttaggccactttgatgctttttcattgatgctctttatagacatagtgaagtaaaagtttatctaggatatatggtgggaggtgaggaagacttaggtagagaggttccaaaccagttgttactgcttagctcaatttcagacatacttcctccagccctctctaaactacccaccagtcttcgcccctcttttcttagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagatatgtagcttctcactctctgcctcacgatagggcagggaaggggaaagtcagggtcaagacctagtgagtaggtgttctggtcatgcttcctacattttttttttttttggagatggagtctcactctgtctctcaggctgtaatgcagtggcgcgatcttgactcactgcaacctccgcctcccagtttcaagtgatttttttttttttttttttttgagacggagtctcgctctatatcacccaggctggagtgcagtggtgtgatctcggctcactgcaagctccgcctcccgggttcacgccattctcctgcctcagcctcccgagtagctgggactacaggcgcccgccaccacacccggctaatttttgtatttttagtagagacggggtttcactgtgttagccaggaggtctcgatgtcatgaccttgtgatccatccgcctcggcctcccaaagtgctgggattacaagctttacaggcgtgagccaccgcgcccggctcaagtgattcttgtgtctcagcctcccaagtagctgtgattaaaggcgtatgccaccacacctggctaatttttgtatttttagtggagatggggtttcaccatgttggccagtctggtcttgaactcctgacctccactgatccatgcgcctcggcctcccaaaatgctgggattacaggcgtcagccaccatgcccagcttaatttttttttttttttaattatttgtagagatgggttcttgctatactgccagggctagtctcaaactcctagcctcaagtgatccgcctgcctcagcctcctgaagtgttggggttacaggcatgtgctactgtcctggttaccctgaaaaatttttggccaatccctgtcattgttattccagtgatgcctctggttatatgaggcatatgtggggtgggggaaatatctgacagccccattaccaaaagaaatctttattcttcagcaggtagacaacatctgccagccctggtcctcagggccacactcatatgcactcacccctcagcagcatatcgccccttttctgacatataaatgcaagagacccaggaccctagatctttcttcaaacgcaagtgtctcacacacacttattttacaaatccactagaaatatggactcttatgttctttgtacagccatgcaacagaggcctagcatttgtgctgtgtctgtgggaaaggcagtcagagaccagtggtttccctgctttggggaagatggctcaacagttagtaatcccaggttagattgtcagaacagtctaggccaggactgagggctcagctgccagggctccccaacagaaacctgtaggcaaaaagaaagttggcagcattagtgatgaggctcatcttggtcccatctctccccacgacctagaaactcaccactcccctctggctgacactgcttccttgcgcaccagtctcttcttgtcatccaggggtttggctaaggcccgaatcacctgtggtttgtacggcagcagctgtggagtcagaggatataatcaaccttgctcatccaaggcaactgaaagtaccgcttttttgattctgtacaactaatattctgaggaaagcaaaacatctttagtgattccaagggatgttaagtggcaggatggcctttctgttaccttctgggcccaaggaaaagaatccttgggcccagaattacaagatctgtaccttgtaattcagatctcaattacacaccagggtggccaagcccacctgactaaggcaaaaaggtacttatgtgtctcttgagatgttcccaggccagggaaggacacctgaggtacttaccacaggggtgggcaggcgagtgagagcatgcatgcactgcagtgcggcgatccggacagcctggaacacaaccacaaggaggtgagagcatgcccagggagagatgctggtgcctaagagttgctggggctcaacgcaccatggaagggctagagctgaggttcagaaacttggtgacgagggtgtccacgtgaagactcatgacttggggtgcttccagtagaagaggctgaaggcagctgagggtggagagctgcaccacacagtcagggcaggacagggcctccagcagcaaggaaagaagctaaggggcaatgggcaaggtaggggatggccacatcatgaagatcctggttcttgttccctcccctttctagccccatctggggaagaatagctttgtcctttgcttagaagctctgcctgtgggacttaccgtgggcagctctggcaagagtacaggcttgggcagcctgttaagtacatgagaaagacccttcaagtagtttggcttcacatctgtaaaaaatggaaaggcttaggggagaaattggacttagatatatagcttgagaaatcaattccaatctgtggtgaggctgagacatcagcctacaaacgggtgaaagagcccttcacgctcagaataagcaagatacgcccatgaaaggaagaagtgggacaagaatctagaagtttagtcttctaggcacagaccacaatatagctctaaagaagcaagcgggccctaaattatcttagggaatgtggccaagcaaaggagagatgtgtatatgtggggaccttctttcagactcctcaccttggggagcagcatggaagccctggaccaaagcaggcacattatctgtgaagaaccgctggcggaacatgatccgcacttcggcatggccagcacgagtcagcacatcagtgcagtcagacatgagcagagagaagccatcagctgctgctggacctaattctgggtcactcaggaggcccatgagctggagaaaaaagagcctttgaggtacatcagggaagaagaatcttaagtgccaaagataaggatggggccgggtgtggtggctcatgcctgtaatcctagcactttgggaggccaaggcaggtggactgcttgagtctaggagtctgggcaacatggccaaacccagttcttacaaaaaatacaaacattagttgggtgtggtggggtgcccctgtagtcccagctacttgcgaggctgaagtgggaggatcacttgagcctacggaggttgaggctggagtgagctgtgattgcactactgtactccagcctgggtgacagagtaagaccctgtctccaaaaagaaaaaagaaaagaaaacaaaaaacacacaggggaggatggaagtccttgggaggaataggagcaaccagaaagtttgtttaggtcctgggttcttctgtctccagaaaggacgtacccgggctgtaaggcaggagctgagaggatggtatctgagcactagggcctttgttacctgtaattggagacagagagagcaattggggaatgacactcaaacccgagaaccctgagacatagatgtttatggtttagggtcaaacagggacattttatttaaccagacataattgcctctctggctaaccagactccactccaactccttacccagagaagaagagtgaaggcctgactacgacagggcccagagcccaggccagcctccactttgtccacagctagctgtaggaattcatccagctgctgccctaaaaaggagagaggaaatgctgacataaaggctacacattttccctttagcaatgaaatgcaaatcactttaagtgcagagctccctgagaagctgttagaaagggaaaatatcatttttgcctgtggacaaaatgattggacacctgcataagagcctggtattctcataatacagaggtgctgccatttgaaaagagagggtcatctacttccaataaagaattatccacactagccccactgtagggagtaggacggcagaactagactctttgtgctcccttctcttcttaggtactataaagctctgcccaactgtggtcttgacgcttttcccacgggcagtcccaggacagtgcttgagcagttgaagccctgttaatgttattagcaagctccttttaaaaagagaatgagtactgagctataagatttcatgggtagttgattctgggaggctccttacatagtctgatctcagtacctgcagggtgcttgttgaggagtcctgcaaagcacttggcagcagcggtggaagaaaaggggcagctgtggcagcagctcagttccaaaagctcccgcatgagttggttcagctgagggatttccacctacagaaaacctggccatgtaatggacccagagaacacttgaactccaagagaaccagtacatagtggcagcagggaccgggacggatgagaactaacttctctggtgggggaagtaaaagatcagcttagcctgtggcaaatttcagcccggagtcaccttgtcaaggttaaataacagtacttcccaaatgtgctcacttacatttcgaggcagggagcagacaaaggccataagcagtgcaatcagccgcctctgccctgaggagccatcctataaaggaaggagagcccgatcaagcctgccagcaataagcttgtctgcccctctacccattccagattagccctaaaaaaaaaccagcttgaaggatgtaagttctaagactgttacctggaatggctggaatctgctcgggaagctgttttcaggcagaaaggacacgttgccatccaagaagaggggcacaatgtgtgtcacactctgggcagctaacctgggggcagagtactaggtatgaccaaggagctaggattctaaagcagccctctcctccacagacgtgcttttcaacctagggtttgaattaggatcaccacgtcaatgggacatgccctgatcattcatgcattgaacaaatattaatttggcacatatgtgccagtaatcatttccattcaggttcccatctgggaagtcaaggtatattttaaaatgctctacaggtaattcttaagcacatctgcggctaagaaccactggccctggcttcccaccctcatagtccatggtgctaagagccccttccttttgttttgtcaacaaaacttacaagacgattaactgcaccacatttacatataggtaaaaggacagctgacaaggcagctacctgttgcttcttcctaagaatgctatccttctccctgggttcaagccacatccatgattatacttactcagggctcaggtgggttgtagcagtgccaatgacagacaccatggcagccaacacctcatcctccaatagtacttttctcagaactgagggctccttctctgcaaaacacacacacatgcacacaatcacaagaccatgacgggttcaagaaatgaatgattgggttctgtcagcatcactgactctggggcttgactctagccacgacagcagttcttaatctggtctctggtagtgctatagtcctgagaatcagggcaccagaaacaggagtggtctgacctggggccacagagcgctcctgagaactctgcacagtctttagactaggccaacagtgggaaagagggatagctaagatgaacattcttaacataagaaatagaaatgttgtccctggtgtccctggagatgcaaggaaaaaaaaatagtaatgttggtctctgaaaaaattaaaaacatagatttatcttcatgggtccttattatttatagcaactatcatacactgagtacttcctatgtggcaggtactatacactaacttatttaatccttaccaactaccctgtgaaacagttttttttttttttttttttgagacaggaacaggatctcgctctgtcacccaggctcgagtgcagaggcacaatcatgcctcactgcagccttgaactcctgggctcaggtgatcctcccacctcagcctcttgagcagctgggactataggtgtgcaccactatgtctgactatttgtagaaacagggtcccctgtgttgcccaggctggtctcaaactcctggactcaagtgatcctcccatcttggcctcctgaagtgctgggattacaggtgtgaaccatggcgccagcctagacggtactctttatctccatcttacaagtgaggaaattgaagcgtggaaaggctgaatatcttcacctaagttagcaagtggtagagttgaggataaaacccaaccaggtgggcttgactccagagtccaattctaagtaaactaatcacatagcacttcatggggaaaaggtgtgcattcttttgaatgttgctaacactagtggattttggttcctgccactggtcagggtggcaccctttgctatgaagtgaaatctcactctgaggacaaaggattgaaaataaacctctgatggtacaaaatacagtaccaccaatacccagagggtggtgctgttcaacaccagcagagggcaaagttcccaaaggccaggaaggagaggtggaaagttacctggcatagaggcctgcacagccaaggcaagcaggcaaggtatagctgtctggtggaaataccagcaactctcagggtcctgctgacatttttctgccatctgtctgaggctctgacagacagcaataacgtcactggattgtgcaaccatattccctgttgatgagaaagtgttctctgtaaggtttgcttaaaagcactttcaggtgtttccaattacacagcagatgagaggaacaaagaagagtgactgaagggaccaagagtgccttattaaaaagctgagtcactttattctcctggctgttctttctgatctattcagacttcatagttgagacttgctctgtcccaggctctgcagcagaagcacttgtatatattctctccttatttttcataacaaccttagaagtatcatttccctcactctatagagaaggacatggaggcacaatgaaatacatgatcagtggcttttccagggtcacaggaagtgcaaagtcaggaatcaagcccaagttataatccaagtctagtattcattctactatgtaacagctgctggatcaaccacagtgggcctgaatctacccacagggcaggctgctgtcacttttgcattggagcagtgcttctcaaactcaacagtctacgagttaccagggtacactgtcaaaatgcagattctgatcagtgagggcctgagattctgcacttctaacaagctcccagatgtcacccatgctgctggttaacagaccatcttttgagcaccacggccttagggtgatgcctctcaattcagatcccacatgaaaattacctaggtaatttttttttttttttttggagacagggcttcactcctgttgcccaggtcaggctggagtgcaatggagcgatctcggcttgctccaacctctgcctcccgggctcaaagtgattctcctgccttagcctcccaagtagctgggactacaggtgcatgccactgctcctggctaatttttgtattttttgtagagatgcggtttcgccatgttgcatcggctggttaggtctcaaactcttgagctcaagtgatccatcagccttggcctcccaaagtgctgggattacaggcatgagccaccacacccagcccggcacttttttttttcttttttgagatggagtttcaccctgtttgcccaggtgtgagtgcaatggcatgatcttggctcactgcaacctccgcctcccaggttcaaacgattatcctgcctcagcctcctgagtagctgggattacaggcgcctgccaccatgaccagataatttttagtagagacgggattgcaccatgttggtcaggctggtctcaaactcctgaccttgtgatccacccgcctcagcctcccaaagtgctgggattataggcatgtgccactgcgcccaaccctttttttcttttgagatagagtttcactctattgcccaggctggccaggctggagtacagtggcgcaatctcagctcgctgcaacctccgccttgtgggttcaagagattctcctgcctcagcctccccagtagctgggattacaggcgcatgccaccatgcccagctaattttttgtatttttagtagagactgggtttctccatgttggctaagttggtctcaaattcctgacctcaagtgatctgctggcctcggcctcccaaagtgctgagattacaggcaagagcagcggccctggccgggtactcttaatagtactgttgcctaagtcccatccctcctcagagactgattcagttggacgcaggcatcagtattttttttttcttttaaaagagttgattctgttactcttatgtatagctacagctagaaccactgccttagagactacagctccctattcagcccagtccgttggtggttattcctagtagttacctctgttcacttgccagagatgctgcagcagcagaggcagtgtctccttgacgatgctgggatgtgttgatacagctgacaaggcttgcagacagcacagatgccgggagcattgggtgggctcatctccgttagtcaaatttgactcccctgaaagcaacccatgagacaaaggtttactgtgtgataggaagcacgaaggccccaaagccttgctggaaagggatgggccacagaggattagagacacatacctacacgcagctcctcagcgagcttgggtacgaggtggctgctgaaggccacagggtagagagcagccagggttcctgatgcttccagtgctgccaccctgctggaggcgcagagcagataagcattggctgagcctgggctcacagctctcttgcctacgtctgatattaggcagattcaggagtgtgagctcccaacgcctccttgctaaagagcagaactcaagtacctacaccactgagttggacagggcttcttaaagcctaagaagagagcagtcctacatctctccaactggttagcagccagagtctaacacagagctcacctcccctaaggagagccaagggtcagaagcacagagccctggtcctagcttgatcttttgctgccaatacagaggcagggaacagcttgctctatctcattgctttaaattctcaccaactctgggaatcctccttcaggaagctcagtctgtacaggtgacccactgccagctccaagtcctcataagataggagatctgtagttagaagggaacatgaatctcatctttcttcccctgcagccatcacaacccttctaagctcttattagaaatcccaaatcatccagagttgcagtaagaagaggatagtaaggctgcttttcaccaaggcagtcttacaagaaaaggaccaatattttcctcttctctttcccttaagatgtacctggctgggcacccaagactgtcagtgtacggatgccaacaagctgaagctgggtgctggggtctgttagagccatgaataccagtgagcacagctggtccttgaagccattcagaggcctttgatctagggaagagacagaggccaggttagaaggaagccactgcattccatatccctgactaagctgtgatacacagccaacctggggtagattttttttttgagacaaggcctctgttgcccaggctggagtgcagtggcgtaatctcggatcactgcagcctctgcctcccaggttcaagccattctcctgcctcagcctcccgagtagctggaattacaggcatgtgccaacaggcctggctaatttttgtatttttagtagagacagggtttcaccatattggccaggctggtctcgaactcctaacctcaagttttccgcctgccttagcctaccaaagtgctgggattataggtgtgagccaccatgccccgcctcctggggcagatttaaagagcttaatccattgggtatccagaaagcacactgagaaaaataaacagatctcatccatctcatctgttaagtgttctcttgtgctacaacctcagaataggaccactgttctagactacttttccacagcactctttgccctgctatcctttataggctgaagtgttcaacagtccccagagcactgcaatggaaggcaacctcacctttgtcttcatagctccatttctgctgcagcttcaagaaacccaggagcatttcaaggattgtccgccgctggctgctctgtaacgtttcaaggggtactagagtcaaagaatattttaaaggatttcaatcctgctactctggatatagggaaaattctttctttcttccaagagatgggggttttgctatgccacagccagg

SEQ ID NO: 2321 - DNA, 4598 bp, Homo sapiens
cagcacatttggttgtgtgtgtggcagggtggagatcaggatttctggagctgcttagctgagaggttttggttaagggtctcccaggaggttgccatgaaggtgcaggctggggtcacaggcactggaaggcatggctggagcaagcagaccatttccaagtggctcactctcatagctgccaagttggtgattgctgtttgtagatacatccagttccttccacatcaaccctgccataggctgcttgagtagtctcatgacatggcagctggctcaccccagaataaggaaatgacttactgcaaagaaccactcttccccacgagacttcgagaagacccgctgtcacggactgagttgtgtcctcttaaaattcagatgttggagtccaaacccccagtaactcagagtgtgaacgtatttgaagaggtctttaaagaggtgatgaaggtctttgtctctgacaatttgcctctgtgacgtggatgggactggaagtccatttggagccctgtcttctccacctagggagagagaccccatgagctcgtcaagctccttctgtgactgatcagagatcccaccgtgagtccagctcctggtcccatgctctggatatatcggtccctggcagcgtggtcttatttctacagcctcctttaattgctttatgttcacgggacactgtcttcaggataagattcaactccttagccaaagacgtggcaactgcgggtgaagtatctctgggcaggaaatcaatgcagaaatgcaactggggagagggggcttgggggccagttccagggagattggaactgctgtgttctcatcagcagaagtggcccctgcccacccccatcctaatcccttctcatgtgggagaaggtctgtgagccctctccctaccaggcaggttctatggcaatgtgggcacataccctggggcaggggccgagggacttaactcacttcatgagcgccaatggaggagcgaagggaatgcctgatgaaaacaacattctaccagtatgcactgttttctaacctacagagtgcctctgtgttcactgtcccatttgagaattctaagtagaattctgaacaggctggagcagattgcccaccccaagggacagatgttggctggtactgttggtattcatggaagattccttctgacactccctccttctttgtaattgccatgaactggagcactgggccaatataaatcatccaagggtgaacacgctgcacatggacggctcctctttgtttttgaagggattccatctctattttgccatgtgctccttcaccccactccccacccccgtctttcatttctttctctggaaaagatacttcaactcacaggactgcgatgttgaaacggacacccaagagcatcacagatgggccaggcctggacctctcgggacaacattcctcacgacttttagatagaagagattagagatttgggactggtggcaactggtaacgttttcagtgtttggtaaacagccagggtccggagctctgggaacagcctgatttagctctttgtttaagttttgtgttagaggctcccaagaagctgatgcaggggaaagaaattaacaaccatggctcattcacagccaggcagccaaatggacagctctataagactcaagccgacagcggagagagtgcaaccaaacagccttggcccagctttcagaggagaacgttattcaccccaactgctctgcatctgcctggatgtctgccaagatctgtgagcattacagcgttggtatgctttgggtgaggcctgtggctatggcaacaagttgggagcaacccggtccctgggaatgagaacagtgtctaaaatcaggcaggcgaggggcagggaggagaggtaaaggttggacttgcctgaagatggagccgttttattgttgtgggtaaagctgctaccattaggggctgtttacagagtgggtgcagctcaagctgggagcatgttagactcagcgactacgatcaacctattgacttgttcccatgagacagagtaaattaactgttgcagtactggtcatgtaccaccaacctcctgtgaaccagccctcagtgaaacatttatgtgaaaggccatggtgttcccataagagggtgcatgttctctcccttgactaactcttcagtatgcctcattctcacgcgctggtgtgcaggaaggagtccaacatgccccattgacagtcatgccctgtatgtggaaagtcttcaggtagagcactgggctcaggtttgaagatgtgagttctaatcctagcaaggccattacctcccagtgacctcatgtctcgatttcctcaaccacaaaacaaaggcattggtgagctgacctctaaggcctctccagttctcaccttctgtgtctctacagactggagactagaagattatgggcacttttattgagtcttcattttgtttccatttctttgtagtcatcagctggagttgaggacaagttttaacaatagataggtttctttttgtctctttttaaaaaattttatttaaaataaatgccaagtgtagtggctcatacctgtaatcccagcactttggggaggccaaggtgggaggattgcttttgagtttgagaccagcctgggcaacgtggtgagaccctgtttgtacaaaaaattttaaattagccaggcatggtggcgtgtgcctatagtcctagctactctggaggtagaggcaggaggatcccttgaacctgggaggttgaggccacagtgagctgtgattgtgctattgaactctagcctgggcaacagagcaagaccctgtctcttaaaaaagactattttttaagaacacttttaggttcacagcgaaatttggaggaaacttggcatatgtcatatgccccctgctcccatgcatgcacagcctctaccattagcaatgtccccactcaaatggtacctttgttgtaatcaacaaccctgtactgacacatcatcatcacccaaactccatagttcacattaggtttcactcttggtgtggtgtacattccatgggcttgaacaactgtataatgacattatccaccactgcaggatcatacagagtagtctcactgccctaaaactactctgtgctccacctgtttgtcccttctttcactctaaactcctggcaacaactgacctttttactgcctcgatagctttgccttcttcggaatgtcatgtagttgaaatcatacatcatgaagccttttcagattggcttcatataggtttccttccttccttcctcccaccaccttcctttctttctgtattcctaactcttggatgtattttccccagcatcatgacttgatgggacttttgctaagataggcaatcatagaaagtcataaatctcttgtcagccttattggctcacctccgagatggttccaacactctttaaggcccacttttccaatccacagattccccagcagaagtccaagctgctgagcctcacatcatcttttgcactagtaatctttaccactacttcactgtagcatttgaaaattttcatatgaagccatagttctgtgtctttttttttttttttttttttttggagacggagtcttaacctgttgcccaggctggagtgcagtggcacagtcttagctcactgcaagctccgcctcacgggttcaagtgattcttgcctcagcctcccaagtagctgggattacaggcgcgccaccatgcccagctaaatttgttggcatttttagtagagatggggtttcaccatgttggccaggctggtctcaaactccttacctcaggtgatctgcctgcctcagcctcccaaagtgctgggattaaaggtgtgagccaccgcacctggcctgaagccatagttcttaacctcagttgtgcaatagaattatctggggaatttaaaaattagaaaaaacccatgccctgaagattgtgatctaactggtcttgcgtagcgcctgggcattggtattttttaaatgtttcccaactgatactaatgtggccattctgcaagccacagttgaaaggcttattcaagcatcctgttgctgaatgcatgtcgtccttaccacatgactctggaggttttcttgtattctgatgtggctgccctgttgaggcctgccccttagagtggagattatcccctgcagtaggctgcctggaatatgatccccagtgatccctgcttcctggtattcaggccctggtgtgatccctttcccttgaagcctgggctggattagtgacttgcttctaaccaacagcatatggcaaaaataaatgtttattgttttaaacctctgttttagggtcatttattacacagcaaagataacgaatatactttctgaaagaaggggaggctctttagacaggaacatgttcctgtgggagccacaccttatgttgattttgaagaatggagggtctaataatgtgtccccaggggaagtgataggggggcccagactgcttggggctggaaaggcaggt

SEQ ID NO: 2322 - DNA, 1056 bp, Homo sapiens
agcaagaggacaaacctgggtagggatctctatgatgttttctgcgttgcccgtggacgttcatctttctgatttgttagctgaagatgaggatctggagcaggagctcggagtgccattgttccatgggcagatgtgcagcagagattagcattaggaagacaagcagggccttcagtaggcataaggtgatgaggttcatgccgttggatcccacgggtgccctggggaagagatggttgggaagtctgagaggaagcaggagagctttcggagcacatggatgccgtccagaatggagatggttgtggctcggaagaaaaagaaatcacccagctcggagtcaggatacatttggaggtccaggccgccgagtttgctggtggggaagataggcaccagaaaggaaagaggacatccagggcaatttcttctgccccccagccaatccgtacattgtccagagggtcttgctctgtcatccaggctggcgcgatctcggctcactttgacctctgcctcctgggttcaagcgattctcctgtcacagcctcctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctgggattacaggcgtgagccactgcaaccagctggaacaatcttgatattagggtgaacaagtgatttcatagctttctctgaaggaggaaacactgggagcatccacccgagaatcaacactgtggatcattctggggagttaatagttttgagatgtgtcccaagataattgttagcttgaattaccacgtggatggaaccatgctgatcctaagagccaggccaagcctactgctgttagaaaacatatttagaaatcacttggttcttccttgcctgaacatcatctatttagttagcttgtgttgtttagatgtgcttcagatctcaaaaaaataaattatgttatttgaaag

SEQ ID NO: 2323 - DNA, 2382 bp, Homo sapiens
gtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacaggttagcccttcctcagaggggagaggagagggcacaggctagcccttccctacacaggagaggagagggcataggttagcccttccccacaggggagaggagagggcacaggttagccccccacctcgtccacatacatggaaagagcggagtccggcttagcacagagactcacaggaaagaagagcccaggttaacccctccttgtgtagaaaaagccaagaatgcccaggttagccccttaccacagagatagaagagaagagcaaaagttaggccaggacagccacaaggaaaaggacagagctcaggttaaccctcctcaccaaggaaaaatcaggctacactttctttctctaccctcttctgaaaagaaatgaagcccggttaaccctctccacacccaaaagaaaagggaagaggcccgctaagcctggagagccacacacaggcaaagaaaagagcctggctaatctttctctcaggcaaacaaagcaggagggcttgggttaactaccctcacccccaggcagatggaaagaggagagcccaggaatagcccttctccactgaggggttgacaagggcgggtgtgagccgggaaagcaggggtctcacatgccttctccccaccatgtctgggtctagcacagggcctggcacacacctcgagcgctctataaacaccgactgaatggaggggtcagcttccatgcaggatatgggagacaagcccctcccaaagcacacacacaaaacacacacgatcatggggacggggagaggagctggttagtccctccctgctgacctcccccaggccccttatccctctgccctgcctccctgttgtctcagcctcactgggtttcccatcaccccatcgctaggtggcctggcccttaccggcaccgtggccccatttaagccagggatcccctgaatgccaccaatgttcctctgggttaactcctgaactgctgagcccagagggcaccaagcaaaggactgtaggtgcccaaggaggaaaagatggaggctggcaaggcagatggggacctccgagggtaggggtgtcttccaggaatagcaacaacagtaaaaagagcaaattgctggccaggtgcagtggctcacgcctgtaatcccagcactttgggaggccgaggcaggtggatcacctgaggttaggcgttcaagaccagcctgaccaacatggtgaaaccccgtctctactaaaaatacaaaattacctgggcatggtggcaggcgcctgtaatcccagctactccggaggctgaggcaggagaatcacttgaacccgggaggcagaggttgcagtgagtcaggattgtgccattgcactccaacctgggtgacagaatgagactccatctcaaaaaaagtgagtgagttccttcctaagccagccactaggtgctttatgtaattatctcatttaattctcgaaacaacactatgatggaaggactattaccatttccatgttactgaggaaaccgaggcacagagggtttaaggaactagcgcaaggtcacagagcacccagcagtagatctctgcccctccgcagctgactccaggcccagccagagtatttgaggactcaggggtccttctctgctcggtggatggagcccccacttcctccctgggctcagcagcagcaacatgggcttttacaaacacggccgcaagaggaggcattgttgtggagcagggctgggctcaagacccagctctgccacacacctgctgggctggtggcattgggccagtcgcctctctgagccctatttcccccactgcagcagcatggggaccaccgcactggccctgggggctgagatgggagtgagagtgctgggcacagagggctgctaggtgggagcgcctgggaagagtacacaactcaggggttgctgagagaagagaaggcacagctgtcccagccccagttctcctgacaagcttctgtctttctggaagcccctaacccaatccctgagctgagcaggtggagaggaccccaaggaagacagaaggacaaggtcagacagacagagacaaggaggtgggttgacacatagacacagataaagaaatgaagacaccatgcct

SEQ ID NO: 2324 - DNA, 7227 bp, Homo sapiens
tgctattttaagtctactgtcttttcagatgaagcacagctttactattcttggtattagggtagtgtagtgtgtcaagtagatttgtccatatccgacattcaaaagatatgtccacagcctaatccgcagaacctgtaagtgtgaccttatttggaagaaagatctttgcagaagtaattaaattaagaatatcaagatgagattgtcctggattatctagatggaccttaaatccagtgataagtgtccttataagaggcacacagaagacagaactacagacagaagaggagaagtgaagacagaggcagagattagagttatgtggctgcaagtcaagggtcatctggatccacaagaaggtggaagaagaaagaaagtattctccttgaaatctttggagggagggtgctctttgatgtaacgccaaatggatctacaaaggatgtggagcagtatgtgtgatccttttattcattgaaaaggaaagggcagcacgaggtaaatgttggttgccattagcttgtaagctttatcccaggaaaagtttagggcagcatgaattatcataggatgtgcccttttttggattatctattgctaccatttacctaaaacactctccaaccagcatggttacctttttctttgtaatattttaaaattcaattgcatttaggacattttctcatcttttctaccatatctctttttctgtatgccttcctaaagtttataaagttagaggacaaaaataaaaagttgtcataaggggccatttttcaatatttgctgtgagtggaattatttaatatacgatggtgagaaaccatcgtatattaaaataaacatttagggcatgtatcttggctagaatatttgaataatgttctgtactgacaatgttcaataaatattatcactcagaaaataaaagcagcaaaaatttggtggtacagttttaatgtttaaatttagaagaaaatatcgaaggccagaaatcatctaatatctgcttccctatcaataagaaccaatgtaaactaaatattgcaatcttgttataaaaatgtggtttcctttactgactattgagggaacacattatggcaagcaatcttaatttaaaaagtcaaaatttgaaaacagcagtaatgccaatttcacattgcatttgaaggataaatatcaaaccctgtcgataaatttgtgcttagaaaaactgtttttgcaggttttctcttctaaaagatctacccttatcatttaaaaataggagcgcagtcttatctttcagtcctgcctttccagtgccctctactgggcactatagttgataaatatgtgtatctactcctccaggttcgcctctgattttatttctaaatcatagaataaaggggagggctgaaagaaatttgagaattccatccctgctttctactagggtcataaccaagccacctgagagatatgaaatctcttctgtttttcaagattgttaaaaaagaaaagtgactcaaacctattttgcttggtattttcacccaactggcctataccttagctgccttagtgagtgtttaggatgacttaaattactgcacctgccacaggtgccttctgggtgctgtaatatataacactgccttttattctttaaacacaaaagatgtggctttcattcttggctgatggaagtgatcagtacaacataaaaattgcaagtgagtttatctctgtttctttgctagctgtagtaatgggtgcatatgcactatagagatgacattatttctatctgttttaaatattttttcttagtaaatgtctataaaagaatacattcacaagcaagtaaccatggaggccttctaatgaaatttattttgctgcattttagtgaaaaggacaaaatatcctgtattattagactggaattcagtataaaatatccattaataattagcatttgtgcataatacaggctttgttagttttggtgtgtgcaattaatctgtaaaatatttttagcaagatttaaaacaaaataatgcaaaagccctggataaagagactctactagcttttcctcttattttttccctcctttggttatcaattttctaattgaaaaattatagaggatgacatttagtacatttaagagctattttgactgagtttttactccctgaatgttaaacacatatgaatatttacaacatatcagagcatggcacacctattctttcctttctgttttggaaatttgcttaggctgctcagctgtcccttctctatggccacataatagaaacatcattacctccagcaaccttccagtgggttagtagcataacattcctgatggatagaacatgtttctggtttttgaagttactcgaatgtttctaacagttgcagctaatcaactgctgcactgattaattaaaaagtgccccagcagtcattataaaatatcaatatacagtagctaaaatagtcttaaagaggccaataaggattattccatatttctgtagtcatattttgattgaaagtgtatagaatgtttgtatatattataaatactattgttctgtgtagctatttttgacaaataaatattctattgcaaaatgaaaataacccagaggaaaagtacaaggactttaattttaacttaaaaaaaaatcaaaccttcttcaaagctaacagaagaccgacatgctgatcatatctttcagaatctcttgaagtgtaaatttagtcagagtgccaaacatagaaagttgatctcaaccaaatcttcaaatggacaaaacattctcttggactcagcaaggactgagccagctgccagttgatatgtgggcagagagaagttaagtgcctgattctgggggcattcagcctctatgcttcaaggtagcatagtctcaacatcagattctgcattagagctttgaatatatgttaggagaaaaaaaaacctgttcaatttcggaaattactctagcttgcaatatttttgaccatctagttatgttcatacattttgtgataatatatgggaatatgtattaagctggaacctttgtcacccaactactgggtccagaattgtaatttttaacaattttgttgcattaggctaccaaccactgtttactaactgcatgtggaactaaaaattgctgatgaaagctttgtaatataatggaaaaggtgttggattggaaatcaagagagctatttttttttctattgctttcactacatgttacagtggccttggagcaaggtgtcttgttttactttttaaataacactttttacaaatactgacttctgcagggtggagtggctcatgcctgtaatcctagcactttgggaggctgaggcgggcagatcacttgaagcccggagtttgagaccagcctggccaacatggtgaaacgctgtctctactaaagatacaaaaattagctgggtgtggtgggggggcacctgtaatcccagctacttgggaggctgtggcagaagaattgcttgaatctgggaggtgaaggttgcagtgagcccagatcgcaccattgcactccagcctaagcaaaaaaacccaaatcaaaccaaaccaaaccaaacaaaaaaacctgactttttttttttttatctatcataagtattggttgaactaaggagattaggtcttctgcagctataaattttcataagccagacttgtgtaccaaaacactttatcaacatctctgcctagaaatcctaacagatttcaaggataacatgctaacatgttcaaaaacaaagttctgactttcctctacactcttctcagtcttcttaatttcagaaaatagtaattatttagattccaaatcctgaagtctttttaagtttcctttattctttataccccacatccaatttatcagcaaaatctgttggctctaccttcaaaatgatgccaatagtggccacttctctttgtctccagtatttatgctctggtccatccattatctttagactttactatttccatagtatactggtatggttgaattgcattcttccaaaaagatatatggaagccccaatccctagtgtctcagaatgtgaccttatttagaaattttgcctttgcagtcaaattaggatgaggtcctttgggtaggctctaatccagtatgactggtgtccttataaaaagggaaactttggatgcagagacagaagagcacacagagagaatgccatgagaagatgaaaatagaaatcagagtgatgcatctatgcctaagattgtctgcaaaccaccagaaagctaggcgagaggcatagaagagagtctccctcagagctgtcagaaggatccgactctgccaacaccttggtctcagacatctagcctccaggagtttgcaacaacaaatttctcttgtttaagccactcagactgtggtacgttgaagaaaactagtgcatatgttaagtggtctttctgctttccactcctccactatggcctattccccacacagcagttggaaacatatatatacacacatatacatatatatgtgtgtatatatataaaataaaggactgcattctctcctttttattctcccagtgggaaagaagaactgtcattaatggcaagtggcagttgaagcaacaccaagagctggcttcacatttaggaaagaatgctgtgccttctcgtcctcgtcgtggtttctggtgctctacacattcagagaaacttctcttgtaacaaactatagaaatgattcctgaaagtatagcctttagaaacaagtattttttaaagtaccagtaaaattgtattgcctctttattaaaaatcctcccatagttccccatgtgcacctgatctacaattctattctttctaccatttcttctatgacctgtcccctaaaatcagtctgctccaaccagagttcctggcatataataagtgcctaattagtatttgtgaactgatagaataattaaattttaaatcagcaaaactatttttgaagtttttttaaaagattaataatggagagaataagaccaagtgcataagtgttgattaaaccgaaatgaccttgcaaaatttcattcattcattcaacacacctcgttaatacatgctgttagccaagtgctgttctaggcacttgactttcaaatgtggagaggctgtagctcctatacatctggcataggtgaaggagcaactacaatacatgaaggtaaatcttaccatagaggtgagaacaaagttctatggtaccacaaatgagggagcaattacttctgtccaaagcagttatggggggtttcctaaaaaaggagacagttaagccaggcaatcaggcaatcttagaagtttggtggtggtggtaggagtgttaatggataggtgacacataggaaggtgaacatttcaaggtgctgacatagcatgtgcaaacacatggcagaatcatgcatctagaaaaggtgccatttgttaggcaaagctgtgtgtccctggctcactatttcactgctcagcagccaaccagctgcagaatcctataggaacactggaatctccgatcttagaaataggaaatcataggcgccttctgcatttaagaaaatccctgactctctttatttaaatgttccacaagccaataaaacaaaaagccaacaaagtgggagtggactctaactctgtcttcactttagcagcagagcggtatatccagctggatcctgctgctagatgattctatgtgactgaatcctagccccctctcccagcaggagacaaccaggaatggagtctggcctcatcatgagagatctgatatattttcatatttcagtgttttttcttctatttgtgtaaccctaaatgttttacaacattaatattttgttgccccatttcttatgctgcaagcacatgaggcagacatgcaaagagaacccacgtcttttgatggtctgtttactaccccttgtgaggtttggggttttaaaatatcaatttcttgccgatatttcatgtaatgctaactgtcacaactgctctgtctagcccagcaaaattggctttaatatgctaaagaaattagagaattgtattgcttctgggttctaatcctagctctataattaatcattgtatgtcataaaccaaggcatttaacctttctattagtacccacatctatctgacaaccagcttggactgtaacagttgctaagatttattattccctgatcctaggaagaaaaaaaaagtgaattggaaacagcttacaatcaccatcagtagttacttgaaagacattgagatttcttttttgtttgttttgttagtttgttttcaatattgacttttcagatgtgtgaatcctcatgcttccttgatccatgtgtctataacttagcaaccaagcagttatggtttgaatgctgaatttaaagaatttattatttttcatatagagttaatggtgtgtgtgtgtgtgtgtgtgtgtgtgtgtgtgtgtgtgtgtgtgttgtatttatccacctaatcttctcaggcaggggttatttaaattcctagaggctgctttacaaaaactcagagtaggtttgctctttcatcgtaactactacgagctatgtggtgtgagcatgacttaaatgggtagttggttttcatttcacatcattgctacatttatttgcttttatagatcttagaaagtattaataaaaaatccgttgtgcatgaaacaccattttttttctgtgcctgaaatgatacgtaatattgactaaacaacccacttttatttccttgacggaatcttgtgcctgtggatcccattttgatcccaaaaagtcttacatcacaaatgctggagcaaatgttagttccctcgtaatatactactgcttcacttccctgtggtacatatagctacattcaaggtttagcataacttaggaaatatttctatgggaagtatgcacaacagatcttcctagcaaaatagaagctattttaagagagagatattaaatagatcaggaaaaagtagggtaaaagaatatgtgtagaaagtcaatttttttaaaaaaagacattcttattaatttttttggtgttaccatctgtcataatgtatatagtag

SEQ ID NO: 2325 - DNA, 4377 bp, Homo sapiens
catgcacactgtgtccttgaccaccagcctcagaagcaggccatgcccagccagcagccagcctgcctgtcctcttcagccatgcatcaaatatttagtgggtgcctgctgtgtgtcaggcactgttccaggccctggctgtgggagccaggcagcagacccctcccctggaggatctgcaactctggcggagatgacacgtgtcacagcacgatggtcatatcagtgctggggagggacggaattcctaggatgcttgctagagggtcacagggttggggcactcctcaaccacggggctgaggcactccaagtgcagaggcttggaagagccacagtggatccaggccctgatgcctgagaaggagccagctaggcagagccggggaggagcactccagacagacagcaatgaaccatccaaaaatgaagtgaagaagacaatctcatttataatattggcaaaaagaacatacctagaaataaatgcaacaaaagatgcataaaacttgtgtactgaaaaatacaaaatatttttgaaaggaatcaaagagtatcgaattaaatggaaagatatcctgcagtcatggatcaggagacataatgttaagatggccaaactcccgaattcatctatagcttcacaatctctatcaaaatcccatctgtctttttacaagctgatcctcaaattcataaggaaatacaagggtttcagaatagccaaaacaatctagaaagagaagagcaaaaccggagggctcacatttcctgattcaaacttactgcaaagctacagtaatcaagacaatgtggtactggcataaggatagacctacagatcaatgcagtaaagttgagactccaagaacaaatccttgcatttatggtcaattgatttttttaaagactgttcaagtgcagcagtgagaaggcgggaaagagtagaacgaggtgttccatctgtaactgactgtgaacaatcaattgagataactcactaccttcagaccggccatcagttgatttttgacaagggtaccaagacaattcaatgggggaaggaatagtcttttcagaaaatggtgctgggacaactagatatccatgtgcaaaagaatgaagttggacccctacctcatgctgtgcacaaaaattaactcaaaatggatcgtagacctaaatgtaagcactaaaattatgatatccttaggaaggccaggcgcagtggctcacacctgtaatcccagcagtttgggaggccgaggcgagtggatcacctgagatcaggagtttgagtccagcctggccaacatggtgaaaccatgtctctgctaaaaacacaaaaattagctgggcatggtggtgggcgcctgtaatcccagctactcgggaggctgaggcagaagaatcgcttgaacccaggaggcaggggttgcagtgagctgagattgtgccgttgcactccagctttggcgacagagagagactttgtctcaaaaaaaagaaaaaaaaagaaaagaaaaaataaaatccttaggaaagaacataggaataaatcttggtgaccttgtgttaaacaatggtttttaatatacactaccaaaagcacaggcaacaaaagaaaaaatagataaattggacttggccaaagctaaaaacatttgtgcgtgaaaagacaccatcaaggaagtggaaagacaacccaagaaatgacagcaaacatttgtgaatcatctatttgataagggactagtatctaaacatgtaaagaactctaacttatcaacaagaagacaaaccacctacctttaatgatgggcaaaggattagaatagagcttgctccaaagaagatgtacatatgaccgataagctcatgaaaagatgtccccatcattagtcatcagggaaatgcaaatcaaaacacagcgagataccacgatgcacccatcaagatggctataaataaaagagacagacaataacaagtgttggcagaggtatggagaaattggaaccctccttcattgctggtgggaatgcaaaatagtgcagccacttcggaaaacagactggccgtttctcaaaatgctaaatatagagtttccataaaaatcagcaattccagtcctagatatacgtgtgtgtgtgtgtgtgtgtgtgtgtgtgtgtgtgtgtgtgtgtgtatccaagagaaatgaaagcatatgtctgtataacaatatgcacatgcatgttcatagcagtactggtttgttttgttttgttttgttttgttttttgagacagagtcttggtctgttgcccaggctggagtgcagtggcgcgatcttggctcactgcaacctctgccccccggattcaagagattcccctgcctcagcctcctgagtagctgagattacaggcacgcatgaccgtgtctggctaattgttgtatttttattagagatgggggtttcaccatgttggccaggctggtctcaaactcttggcctcaagtgatccgcctgcctcatcctcccaaagtgctaggattacaggcatgagcaactgcacgcagccagcactagttttaatagctaaaaagtgggaacaattcaaatgttcatcaatgaataaataaataaacaaaatatcggtctatccatacagtggaatattattcagccataaaaatgaatgaagtaccgatacgagctacaacatggatgaactttgagggtatgatgctgagggaaagaagccaaacccaaaagaccattgtgataccatttttttcaagtgtttagaatgggcaaattaatggaaagtagattggtgagtggctgcctggggcttcgtggactgggtggggagtggctgctaacaggtgcctacggggttctgtctttgggatgttgaaaatgttctaaaagtaggcagtggtgatggttgcacaattctgagactactctaaagtcacaccaactaagtctacagtttatgctaagttttatgtcataagaattttatctcaataaaggtataaaagaccttccaaaggccaggtgcagtggctcacgcctgtaatcccagcactttgggaggccgagatggccagatcatgaggtcaggagatcaagaccatcatggctaacatggtgaaaccccgtctctactaaaaatacaaaaaaatcagcctggcacggtggcgggtgcctgtagtcccagctactcgggaggctgagacaggagaatggcttgaacccaggaggcggagcttgcagtgagccgagatcgcgccactgcactccagcctgggggacagagcgaggctccatctcataacaaaaaacaaacaatcttccaaaataccaataaaaccaaccaacagagaaggcttcagatgtgtgttgctggaggcagtgggctggggaggctgaggctctgggctggggaggctggaggcggccacccttcgtcagggacatatttgccttcctccagttggtcttgagttgggggcaaaaataggtgaactggcagccgttagccgtggcctgagtctgtggcgtgattgctacagaggtgtggtttggcttccaggcttctcaggggtcagagttctactgacatacgtgatccggccgctgcccgctggcatggttagtctttcctccttgtgtagaaagccaggataaaaactgccctatgtccagcattgacaggcagggctgagtgccatctggggcctggggcacatgtgtagctatcttctccaggggctcctggctggcactattcttgcccagggggccctgcccttgtagggctcccagtgtagagggggaaaacatgaaatagttggacacgtcagtcaattcaagaatttggggtagtgaccccagctacagagaaaccaagaggtaatgggaaaaggaatgatttggggcctagcagtcaggaccaagcacgccgggcagggacagtgctctgagacctttgcctgacacttgggggatgagggggcccttccaggccccgggtatagcaaaggcccaaggccagagagtgttggaggggaccctggggcgaggcggggctgggagcctccgttactgcgcgggtgctcagaggtgtggagccctggggagcagggcacgcagggcccgagttgtgctttcaaacctctctggtcgaagggcaagaacagaccttggggccagatgggaaacagggagaccagtgattgcttcctgcaggggccaggccagagctgacagcagctgggagtggaggcagagatggcggagaggtcccaagaaaagggccctctctgctttcaggacagaaatagttcccccttgtgaggtttgcagggggatgcaaggct

SEQ ID NO: 2326 - DNA, 542 bp, Homo sapiens
ccatgacagtccttcaagagaggttctgctgtctgagagattatgtgacacgcctaaggtcacaggatcagcaaatactagggctgagatttaaacccagaactgtctactgccaaagcttttgcgctctccctcgtgccacgttgcttctcattttgggcttggtctccacttcccagtccttgaaggagttctccaggtctgccccattagcactgcatctcagaaggaagctgcagctgcgccgccaatctcccggtggtaggtgcttaataaacattatgaagtgcatgaacaaatgaatagcccctgatggacagacatgcttgagaaacactatttttcacattcctatctacactcaagattttacctatgatagcaggctgaagattcccaggatcttacatcctagcaggcaatgcctctgcatcctcatcagcgaaaccggattgatcttgcctgcttccctggctttgatggatgcaacagaagaatatatgcagaagtccctaatgcagtgcctgatgcatgataaatgc

SEQ ID NO: 2327 - DNA, 14642 bp, Homo sapiens
ttttgcggtttgggagggaggctgcgaggaggggcgcggtgcccgccgccgccaccgcagcaccgcacagcgtctctcctgggggtgcgacctacgccggggacccagcgctcgggcaccggaggccggcctcgcaccggtgcggaggccggctctcgcgagaaagcataaaggatgttattggcagaaagataaaaatttcagtgaagaagaaagtaaagttggaagttaagggagacaaagttgaaaacaaagtgctggtaagtattgctgtttatttttattaaatgtttggaaatgaaagtgtgttttcattgtttagattgcttaattttcatgcagcattacttctgtgttttatatattgttcaaaagttctgatgaccattttgtcttaggttaattggaatatttctttgtcaaaagttaaaaatagggtaatttgaattttaaagatcaaaggcttttagattgtatttctcaaagttgtaattgctgcctatatttaggtaatctcttagagcctgttttcataatattcagagtttgatgttaaatggaacttttttatttggtgtgtggtgggtgatcctatgactttattcataaagtcttatggaggagtttaaaaagttcatctcatgttggtttaattacttaattagattttctcagatgttatatatgagtccatctaaggggtgatgagctaacaaaacattgtcattttacttagggtgttggtgctttggagggaaactcctgctgaaggcagtatctgctagtgttgcgactggacttggggttccttctagtttgtgagaggagatgctgagggattgggccctgctgcagaaaacttcttagagaggtgtcagtgacagagttgtacctttagagaggtgaaaacattttgtgatattttaatggtttctaggttgagattgtggcaaatctaaatttaagcttaggtggaaagaatattttgatggagagaatactgtttaactttttatcatggatattttcaaacatatgcaaaaagcagataatagtatatcgaactctgtgtacctgtccttcccagcttcaaccattttcagcattgtactaatattaaatatcttccccatggtgtttgtttgttgttgctgttttttttttcctctggagaattttaaaacaaatcccaggtatgttattgaaagagtataatttcttaattttttaaagtctttttgagacaggatttcagtctgttgcccaggctggagtgcaatggtgtgatcttggctcattgtagcctcaacctcccaggctcaagcgatcctcccacctcagcctcctgagtagctgggactacaggtgtgagccatcatgcccagctaattttgtttattttttgtagagacagggtctccctgtattcccgaggctggtctcaaactcctggactcaagcgatctgcctgcctcggcctcccgaagtgctgggattacaggcatgagccactgtgcgtggcctgaaaaagaatatttttaatattccattgcttcagttaaagttgccaaagaatttgaagtgtctttctgatcacatctgtcttgagaatcttctaaaatatctaactccaggatatgtgattgtcttttcttgttagtaaggattatgcttgtgatggatgacttctgtttctatgttgtctatatatacaagtcgggatggtaaaggcattgaatgggaaaacttgaatggcttttgcccagcaacaaaatgtgcttatgtaaactgcatgattaagttatcagtagaagaaatgattggtgccattgttctgttgtatttaacttcagtaaaggtgagatttccttaagttatgtttttcttgatgttgttcaacaatgattgtgctattttttggaagtggtagtgtagagaagaaatattgtttctgtcatttgcttttttacaaatttaaagtaagtttttaataatgtagtaactttataagatgaatcaacttctctacaacttaaatataaggtagtggttgctatgacagtctaaaaaattggggcttggtattatttgatatggaaattattattatgctaagaacaaacccacatcatgagtgcaatttaccatgttaaaatttcaaagacaaatttaaatgtccagtataaaattagcactatttaaacatgcttatgattagtacttaattgtaagtttttttggcctcatctaacagctggaattgattaaagttgtaaccaaattaaaaatgtatttgagtttaagcatttatctccccaaatatggaatctaagcagtttctagaagcatggccggaactcattgtggctgttacttacttgcatgggcaggaattattaatagaaatactcaaggtctggctttctttgacaggcttcaagttagaacaagaagatgtatgaagtaacctcaaagttgtggatttctgagtttctgagtttagagaaatttaattgcttaatccattgttagcctactaaaatggttcataaatgagttggctgaatatctacagtacgctttttgagttgtgcttttgttacttcccccattgcccaccattcactccttttcttcttataaaagtaggagtgtgctgtattttacgtggttctttcttcttacacttgagactttatactatttctagcttatcttttgtagagggcttatcttcatcttcctataatcataatagctaatatttctaaaaatctgtttttgaagtctagtcaagtgaagcaatgggattggaggaagagcaaagaaatctataatgagttgtgatcaattagttgtaaacacccctacactcagaccagccatgatcataatagctaatatttattaaacactggccaagtgccagagactgtgctgagtacttaattacgcattgccttgttatatccccactacaacgctatgaggtaggcactttttacatctccattttacagatgaggaaattgagatttggcgaggccaaagtaaattgcttcacatcatttggctagttaataacagctgggattcgaacccagctctgcctcactcagagcctatctgctttgcctttgtggtcaaaaagaaggcagctgttactttgttccatggttgctgacttcaaacaatgataggggagatttggactttagagtctctctgtctttgattgattgatttatacactagttttatatttattgagaacctgctgtgtcccaggcacatggtgtatacaaaatagtcctagtctttgacttcatgggactcgaagcttacagtctagttggggaggtaaacatgtagccaggcagtggtttcagatgtgctatgagtggatgaatcggggcttcaggagcacggagaggaactcccaactcaggcctgagaatcagggaagacttcagaaggaagataagcttaagctggcgttcactggatgagtaggagttagccaagcgaagagagtggagacatgttctggacaaagggaacagaatacgtctggaagcctgagagagcttatgttagagaaacatactaaggtacagctggggtaaggcatatacagggtagagaatgggcaggtgtaaagcctgagtcctgtccttgcagttgggatgtcaggtgaaagttaggactggttaaacaggtctcttcttgccacctgtgtataatgaaatattaaggctcagtggttaagggcccagattttgggttcacactgttgctcagtaactttgtgacaatgttaagaatcaggttttttttttttttttttccgtatggaaaaaatcttatgttataacagtatctattggtatgtggttgctttgcatatcaagtggaatttatttaaatactgcatagcacagtggctgcatgcagcaaacacccaaaaaatgataaggcaagaggaacaaaggggtcctgcattctgttttctccgtggtgcggaaagtgccattccttctgaagcccaagtatctgctgcctccattgacaggttgaggtcagttcaccataaggccaagagggtttattcacagtttgtggcaccttattagcaggatagagggcaacaagctggatctaaaattcctaaggtatgctctcctcaagtgaaatcagaaatgctagatgttctggggcaggagtgttctattctcaaataaatttggcagagtgttaaagataaatcagtttctttactgcatgagttttcagagccattaatacagccctgtgcattgtaaatttctaagaattggataaagtatgctgttttttccaaacttatttagccagagaccctaatgaccatgggctaagaaggaacaggccagagatgatgcctcttgggacagttaagaaaagatagaacaggcttgaataggctctccatcattaggagtgttctcctgaggaatggtcctttagccatgttttttaaaatctacattgtgagtagttccactctgggctacgttggcttgacatgtcatatgttgttgaaatacctttctctgttgtctttaggggatgtcattagaaagtgattctatgtttatttgactctaattcccttctcccatttgctaaatgaatcttcacccaatttttatagtacttggagtgtaaaaaatgtattttaacttatgtattttttaaaattaaactttttcatttttaaataattgtagatttgtctgcagttatatcagataattcagagaggttatcttatgccctttatttagttttccctttttgcaaaattacagtataatgtcacaaccaggatactgacattgattgacactgtaaaatgcagatttccatcaccacaaggacccctaacattgcctttttatagccatacctagcattccccacttctctgatccctggtagccactaatctgttctccatttctataaatttgtcattttaagaacattatataaatgtactcatacagtatcccctttttgggattggttgttcttgctcagcataattccctggaccttcatccaagttgtatcaatttagctaaggagtacttcatggtatggatgtaccacgtttggtttagccattggctagttgatggacatctgagttgttttcagtttttgtctattaggaataaaactggtgtaaacatttgtgtacagatttttgagtgaacatacttttccttgctctgtgataaatgccaaggagtgcaattgctggtttgcatgggaattgcgtgtttacttttataagaaactggcaaactgtttcccagagtggctgtaccattatatggttttaccagcaatgtatgagtggtctagtttctctaaatccttggcagcatttgtcattgtctggacttcttttttttctgagacagggtctcactttatcacccaagctggagcacagtgacatgaacacagctccctgcagcctcaatctcccaggcttaagtgatcctcccacctcagcctcccaagtagctgggactacaggcgtgtgccaccacacccggctaatttttgtactttttgtagagatgggtttcaccacgttgtccagctgcttcttgaactcctgggttcaagcaagctttctgccttggcctcccaaagtgctgggattctttttttttttttttttttttttgagaactaagttgaaggaaaaacaatgtctggcaggagcaagagccctgatgacctcttgtttcccacagttctgctgttgcctgtttgggggagaggaatgtggcactcctctctccaggatggtggccttaaagtgtatgaaaagtcattcctagtctccactttggtttcttctgtttgatttggaatttgggttacatcatctttgccaaccccttcttcttccacaccctttgtaaaatgggtcagaagcaggacttcttttcttcttaaactgagcaagtaggggaagtggcatacaaatcgaactattctgttttgtttacctattctctttaaaactgcccatctgttgtccatttgttttcttttgaaaagttaatctgaaatccacccccccggcccctgaacgacagggtctcactgtgttgcacaagctggagtgcagtggcactatcacaatcacgagccttgctcaagtgattgcctcttgcaatcacttgaactgagccttgcccagttcagcctcttgagtagctgggactacaggcacatgccaccatgcctgcctaattaaatttttttattaattaattttttttagagacagtctcattattttgcccaggctggtcttgaacttctggactcaagcgattctcccacgtcggcctcccaaagtgctgggattataggcatgagccaatgcaccaggcctgaaatccctttaacatatttttttccccttggctatttatttatggcttttgaacatcttaattagactggattggagtaactataagttaacttaaaaaaatgtcgaaaggcataggggtattattttgggtaacgtatccctaaaatattttggtggcagtgctgtatttcattaacataaagtataaactctattccacctgctttttttttaagaggacatgaaaaaagaaatatctctcatatagaagttttggaagtatttgacccacttagtcacaaattatcttcaactcagatattctgcaatatggaaactattgttcttttgcagtaggccatactcattttgcatgaccagtctgtttaatgcttttctagtttgccagtctctagtacctaacttgattcagcagtatgacctgtgccatagtcacttttcagacggatattcatgctgaaatttgtgttcagcttcttaaggcaacatcagccttggccagtggttttcagacttagtgcctgtttaaaacaattttttttttcatggaacccataatgtagtaatgttttgggattgtattttgggagttcatagttaaacctataatagtgtaaacctaatcactgatttcagtgaggctgttttgatgaacacaaattagaaatagtaggggagatttggtttttgctctggttgcatggaatagagagactcccgattcaccagttaagcagtacacatatcacagtttttaaaataactagtcttgcaatctcaggatgctttccaagtaaatagagacggtaggggaagctttattctgagatctgcacaaaagtgggttatcctggcagcacagtgtacctcgtagttgttctctgatgtgtaaaacttggtgtaacacatctgagtgtgtgtgttggtgttttattccagtagttaaaatagacataagacaaattcatataaaatgtttgtagactgcaatgtcttctgaagaatgctgtcagaaaatcattattctaggtccccaggtttacatccctctgtgagacgctcttgtaccagttgttgggtaatttgaacagttgcctttgtggtaccattaggagtctcaacttttaaggatcacttacagttctgtgcataggtgattttcaaagcacctgggtgaagttacatggctctagaaaattgagctttagaaaacagcaataacactgaaacaatctttgggagtgagttatcagagaacgtgcattgttgccaaggatgctggcataaattctgggaacctcaaaataaaagaatccatatttaagcacttcacaatttacctgaaccgaacactggagtcagttcctacctgtttccactaatctctgggtaggggctgggggcaggctctggccctgggtgtgcgttttcaggaggcagttctggctgacttgaacttgttacctgagctgcatttacattctactctctcctcatctgcaactgccccagtttcttctgtagttaggataggcgagtcaaatgaccttaggcaaagaagctgttgaacatacaccaggctcggtgtaacttttcattgttctaaaaagatactctttttccagtctctgggatttagccacccttggaccagggcaattaggtatataccctggagaggggaggaaggtaagtgatgggggggagtaggagagtagcatgaaagggacattgtggacattaagaagccaggaaatctaatcaaaatatggaatgaatagggagaactcttctttttttcatagttataaaatagttacagagaaaaataaagactttagtaaaaggttactgtaaaaactttaggtttcatttcattggaaacgctgttaatatctttgttaaaatagatgaaaaatgtagctacaatctgaaggataaaagatttttgttccctctcttatcccctctgctttctaaaatgctttttttttttaatagaatataagaatttggattggtatatatggggtatatcattgtctaaatctttacgttactgtgttttatttatttttttccctcttgatagaccactttccccagctctttgaggaaagaggggcaaagaggggaaagaaggatgcttggtgtgtgtgtgtgtgtgtgtgtgtgtgtgtgtgtgtgtgttttgtagcagtagtagtagtggcagtaggtaaaagagtgttcactgggttattttcctcatcttgtttcttaggagaaggtttttcttatttatttttgagacagtgtcttgctctgtcatccaagctggagtgcagtggttcaaacacagctcaccgcagcctcgatatcctgggctcaagagatcctcctgtgtcagcctctcgggagctgggactacaatcacatgccaccatgccgaatttttttttttcctagagatggggtctcactttgttgcctaggccagtcttaaactcctgggctcaagcagttcttccaccttagcctccccaagtagtggggttacatatgcgagctggtcttcccttcccttcctctcctttcccttcctttcccccttcccttccctcttcccttcccccttcctcttcccttttgacagggcctcactttgtcaggctgatgtgcagtggcatgatctcaactcattgcaacctgtgccacccaggctcaagtgatcctcccacctcagcctcccaagtggctaagactacaggcatgggctgccccacctggctaatttctgtattttttgtagagatggggtttcaccatgttgcccaggctggtcttgaactcctgagctcaagtcatccacctgccttggcctcccaaagtgctggaattatgggtgtgaaccactgtgcccaacccaaggtttttctttttttgaaagcattatcacttggtgaacattggccagcaagtgtcttggtttctttagatatgtgtagatgcacaggacgtcctcttagaggtaggaagcaggcatgtacacatgtcctgagctgtacttacagcctcaccagcctttggcaagggtttgagacagatgtgcttagttcctgctaagaaggcaaatgtgtctatttctgctgatccctgggccctggagtctcaggagacatttatggacattgactgggattagtaggtatatccaccagacaggatctggtgtagacagattgactcaaacagactctggggaaatttattgagaccttgccctcattgattgctgcctagaggatcttggggctggaggactcttggcagccatctaaccatgtgtcctaacctaggagaagtttcttctgtagcacctccgacagctaggtatctactttttgcttcactattcccagtgatgagaaaagcaaaagcccccaaaagccctgtcttcttttgaactgggatctgcttctcactctccatttcttcttgcatagtctactggaatatcacagaacaatttttctccctcctatccatgagtgcagttcaagtatttgaagaaggttatcatacttttctttggtcttatagtcctcaggctaaataggctcacatcctggagtctcagtccttggaagatgttgttttcagacttatcactattctgatcaccttgctttggaatcaccctactttgtccatgaaccttttaaacaactgttggtgtttggggatcacacatgcttggcgaacacccttgaactgaattaaacagactttctcagtctttaatgggctcctgtggattgtgccttttgaagagggtatggagcctgtggcatcacagcatctgtgttcctccaggcagggtggggaacatcaagctaagtgcaacctgcctggtgaagaatgctacctatgcattgcttggacaaaaggttttgttattgttgttttttaaattttggaagtatccctgatatttgcattactaaaacaataataaaacataggaaagaaaaagcgaacatcacctaatcctatcaatttagatataatcattggaaaaaaaatcagtatttttcatatttttctgtgctaacttacataaaatatatgatatattttaaaaaatggaatcatgaatactattttgtggtatacttttaaaatttaatttttgaggtcaaagctttctagggcagtagaaagcatgatactccatttacccactgtagaggagtactgtagtttatctaaccatgtcccttattgtcagataatttaggttatttccaatattttgccttataactgtccatgtcctcatatttatttctcttggataaattcgtggaagtggaatcattgccatcattgcctaataggcattttgaaggatgctttttttttcacctgattgttatttaggaagtctcaatagagaataaatcctccaccttgtcaatttcattgtcttaaacaagagtctacttggcagaatggcttgttctctttgcttggatccgtgtatttcttagaccagtgctccttggaccctagctcctgaggcaaacctttttcatgcaatttagggttctttcagatctccctgtgtggaagtgttgtcttctactacagtatgtttgctggaatgagaaagtcctgtgacttcacttgtggtttcagagtcacagcttccaagtatcattgtcttggcagaatcagccatagctttttccttggctgaatcctaggtaggtgtgagcctgtattatatgattcagatctttgcccttgtcgtgggactttcttaccttgggcctttgaatgctctcataaatggtagttgagtagattcacaaatgataaggcacatggcactttcattagatgaaatgtaattaacaagaaccataagctaatatgcatgtagaactagtccaatgtcttagaagataatttagtatcataatgaaaggagacattgtttttcttcccagacagttctgaaggcagttgattttatctgtatagccaacaacaatttcttaagtctcatggtccttccccactccactagaagctgcagagtagtccttctcattctcatttactgtcccaatttcctgaccctttcactatctccctgtcctgggagaggggtgtccaggtgatgaggacctatggcctcttttctgccatgaggagctccttgtggagccctgtcctccttgctgaggccctcaagagtgcagcctgcttttctgtgtcctttcaaagctaccattgtgtactatgttgcttgtggctgtcttttctttcaagcctggcagataggatgatattcctcagggacctccttatttgctgtctcagaaaacaagcacagaggactttcttagttaccctgtagaacagacaaagaaaatcaagacgcccagatgcggggaagtgactgagaaccttgcaaggttcttttaaggcaatctctctgctctttgatgcctaaccttatggggcacagccacactcacttgcagaatctgagctaaggtgtggccaggagaagtccaggccagtgaatgttatcagtggtcatttcttggtttcctgaatccatctgtcttaaatcagctgtcactagcaaccaaaaaaagatcttatcatctgtcataggcatgacctgaagagaagcagctgtgctttgttttttgctaagtcttgggcagttcagtttggcacttagagtattccagctccttttcttataagaatatctatctttatctatctatctatctatctatctatctatctatctatctttaactaactaactaactaactaactaactaaagcattttaaaacgtggcatctcgctttgttgctcaggctggtctccaactgttggactcaagcactcctcctatcttggcctcctgagtgtctgagactacaggcacaggccaccatgcccagcctcagctccttttcttttaaatctcttggtccaatttatattctttgccagcatccttgggacagcacaaatgttgaagtttggggaaacattttgtacaactttgttcactgaatcacagtcactgcttgtgctgttgataatcaaaactaggctgcacagagtgacgtagtcacatatttggcttgggtgtacagatgtttcccttcaagcatcttggatgtcttgctccttatcagaattttatctcccccaaattcattgtttgtgaattaactgtaaagttctgggagcgatttccttttcaacagtttgcctttctagaaaaaaacttttggagtttaaatagcacttaaccctctatcattttactctctctgaagtggtctctgtggagaacatgttgggtcttctctgttcaatatctctctctctctttcttggcaaagcctggatgcgagaagttggtccaatctttcctgtccagggttgcttgttaatacagcatctggagcaaaggaaaggctattagcaccttgtcacttggagtttcttaagcattgttccatttatgtgttctttctgcagagatttaatgaaagtggcatctgtctttacacctgacatatgcaggttgtccgcagaactgaacaagtggtgtcagcaacactgtatatgcaggaaggcttcatgctcacgtcgttttttctgtgttctctgggagtagccaacttctttattcatcagagtagggctttacattttaatattctagagagagatgcttgtggtgatatatttagccttaaattcaggaatggcttcttttttcaatgtctttacattttacgcctcccattttctgtgttaataggtaagtgtgcctacatttaaattctgaaatggcatttgctaacatttaatcttggccaagttatttaacttctctgtgccttactttcttcatctgtaaaatgggtgtaataacaaaaaactacattgtagctttgttttgaaaattaagtgggatattacatataaaatatttcataatagtgcctggcacatagtaagtcatgagtaagtcttagctgttattgttaggggtagtgtcgtgataatgctaaatgctttgattaaaagaatctaattgtatatttgagtcacagattattcagatatattttatataaatatttcaaaagaaatacctcaactttgcatgtcttcctggccctgtacaaggtacatgttgttatgttttctctgctcagagctattttaagccagtacagactgtctacagaaatgggtttagaatgttttttcactctgctgttcttaaagagggtacactgcttttgagaaatcttttttaaagaaagggttcaagttcagtgttgagaaatttgtctctgaggacaacgctgtgcatttccaatacgtatctgtttttcatcttgctttcattgcagatctgcatgtatttagatatatgctcaagtccctctttcacttcccagttacttagagtgaaaaaaagaaaacatcagtagttggtgcctgttcattcacttagggctttcttggtcctttcagggcactgctgtctgttgctgttgcctcactcagtttgcttcctcttggatttcagttatgattgcttttttttttttttttgagacggagttttgctcttgttgcctgggctggagtgcaatggcgcgatctcggctcaccgcaacctccgcctcctgggttcaagcgattctcctgcttcaaattcccgagtagctagtattacaggtgtgtgccaccatgcccagcttattttgtatttttagtggagacagggtttctccatgtttcagggtggtctcgaactcctgacctcaggtgatctgcccgcctcagcctcccaaagtgctgggattacaggtgtgagccactgcgcttggccgattgcttttattttatagccggtccttgatcgggggtgcagggtgcattatctgagttcattggtgtgtgtggctctgtgtctccatagtcagaaggattcctgggcatgctggattcttttttttttttttttttgggaaagagtctcactctgttgtccaggctggagtgcagtggtgcaatcttagctcactgcaacttctgcctcccgggctcaagggattctcctgcctcagcc

SEQ ID NO: 2328 - DNA, 1878 bp, Homo sapiens
ggggaatctgagaactctggggctggtgctagctcctctaggttcagcatgacccacagctaagcagaggagcggaaggatggttatggagagtggaagtcctagacaagaatgaacagtttacagccacttgtagaactgtctgtctctttccagtatctgaactttgacgatctcaaagggcatctctgggaatttttgagtgtcagcgtgccactcaaagggtggcgggaggggcacctagcagtcagtgcagcaaggcagacaggacccgcatgccagcaccctgcctgtctgatgacactgattccgaaagggcactttctcatctatttcctgctttggaaaagggcactccggtcattccagtcaccgaaacaagagattttggaaattcatgccgggcagagtgctgggcatggggaatttggtggctggcaagacaagccgcttctgtcctcaaggcctgactctgaggccaaaccatcactgagtcagggcccccagagccctgcatgttgaccaccgtgtggatggacaccatgtggatggcctctttcaacatcttctaactcagctttctcctgcagccagtgagctctctccagagataagtgcagtcatgcccttaccatctaatacacagcagtttttcatcactgacagaaaatgtacaaccttaacccatcatgacttacagccctccatgtctgatcgtagccccaaacacaccatacctttcacatccgcactgcatccctgcattgtaccaccagccagccaccttcctcctcccttacccgctgggggatttgcacagtcgctgtagaccccagcctctgtgtgaccactactttgaagacttcctccttcaccctcttaggaatttagcctttctcacctaatatttgtctccgctcattgaacatgaagtcatggtttctatgctggttgttattctttctgttatttacagtgttttttttgttgttgttgtttttttttaagaaaagagtgtgttagaaatactttatacacaccacataaacttgaagtctctctgaagaaacgtttatggtttagaaatttatgatacgaggtttaagatagtctatttcatctgatgttttgcctttttctcatgtcaagtgttacctcactgttatgaatgttgccacactggctttatatagccaccatctatcactcttctgtttgtttagtaaacatctatctccatctatctgttatctatactctatgaatctattgcctatctgccagtcacctctcatctacctatccatctcaatgtttgttttgactcatttgaaaataagttgtcaacctcacaaccacaagaaaaagaaatcttgcttccatctcaatcccttttgtaaccattgttattgatctcatgtatcttagcaataattctttttttgcaataataagcaaatttgttttctaattacttcactgattcttctcataccttcctctgttgttattattattgcctggtttcctttctttgcagttgaccttagggaaagaagatctctgcatccttgaacatgcttacaaatcacctaggcaattataaaattataattataaaactaaacagatcatcatagataaaggaaatatatagttcagaagaaaatgtaataaagaaaaataagtacaaatataataaagaaaattaaatacacaaagacaataaataccctttagtacacagttatgaaaattgacttggtagcaacagatgggtgggttgaatacttttttacattacaacaatttccataaaggtgcagacccacaaataaagcaatgttttggcccaaacgagttatcgaatttctgctg

SEQ ID NO: 2329 - DNA, 2460 bp, Homo sapiens
cgcatatcaaccaatatcccccaaaaagaaagttgcatgaaaaaagttgcatgaaaaaaacagaaaagttgcattaaaaaaacagaattcccaccgtgtcccagattttccaaataatcctgccattcggaagcctgttcatagccccaaagtactgaaaggccttgcaaaatgctcataggtggaacagcaggaagcatctagagccatctcagagggagccttctgcttccagaaataaattcacacattcacaggtgcttcctgttttttcaaacaccttgcccaccttctgcacaccaagcgtggattctgcaaaacgtgagcccaacaggaagctgcctgcaatttcaggtagcttttctgactcttaaagagatctcaagtataccttcagagaaatgccagcaaaaactgtagtcatttgggaaggaataagcctggaagaaaaagatacaacgaactagcacaacgaggagtttgaaaagttcatgacagctcacagctgatgatggtggcaatcttaaggatacagaaagctcattcctcatgcagggaagaagaaaatattctaaagaagagataagcatattccatgaaatcaaaaaagcgtaaaacgctggaggagaagtcagtagcaagcagctaagacaacatggtacatgtggctagaagcccaccaactgctaacaaccagctggagggcctccccggaagctgagcagatgccagcaccataattccagtacagcctatcaaactgtgagccaattaaaacttttatttattttatttattttaaaaaaattttaatttatttataaattacccagtctcaggtatttctttatagcaatgggagaactgactaatacagctatcataatgcattcaagaagaaacagaagacactaaatagccctgcatctattaaggaaattaagtttatttttaaaaattcaatttataaagaagtatatgaatgaaaatactttccacgaagtaaatcctaggcctgaattatttcatctgtgaatgctaacaaacacttaagcatgatataatactcattctatgtgaactcttctaagaagttgaagaggagtgaatacttcccaactcattccacaaggctagcattactctgataccaaaatcaaagacataagtaatgaaaaccatggaccaatttcccttgtgagcacagacgaaaaatccttagcaaaattttagcaagttgaatgtgacaatacctaaaagaagaccaagtagagtttatcccaagagtgcagtgttggaggaaaaatggggacattgtggctaggctggaatgagccagggaagtgaaatgagatttgagaactaaagagaactagatcatgtgggccagaggatttgttcctgatcatcatgaccgtgaactcaaacaattaatactagtagtgtgaattttaggcctctctactggagaacagagaaaattgaggggtggtggggactggtaaataccacagagagaattgtcagcctcattgcaaggccttgatttttaatctgagtgagatataggaaaaccattgaagagttttgagcagaggagtgatatcatcattttactgcattttagtgatctattttattgagaacatattttagtggagtgagactggaatcaggaagaccaaataataatatgtaagtcaaagtattcagtaaattataaatgattcacataccaataattactcaaatattgcaataacttcatcattctctgtcatagtttagtgcaccatttctgacaagctgctttatatatacttacttttttatagataacagtcttttgataaaatacattttgctagagaggactctcagaagaatgtggggaactttgcttggttataggttgatcattgaagcccagtggaattttgcccaactcttttattatacatccctcagttttattgtcagaaataaaatgttatgctgaatggtaagagcctaaaataatacaacattcctttatacaatgtacttggtcccaacttgattgtgatgtcagaaataaacaatatttaatcattttccaaggagctggtctcccttgaaccagccccttgcagtcattgttctcctgactgatgttatcagagatcctatgcaggatctaattcctactcatgccagagcaagccaggagaagctctaccaactcctgggagctacaaagcgataggttcccagagtctaaaactattggaaatgatgtttgtctaaaatggccagagacaacttttataagcttccaggaagtggagaaccagaaaaactgagaaaaaaaaaaaaaaagccaaaacacacaaggtcaagggagctgagaatcaaagactgtgatgacaggcaaggctgtggatatggagtgcacccaagagttctctttcataagggatt

SEQ ID NO: 2330 - DNA, 2042 bp, Homo sapiens
cagaaacatgtgacagctgtggtctaaaaagggaagcctaaagggtcaccaaagggaccaaaggggctatggcagctgggactgagaaccagggaggtgagtgcaaaaatagtaggtccaggggttggtttagaacatgtgttgcctgtggctcactctggtgggccagctgggcgtggtgggagtgtggatctgctaaatttaaagggccagaacagacaccactgtgcaggagactgtgcatgtgttttagcctgggaacctcttatgatagctcaggctgagtccaagaaggtctaagcatggtttgccctgaacctggagctgggaaagcagaccaagtctaaatgggaggggcaggcagtgttggagataaggacaagccgtgatgggtgcttgggtggagggacaagtctgggcgctgggccctgggcaccgtggggcttacatgctcaggcctgcaggagtgagtgaatagtgctgggggagacagaggcagatgagtcacaatcccagatgtgagcagatgctctgggcagatttgggctgcttgtcagcaaatttgaccacagcctggatgggctgtcaggctcaggccaccggccccactcccagcacagagaaagcctaagaacgcactcctctggatcactctttgaaatgtttcatagccctatatggaaccacatctgggagagtaaatgtattttctgagccaggctttacaagttgattttatgacgcatctaggcagaagatgaaacgccccagtcattaactcacttccccttgtgggtgaattccacaatacgtctgtggaacaagtttctctagcacacacagacctgtctgtcagtggctgctcagataaatccttcgctcttcagaggctgtccctggttcacccctcaggccacgtgctctctcttgcaggcaactttgctggctcttcctggaacaggccaaaacacagggatgaagttaaggctgcctgtgtcagaggggccttgagcacacattcggattcttaaccaccagcttaccagatagcttgctgtgtccgtgtgtgtgtgtgtgtgtgtgtgtgtgtgtgtgtgtcctttaaaattctagcttaatggccacatgttttaggccacttctgtcctcctaaaatagggctctgagcacgtctccaaaggagggcccctgaagcacaagcagtgggccggctgccagggctggcagaatgagacacagtacttgaaataaatgcagggtgtttgcttacagattctttaccacatcatggatgagtcagatgacttctcaccccagattctgtttttaccctttttcctactcagagctaggggtgggaggattgtgtaaagtttaaaatatatccccaaattatatacttctgtgttttaacatacaatagggatcctttcattcttcgacgcggtcgagaattatgtttaacttttcctgtttcattctgttttaattcatacctggttgtggaaagagcgttggaagttgagagacctaggatcaagtctctgctagttagtagctctgggatttggggcaagtcagtccacctgtctgagctgcggtttctcagttcccagcttgcactgggaaggaacagctttgtggccctggttttctgagcccctgcccttcacttggggttgcttgtcatgacagcaagttagatcactcatggaagtgttttgaaaactaacatgctacattcttgtgagggataattattactatgtgccatgccaaaaacaaaacaaaaaaaatccttttcttttcttcagccttcttcacactcaacttagcctcatctgtggctagagcttcttcagtattccaggcaaatcccttctctctggctttctgaggctgacctaacccccaactccactcataacacctctgcgtctgcttctgctacttcttttttttttttttcagggtcgtccgtatgttcttttattatttatttattcatttcatagtagtaacatataagaatataaaactta

SEQ ID NO: 2331 - DNA, 2773 bp, Homo sapiens
ctttgtctcttgctccagccagagctcgaggttagctcttcactgccctgtgtcttctttccaagggtctcggtgattcggccacagcctcagcctccatcacgcggtgaactgatggtgctggaagattcatagactccaggacattcctgaagccgagaaaaggttaagtagggtctggcctggaatactctcctagatgaagatagcccaaccatgagccaccttcgaagcagatgagatgaaattaaagctcttcaactcctaaaggcccagagactatcacaaaagaggtgggcatgtgagattgtaagaactgattttgagagataaaataagttcagtttttctatacattaatcattaatgtcaaaggcacactaatgcaagaccagaataggggccccagtgttagattaacaaggttttcttgaagcattaactgactccttaataaaggcttatagaagttatatctcatggtcaagattagaattttatagattgttcataacattttgaaaaacaaatttaattggctttatgctgttttattgaagattattgtttggaaaattaagtcttgtctcccaaagaatgaaggttttttctttttttgtttttgaaatctttattactttggtcaaattaatgacttattttacaatgacctgtgacatcaggtgttttaaatctttgatatttgactgagattctttctgtggaacaaagttccatcaaactttccaaaatcaaattataaattatgtatttttcttacctaatcctttaaaatattatgttccctaaagtttaaaaatgacataattttgcttatttcttataaaaattatacagagaacgttgttgaatatgaaatggtgtttggtttttttgggctgtgtttgtataagtatattattggtatttgttctaaaattatgggaaactcctataattcttatatgacttagtgtacattattagcagtaattataattgctatattgccacagaggtaacaaatttccttgtcaattgtatctttgactttggttgccttaaaactttttgtcattcacagacaattgtattgttttggtcctctttagaaggtggttttataatcagctataaaactcttaacaggtggtcttgaatgcaagtttctgataactttggagatggtgacatcagagtagaggaaaaaaattcagaactcatggagagctgaaatgttcatgaatattaagcagaacaaggattaagtgcatgcattgaactattagaagactgaagtaatctttttttctttttttgagtcggggtttcactcggtcttccaggctggagtccagtggtgtgatctcagctgaattacagatgcatgccaccacacctggctaagttttgtatttttagtagagacggggtttcaccatgttggtcaggctggtccaaactcctgacctcatgatctgcctgcttggcctcccaaagtgttgggattataggcgtgagccaccgagaccagctgatctttttgactttttacttaaaatgttgctgatcctttcttttgttttctgagtcaaggaaacctaccttttgatctatttacagcttttaacaagttagtatactcctgtgaacaaaatttaaagcatatttaattctctctacttgatttctctagaatttggaaactatttgtgagtattcttaacttatggcaatacatttatttgcataagtgcattaagaatgtttttttttgtttgttttgttgtgttatttatttattttttgagacagagtctcactctgttgccaggctagagtgtggtggcccgatcttggctcactgcaacctctgcctcctgggttcaagcaatcctcctgccttggcctcccaggtagctgggactacaggcgagcgccaccatgcccagctgattttttatatttttagtagagatagggtttcaccatgctggccactatggtcttgatctcttgacctcatgattcacccatcttgacctcccaaagtgctgtgattacaggcatgagccaccacgccctgccaagaatctggtttttataagtaacaggacacaattggagaaactggttattttaccaacactttgactggaatggtgttccttttttaaggaatcaaacttgatttatggagccaattaaaagcccctcgggaaaactggattcaaatcttgtctacatattccctgtactatgacatttttacttaccacaggtcagaaatcctgaaggtcactttctgacaaactcaggaaccccaggtttatcttggagcctcaagaggagataaattcacccaactcagtaaaatacggatgccaagccgaggctggactgtgctgccgccatctcggctcactgcaacatccctgcctgattctcctgcctcagcctgccgagtgcctgggattgcaggcgcatgccgccacgcctgactggtttttgtattttttggtggagacggggtttcgccatgttggccaggctggtctccagctcctgaccgcgagtgatctgcctgcccgggcgtcccgaggtgccgggattgcagacggagtctcgctcactcagtgctcaatcttgcccaggctggagtgcagtggcgtgatctcagctcgctacaacctccacctcccagccacctgccttggcctcccaaaatgcccagattgcagcctctgcccggctgccaccctgtctgggaagt

SEQ ID NO: 2332 - DNA, 1927 bp, Homo sapiens
agcaagaggacaaacctgggtagggatctctatgatgttttctgcgttgcccgtggacgttcatctttctgatttgttagctgaagatgaggatctggagcaggagctcggagtgccattgttccatgggcagatgtgcagcagagattatagaaacgcttacccatatcatagcatcagtattttgctgaagccctggagtgtcaggcaccgtgttaggaactgaatacaaaaataagatgtaaaccagtccctcaaggaatctatgggactggtaagattagctaaccgtgcacctggagggaatatacttagaaataactgcaaattctgcagaaatgctgaggggttcccaaactcgtttctgtgaggcctgttaattgctgagttgttttgtctctggtctgtggaaccccgatagtgtgccctaggtctttaatttcttcatctctaaagaatagtgtcaatggagtcattgcatgtgtttattcatacttctcaatgtggaagagaactctctagggtgtaaaaccctatccaggaagcacatgacaagttggaatcctcaatgacatggcattgctatagttgctatcggaacaatcttttcttttttttctttttttgaaacagggtcttgctctgtcatccaggctggcgcgatctcggctcactttgacctctgcctcctgggttcaagcgattctcctgtcacagcctcctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctgggattacaggcgtgagccactgcaaccagctggaacaatcttgatattagggtgaacaagtgatttcatagctttctctgaaggaggaaacactgggagcatccacccgagaatcaacactgtggatcattctggggagttaatagttttgagatgtgtcccaagataattgttagcttgaattaccacgtggatggaaccatgctgatcctaagagccaggtaatggccaaaggtgccattcaggtgaaatccccaggtggaaaattcttccacttccaatgatagaattctattactctgcctatagtttggtgaaacaagactttacaaatagaggacaagatccattttgccaagaacaaccatatggatttaactgctgctaacaaccgttaggaaggaacatcaataaaaagcaagcctgtgagacaactccttccccaaggggcgcttgttacagagcgcgggccccagcaggcctggtccatcctccacattctttcctctctgacttatttttactttctgtttgaattggcttggttttattttgccctaaactgtgtctgtagtcatcccccgacagagttttgagagtgaaagtccgatctgcccacgcttcacagaactcaatgcggagccttctcaggagtcacttgacgtcaaggctgacttttaaatttgccaaaaaggcattctttggggagcggtcggcaccatcactttccctctttagagagctgctactggctgctggaattcaaaacccacaaattgcatttctaaacttaattcgatacatagatgagcggaaagatcagacattgatgctattgttttcaaccaagatgttttactatatcatttatattttgtttttttcttcccccagtttttaaactttttgtttgtttgttttacaggccaagcctactgctgttagaaaacatatttagaaatcacttggttcttccttgcctgaacatcatctatttagttagcttgtgttgtttagatgtgcttcagatctcaaaaaaataaattatgttatttgaaag

SEQ ID NO: 2333 - DNA, 1578 bp, Homo sapiens
cataaatctctgactcatcacttctagccagattgccatgcctaaaccactttctttgaagtttatggaagcaccactgcatttatgccagaaggtgaaagtccagaacaggtgctttttggtttgagaatgagtgttctacatactggcctgtaaggcagtgctactccaagtgtggtccacaggctggcagcaacatcataggggagtatgttaacaatgctgattctccagccccagctccggactctgttttaacggtctatccaggcatgaattctactcaagtggcctgcccctcagcagaagttggacaggtgcttatgttgcaattaacaaaaaggatacatgctgggtcctgcagtaaatgtctcccttggatcatgaagtctttttaccatgttactggaacacagaagggtactattgagaaccaactaacttggagccgtgtatgagccactgggaatagactaaatgagataatcaacgtcttgatctcatattctttcattctacagaaggaagcaggcaacaggttgcaatacgaagtggagttaaagcaactagaaggaagtgtcagtaaccaagctgagagaggctggaaggaaaacaattcatgcagcagaaaagaaagccttttgagcactgtgatgtcagaaggtgacttggaagatgatctaaatgttaaactggcagtgaagatgcgcagaggttgtagttctgctcccctccccgtcagagtgccacatcattgttattcccccaagatcctggattccagacagcccagtggagcaccatagaaagaactttcaggaagcagagaatggttcagggattctgattttcctgaacttcctcctccctatccacctccaattaggaaaaaagaagaaaaaaaagattaaacacgtccagaatgttaaaaatccagtagggattttaaatgttcactattacagcacatacatttatacacaaggaggtctgaaggctttctggtttcaattaagattattatctcctttgagtgatggtttctccttttttcccccagaattccctttggctgatctattttaaaagagtatgagctagggataactaggcttatttgtattgagtctactttcccctccaggtctctttgtcttaaattctgaagtcccttttcctatcctgctaaaggttagcagcttgaaatcaaggacatgagtcattgttacttttcatgtggaagataagctctgtggcttttatagcaaaaagtatatacaattctaaaattaaagtgcaagtcagaaaggccattggggctgtgaaaagtccttatctaaatcagaagaccaaggtcaagtttgtatcatgcctattagtacatgggtttcattggttaagttaccaaacctctgagcctcagtttccttatcagtcaaatgagtgcaataattcccgccctatcatctgacaaattattgagaaattctaattacatgcctataattttcaggtctttgtttttcaggtctttgttaagcatcatgcacataaacgtttgtattacactttctttag

SEQ ID NO: 2334 - DNA, 13987 bp, Homo sapiens
cacgtaatcagtgctaatcacacccttggccactacatgaagtctgtatgcccttccacaggatgtctttgaaaagcttcagctgatgtctcattctgtttgctgctggctgggcacaactggaagcaagaagttgaccgggggctcccatgacagtgtctgatacagaggggacagtgaaaaaagaatcagaacaaagcttctttcacacctgcctttacaggtgctgcccatgactctacaaagataaaggaagacaccagatgtcacagcagctgcctgggtcacttagagcagtagatattgatgctcttcaatgtctcaagcctcttcaatcatagccccaaagaggacataaggaaggtgggcaaaggtggagggggaatggaaaggatactccaggacgtggtgcctgttttctacactcccagctgcccaatcaagctcagagatccgaggacaagagttcaacctcttcacccacttctacttccaccccaacactgcaggtcagaagcagctcagaggccacagttttggagcagacaagagactgcagagaggcttgctgaagctcactccacggctggattcctggcaggatgagaaatggagttctagtaaactagaaggaatgctgctggcaggagacagacctctcgagagggctttaaatggaaatatgagagcacgagaggaactctaagtgtagaaaatgcactgggcaaacaagcgtgtcgcagatgtgggcgccccagaagggaaggagctctggagtcacaggggacccaaaggacagaatgtcaggtggccctccaagcccgcaggtggcaatgggaacaaggcgggaaatgaactggagagctgaaggcgggggcctaggaggaggccgcagagctgtgatgaagggctgctcatcagaggcacatgcacgggtcagataaagaagctccgctgcgaagacagggggcaatgcaaggccacagccgaagattccatgcatgctcttcacggtggcaaattcaaaagccttggagggcagcatgcttctatgataatagggaatgggggccggggggaatatgtagaccccatatcaatgctctcaaaacctctctctctctctctctctctgtctctctccctccctctctcttgctcactctctctctctctctctctctctctctgtctctctccctccctctctcttgctcactctctctctctctctttgtcgtgctctctctctccctctctctcccactccccacctctggcctaatatacctgcatgtccacagaggcaccaatctgcaatgatgatggactctctcacccaccctgctactaggaaacttcttccatatatcataaacagagaccagtattacaatacttcacccactgcgccaatttggctttcatgtctgtttcctgtgtcgatcacaacatcctagacagcccaaacaaggctttattcacctctagtccccggtccctggaacagcagacaataaataaggaatcaacaagtgtccttcactgccgcacacattggctgtgaatatccttttgcaaagtgcagaacatctgaaagattctcacattgactaaacaacagtgtgacctgaagttaagagaaccataaaggtaaatgattgctagaagtttaattccaaacaaggaagagcaatttgatgcaatgggcagaagacaaacattgggagaatgagaacgtatcctcttgagttgtgatgtgaacaaacagagattccaagatcttgcaaaagcgaacagtcagcaaccagcatggtgcttagagtagtccctgggcaacagaaaaaaaacagataaatgaagaaacatggacaatcaccctacctgggtctcagcgtgaggaggagaactaggacttccagacagaaaagaggagaagcatgaggagggggctgggaaagacatttccctgtgggcatgtggtgccctccactggggccagaattcccaacctgcctcactctccccatctgtgaaattggctgattccctgaggtccctcccagcactgactatcaagtgacagagaacctagaaactccaggagctccatcagagccctgactacctgtccaagtgagactgtgggagcctcactcttctcacacctgtaaactgagggtgctgcagtgtcagctatatcaacactcccaagtatgcctttgccaaaacctctatggatgagaaaggaaaagagcatgtatggaattggccagggcttagaaccatcttgaacatgacacacttatgcacatcgtcacatcttcccagcatccctgtcccacctcgggcagcaactgtcaaagttctgcccccaggatgacctcccagagtcctcagggcagctccatctctccagccctcattcctttccagctctttggtgtttccctgtaataaaaacactgtgcacttctcttttcatgttttaaccatgaagtgccttcctccagacaagtactttaatccttactccagtcagaataggtaacatcagcataattaccatcattactcccattttacagaggagagggctgaggctcacgtaagacctaatcttcatcttcccagggatcctccaactcctagccaggcctctcccagctcctaaatcaatcatgaaagactacagcaatcacatccagtacttttctgatctagtgtctttgccgctaaataaaggcagaaatcaaggtggcaggatcaatcctgtattcaaatcactgtactgtctgccaccctcctatgctggtccagggagcagaactgaaaatgtgcctcaaggccccaatccaaaacagatgccatcaccctggacagattctccaaccatgctccaagactggtatccatctcacttcaaccagccctccttcccaggcctgggtctgtctactggcacagggggaccctgccatgaaaatgagggcatctctactggattgcaggcgatcccctcgctgggctggcccacccattcaaccatcactggaccacccccaggcctgctaccccttcagacactcagcctcatactgcctagctctttctaccaggtctctccctcagatcaattccacctcagccccaaacttgccatctcctaagcagatttatacttcttcccaatttctatccttcctctagctcattactgctttcctgttgcttaagctaagtctatttcaaattatagctcagagagggcaggtgacttgttcaagactacacagccatttagtggcaaagctggggcttgaacccagctctcccaattctaagccttgtgtttttccactaaatctcagctgtctctctctatcatactgctcaagaagccactggtgcatgagagggtgcagaccacatcttattctctttagtaatgtgtacactaagggccaggtatatgttcagtgacttcttgcagtcctaggaggtatgactgtctttgtttacagatgagaaaatgttttcagactactgcactgctataccactagtctaaatacagttgtgaacacacagcactggtcaataaatgtgggttaactgatttttttttttttaattagctgaagagagcctaatggaaagacctgaaaaacaagtttgtggccagatcaggcaaagggggtaagatccagttatcattctgcagtagaactaaacataatattgttgcaggacaatctctgatggcaatgtgaagcagtctgtgagtcggggtgcctgattttgactctacctgacctgacagtgtgtgtgactctaggcaaatcttttctatttccaggcctcatttccccatcttcaaaaactcttttttaaatttatttatttattttttttacaaaagaaagaaagcaagaaatcccagaagttgaactagatcataggttctcttcaacattagtagcacctgtgagcttcttagaaatgaaaattcaggggtcccgcctgatttacagcatcagaacctctgagacggggcccagtaaactctccaggatgaccctaatgttccttcgagtttgagaaccattagactagatgacctttatgatccttccagctctatcactctgagaaccttatgctttctcaattcaacagcatcaactcctcccaattttgccattctgattttgatctggcatgaacttgggtcatctggctctctcatctggtcatgtctgatgcttcctcctgtgattaatagaaaaggccccaagaaacagacagtatactccactgcacttattttttccatttaccacctcagtggtatgcattctgtcactatatttaaaaaaaaaaaaattaacatgtacaaaaaagcccaactatgagcacagtggcatcctggtactatccttttaaaaattggaaaaggagtttactcctgaggcaagtcagtaaggaactgctgtattatctgaaaaataggacctttctgagcccagtgatctctttttagtataaagccagttgaaggaataagagagcatttgcattctacaccagaaatactcgtagattagcaaaccttttctttcttggtccttacatatcaaaacaaacaaacaaatccagatcgaccttacaagtataaaaacacatcccaatgagtactattttctctgtgttaactatcaacaaatggactgtttactgctgaaatagtgcctgaaactttattgtgaaatgaatgaatgtgcaccttctcagtgccagcatgggagatgtaaagataagcaagttaaaattctactctaggtggggcgtggtggctcacgcctgtaatcccagcactttgggaggccaagcaggcggctcacttgaggtcaggggtttcacaccagcctgggcaacatggcaaaatgtcatctctactaaaaatacaaagaaaactagccaggcatggtgggaggcacctgtaatcccagctacttgggaggctgaggtaggagaatcgcctgaacccaggaggtggagttgcagtgagccaagaacccacgactgcactccaggctgagcgacagagcgagactctgactcaaaaaatataaaataaaataaaattctactctaaagaaactaaatttgagtctagtgtcagcagtgtcaaacctgtccatccatccaacaaatgttcactgtttgccaagttccaggcagacgagaaggtcctaaagaagtaaaagcccaaaataagacgagcatattgataactacaagagaaggtaagaagtgatcagtgccatgcaagcagtacagacaaagggccatggaaccataagaggaagtgatgatttcctgcttaggggggatgggcagaaatcaaggcatgcttcatggaagaggtggtattaatatgctggaccttgaagatcaattggattcaaacaggtaatgatggcagggcagggtaatccaaatgcagaaagtgctgcaacaaagacaagagtgagggaaagcaatggagatgaggtttcagaagtcagctggcccccttcaataagaccataaatggcaggataaggaagatatacagggtatttatgtctccagggttcagctccttcacccagcctcccagctagagatgtccctcctcccccatctctccaggctccagggacagaactgtgcacctgctgcctcacccagcatgctgtgccttccctgctgcctcatgcgtgcgttcctcgggtatcaatgcctgcgcacgcttcgctgcacttgctatgccatgtctttacactactgttttctgtaatttataaaacacatactgcccacgagtttgtatttttaattcctgtaagaagttttgggatccaatttgtgtgaaagtcagactgtaacataatgtagtattgtatgataaaagcctccaagaataaaaacagacagtatatcctgcttatcagatactcaaacactggttccattcctgagtgtcacagatttcctcatgaataactcttctttgttttgcaccagcttgtcccaatcttcttgaaataagttctaaggggagaatttcctgattttcaaggcttctttttcaaacattgattgagaacctactacgttccaggctgtgctaaaagtgggcacaacggtttgcttaactttcacagggtaaaactgtggcattttgtgagggttaagtcctatgagacattactgatcagtgaacccactttacagataaggaaaaatgaggggaaaggtggaggagcctggatccaaaccctaatttttgggagtccccgatagttgctcactcatttattcaacaaggacaggatcaaggtatcttgaagatccttttctgatcttctctgggcttccagcttctcccagcattgtcacttcacttttgggggcctcagtctcttcccctaagaacaaggagactcaatgcagtgacttttaagccctgctttgctggagcccttcagggagataaatcaggggaagaaaaaaaggtgggtcccatcctgctcgacttcatccgcagctgctccagattacatgattacaacattatacgtcatagtaggcttttctttcttactttttttttgagatggagtcactctgctgcccaggttggttttttttgtttgttttttttgtttttgttttttttgagacggagtcactctgttgcccaggctggagtacaatggcacaatctcagctcactgcaacctctgcctctcaggttcaagtgattttccttcctcagcctcctgagtagctggtactacaggcgtgagccaccacacccggctaatttttgtatttttttaaatagagatgggctttctccatgttagccacgctggcctcgaactcctgacctcaggtgatctgcctgcctcagcctcccaaagtgctgggattacaggcatgagccaccgcgcctgacctgtaataggcttttctataaggaatccttctctaaatattaaggaatatgggccaggcgtggtggcttacacctgtaatcccagcagtttaaaaggctgaggcaggaggatggctagagcccaagggtttgaaaccagcctgggcaacacagtgagaccctgtcgctacaaaaaatacaaaaatttatctgggtgtggtggcatgcacctgttgtcccagctaccccagaggctgaggtgggaggattgcttgaacccagaaggtcaaagctgcagtgagctatgatcacacaagtgggggaccccagcctaggggacagagcaagaccttgtctcaaaaaaataagtaaataaatattaaagaagatgaaagttttaaaatgatcctaaactgggtatcctggactagatcttggaacagaaagaggaacttagtggaaaagctggtgaaatctaaatagtttggagtttagttcacagtaatgtaccaacatcagtttcttagttttgacaaacgttccatagtaatgtaagacatcaaaaatgaggacaagtgggtgagtagtatatgaaaattccctgtacaatttttacttttctatcaacctaaaattactccaaaattaaaagtttatttaaaaagacaacaataacaaaaaaaacacaatcatttagataatctctattatcttttccaaatcgccattttgtgacttaataagggtaacacataataacagtggctaatatttaatgggcacttatcacatgtcaggctctgttctaagggctttatatgtattaactcatttaatcctcacaacaagataagtaattttcttattattattttatggatgaggcaacagaggcctaaaaatactgagcaacaagttgaggtatttttggcaggccagaatgcaaatccaggcagtgtagctccagagctctggcccttaagcactacatacttagagcagagttttccagatgcttctggaattgggcctatctaaccaggaatagccaaaggactaaaggcaaagactgagaggtgagtagtttgtttaatacaaaagaagaggaagcaaaaaggactctcaaggtgaattcttagcttctgaaaatctctactggagaagaaccaaacctcgccgaggttaccaatggcctctccacatgggaatgacatccttggccttgtcctaactgtgttctgccctctctggcatatcatccttgaagagttgcaccaccagcccacatcatgccctctagtcggctacttgctggctgtctgctgacattttcatccctgaagtgtcagttcgggtagagagtgaaatgaaacatgcaggctgtcttttcaaggcctgcaaaataagcttaagctttccacatgaccagttttcctagatactcaagaatccacgctgagaacctagtagtgcattgcccaatcctagaaagcaaaaaccccacctttccaattgataatatacctcatggactgttgtttccactaagtgtcaaaaagaaagcatctcacctccattatgggatccttgaggataagacttggtctcactcatggaacaacaatatgattccataaagaaatggtgctaatctcttggaaagatttgtagctggccaggaccaccacccggcaatctgtgcctccattgcaatcatttgtctttgggaggtttcagagtggacagcatccataggcatagcctgaagggaaaaaggtgaggagagaggaagctatccagatggagaatgagaaaggaagatttacagcattgagggtgtagacaagaaagagataagcttgggtgactaaaaagcaatggcaataaaaagaaaatgaatccagaagcagtcaggatggaagagaaccaatattcatggaatgcctactttgtgtaggcatgaactatgctcactgcaggagtttcctcatactgccaggctcaaaagtacatggaggatcaagcaatccagggtgactgcagcttgtgttgacttagtaaacattcaaattcaacattttctagttaaaaggccctgagagtacacatagcgtaaccctaacgtttcatacacagataaactgagactcagactcagaaaaattcaagcccaaaatggaatgagaaatacaacccaggtttgccagtgttccttttgatacagatatgaaaaacaaggaaggtattgctgagaggctctgaaagaattcactgttacgtgaaatctcccatgatatggcagaccagatttgtagattatcctctacctcatctagcatgttccatctgctggttgctaccagaggggaggaaattggtagcattattttaaatgaagtagatgtctttccaggaagatataaaagggtaccttgccttagatgaagaagatgattcagatgaataagaatgaaaaatgaagacacaggtgattcaccagaataagagaagctggggggaaggtaagttggaggaagtggtagatgacaaggtaaacggaaactagactgactagaatgatgctgttgatgaagaagctgagactccctcggctgggcatggtggctcacacctgtaatctcagcactttgtgagatcgaggcgggcagatcacaaggttggaagtttgagaccagcctggccaacgtggtgaaaccccatctctactaaaaatacaaaaaaattagctgggcatggtgggacacacctgtaatcccagctactcaggaggctgaggcagtggaattgcttgagcctgggaggcggaggttgcagtcagccgaaatcataccactgcactccagcctgggcaatagagcgagactccctctcaaaaaaaaaaaaaaaaaaagaaaagaaaagaaaagaaactgagactccctctcataagagtgattcacaaggcagaggctctgccccaaacaaagcatgagaatgaaaatgtcttacagacgtgaatcaacaatcacttctgcagatgggcagtcacgcagttggaacaaagccgaaggcagaaagttctgcgccaaaaaattcattgcctcttacctctccatattcaggctataataaaaattggtctacattatatcaatgtgttagggagtctccaccaaatcagccatgtcagaatttcactgttattctgttcccgatgatgctctggcaaccctccaggcctctctgcctacacagtctatctcccgctagacccagcgctcctccatgaggaaaggctgtcctggttacataccctccactccagttaaaagactctatgtctaaaatcacccactctatgtgcacaactttcagacaaagtagaattctgaccctgtatcatagttactagggtgaatgtctgagtaccccttctgggctgtgggaggttcgtggccagggtccacggcccacagcagctttccccaaagcatattacatcactgaacccaggaaatgctctggtacaaagggtagtagtggggtgcaggggttctatgatcaaataactttgggaaacaaaccttccgggaggtcagaatgcgcattcgtttattaaagtctcaaaatcccatggtaaagatacacaatactgaaatttccttaattttgtttaacttggacttttccaaacttacttggctacaggacccttttcttaataaaacagccttaacactttgggaaatactgtcttacagaatcacagcattctaaaggaccttcatgttcctacagctgaactttgcagctttcacactggtctgtgtcctctttaagagcaggggccttgtctgaatcaaggtgtatccaaacactcagctaagtgccttacacactgcaagccaataatacgtgttacacggataaactaaacccaatcctctcatttctaggatgagaaaataaaaccaaatatgtcagaatgacctcttttatagcttccttagggtttaaaagaagcctctcacagagaatgtgctcaataccttttgaaaaacgaaatgttaatagaataggattgaagaaaaaagaaaagattgaaaaagtttctcagttatactacgagcccaaagtttctataacatgatggactgctgcctcttctcctctttcacccaagtgaagtcttaagtagaagaaaataaaaatgatgaatcaaaaaaggaaaactgtaggaaaaccaaaggccccttgggatgggaggtgggggaggtggtgtttgcaaactgatggggataaacaagacttgtctgtatctaatttagacttaataagatagtttgctgaatgttaattaaatactcagtggttgttaccaactgtggtgattaacttaattttgaattaaataagcaataaatgcttaactgaagttctattaaattttacccagcaagtgagaaatatgaggctcttaattgactttaaacaagatagttatggcaagttagttgaatttttattacctgaagataactgccttattaaatctaaattgtctattttatttgatagggaaatatgtcatcagttcttctcatttaccaaaaacatgtcaaaagaggttcacaactggtctgaaatgcttggcttgggatttacttcctgatcttattttaatattaagtttattcatttaagaatgaatttagacttaagcattagagaggtctaggaaggaattatatttacaactgaagaaccaggtgaccatgttttctaaaccaaaaatcaggactctgatttttcaacgtagacacagtttagagatgttctttaacatcacaatactgaaatttccaggatgtcgccatggtttaaaaggctatggacacaaaacatttaaaatcattactgttcaaataaatggttggctctgctactgaacaagctgtacggccctgggtaattaacctcacttttctagacttcaactatcacacatgttaaatgaagaggttggaagtcactgttttcattcatttatttttttcttcatagtatgtgcagcacgtgcctggcacggagtaggtagctcaataaagactgagagaatgaatgaatgcacaaataaataaatttaagcagctcaaaacattaaacatttttagcccttttatatcaagcgtcttcagcccagactatttctaaatattgtcatatgacaatccatataaagagaaacacaaacaataaaccactacttgggaaatttttttagtaatcaaagaaattcaaattaaaacaataataagatatttcttacatattaatttagcaaagacaaatgcaagttataaaattaaatcctggtaagtgcacagagaaacaagtagattcacatactgctaatgactgtgcaagtcaatagtctttctggaggctgactggcaactgatctgaaaagtcatagaaatagttgggacttttgtgctataattcttctctgaaagaacttaaaacatatttagccagtcagcaaacactgggtctaccataggtcataatttggagaaataaaaggaaaaatacagtgagtgcattattagctaatgggttgacagagaatcctaaaaaaaaaaaaaaacaacacacacacaaagataacatttttcagtggcactgcatggcaggcctttgttttgttttgttttgttttgttttgttttgttttgtggtggtggagtcttgctccgttgcccaggctagagtacagtggtggcacaatctcagctcactgcaacctctgcctcctgggttcaagcaattctactgcctcagcttcccaagtagctgggactaaaggcacatgccaccatgcccagctaatttttgtatttttagtagagacagcattttgctttgttggctaggttggtctcgagctcctgacctcaggtgacctgcccgcctcggcctcccaaagtgctaggattacaggcctgagccaccgtgcccggccaacatggcaggctttgaggctttactacactgaccatagaataccttccacaatcatgttatgtgaaagatactattacactcttttagagatgaggaattggaagttcagagaggctaagtaaccagtacacgattatatggctaacaattagcagagctataatttaaatccaaaccttctaactctccaaaccatccatgtagtttctactacatccctcagcgataaccacgtaatgcaagacacaaaaactgtaacctctataaggaaaagtcaaagtgccaagaaggtactcaattaggtggtggtggtttttttaatttcttaagctattcttaaaactcaagtcatcatttattacttcatatatattattcattcattcattcattcatatgttcattcaataaacatttattaaattatttataacatcccaggatttgcagcagatgctgtggatatgaatatgaacaaaagctagagccggactcagagatctgcacaggcagggaacaggaagaatctggcattgcgataatagaaaacttaagtcctggttcaatgtttaacttgcttgggttctgggcaaatcatttaacctttcccaggttcaagcttctgattaaacttggacaataataataaccatccgcaggactactggtatgatttacctgtaatttgtaggaaaacacatgtttccataaagccctataagaaatggcaacagcaagataagtattatgctatgtggatggtccattttgaccaggatcctgcaagctgagccagctaccaatatctcccacatgagtgagcattaatttattggcaacgaaatggttgttccatcactactctgaatgaactacaggccaccattcttagagctcaatcatccatttttaactctctctgccttttgtctaaaataatcctgaggagccaaatggataaagcattcccag

SEQ ID NO: 2335 - DNA, 1666 bp, Homo sapiens
agaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagccttccgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgact

SEQ ID NO: 2336 - DNA, 2157 bp, Homo sapiens
agtccatgggatgtcttgatgcaggtcatcatctcacccttgttcattattggatggagaaaccagggtcccagagacactggccggctggggcaagatcaccactcattcctatcaacagctgggttaaaggtgcagaagacatgcttattcgatttgcaggtgacccaaaactagatgcagtggctggtattttaaatgaccaaacaagagcccaaaatcccctaaagcggatgagatgatggactaacccctctacggatggatgtaaaattaaaattttttgcatgaaagagattttggctgaaggttcattgcacattgagatggttgccccaaatgattgtggtctcaggctgagtctgtagaggtacaggttgacgatgagggaggtgatagctggagggttgtgctcaactctggttgtcgtacatttgaggagacagggagagaccagagtccagtttgtggagggtaaaggttagtgaggaactggggatactgatcttgcagaagagaagactcaaaagggcagaggcaggaacagtggtataaccctgcctggctccaagggcagaactggcacccatggagataacaggggcctgagaaccagctctgtggctatcagaactttcccacagtgaatcagagtgccttcagaggtggtgagctccccatcaccaatggtatgcaagcagagtgaggaaaggattcctgtttccagctctcagatggttttatcaacagcaaaaaaactagaccctactgataaaaatttctgttggctatatatacacatatagttaacaaatatgtaatccatatttcccctattttaaggtttattttattttatttttgagacagggtctcactctgtcacgcaggctaaagtgtagtgcaggatcttggctcacagcagcctctacctcccggtttaagccattctcccacctcagcctcctgagtagctgggactacaggctcctgccactacacacctggctaatttttgtattttttgtagagacgaagtttcgccatgttgcccaggctgatctcaagctcttgggctcaagcaatccacctgccttggcctcccgaagtgctgggattacagggtgagaacctacttcttcataaagagaatttggagggagctttttgttctgcggggacaacatctggatttgaatacatccatgctcaaaaggagatttctcataatggacccaactgaaagcactcagagtacaaggaccggtgagctttcaaaaggagacacttcgggagactcgccaggggccctcgtatccccggcagcgcgagttttggaggtcagtggagggctctcgcatcatgcatgtaactttcatactcaaaaacttaccttcatcctgcatccctcacccccctgcagaaacttggggcttgaattcatttaaaaacatttgcggtttcagaagccttctttttattatgaagctgccaaggagatcttagaatgaaaggcatttttagagatgagaaagaaggaagccaggccaaggctgggccggctctcagccgtgggtctgtaaaggtgacacgtgggacatggccacctgcagaccctgcaggcggctgggcagaggcacccacagggacctgggtttgaatccctgctctgccagtcatttccacagcgatcttgggggaagttgtgtaacctctgggccctgcgacgccctttcctggagcctggagctggaacgaagccccttggagccctgacatcagaggtgacgttagtcttcgcaggcaatgactcggcggaatgtgatgccactccctaacccgtgtccggactggcagagtgtgtgccgcctcccaccaggtggtctggctgctttgatggatctcctaacttctctgcaccccagagccctcagtgctggccagaccttcactcactcctgggtgacaaccccgttctcagatagtgggtcccacaggctggcctgtggcgccccctgctggtgactgcagggagaaggatgccctaagccaaaggaagtccttcctggggtctaatctctaccttttgcatgatgaggcagctgaggtggctcgctttctcctccaccccagaaaataaagtcatatggagtccaa

SEQ ID NO: 2337 - DNA, 2884 bp, Homo sapiens
tggaaatcagcccatatccattaagttcattatttctgctttaattagccagagtttatttttttgcttacagttaagacctgacttatgataattatgataatataatttcaatgatgacaatggtgatgataagaactgtgttgtaggaagcaaaacaatcactcagtttgtaatgtggaaaatagataagagaggagtgagatgggaaactgagataagtgtgagactaattatattacaaatgatgtatggtggcaagagatggcatggctgatggttagtatctaactgtgtagatggacagaaaggaatagattcaagagagacattggaggtgagatgaacttgagttttttcagctgttggaccattcacagtacagaaactttgagagttgttggccttaggtgctaatgttctttgttcaaccagagatatttgggctgcagagagtacagctcagcttcacatcatttaaactgagtcaaagaacaactaggcgtcatgttcagattgggttccctcaactgggtagaaagactcagccgtttccatttttgtctttgcaagaaggtgagatttctcctggactcccatatgctgatgacatccaatattttgcaaatgctaaatatgcaagaaaggtgctcatgaatagataatgaacactgctcatcatgattttctgtggagctttctcgttgtcccaactgctgtttttaaggccagcctaatgagcctcttgtgaccacaggaggaacatggttcagagagggtcttatttaaacggttcatccatgcaggaggggcaatgcattttcccaagtctcatggaagggtttcacagcttagagctcagcctcagagtggactagcacacagctgtttcggagactggaggatagcctgctgggatagaggtttccctggaagatacagagctggtaaggctatcaaggtaaattgggcacaaatggtggagtccatggagttcagaaaggttttcaggcaacagggagattttggagttttttgttgtgtttgttttgttttggaacagagaagtaacagaatcagatctgtgctccttgataaaatgtaaagaatgaatttgaagaccagagattgaaggatagaaggcaagttaggagatccaggtaaggagtacagaaggccagaaagcagggcagtagaaatggaaaggaggagacagagtttgaaaatgtgttggagtggaatatgtaggatttagtgagggataggatggagatagagaaacccagaggctttaggtctgggtaactagaacagtgaggccagcagtcaagatagggaggcatcaaaaacacagaacattcccagagtctgagacaatggatttggttttagataaaataggtagtgctgattttaaagatgataggctttgggggagaataatctgaatctcctgtaaagcagacactgactggtcagacttataaacttttgacccaggcagaggtatatgaaatttataataaataaatgaagctgactggaattgagggccactagatttagagaacatgacccatgtgaaggccacttagctcctctgagttgctgatgcgccagaatgggggccagtattgccaaatcatccgattcctaaagacaggccagaaatcagaatgttacctgaagtctcctgattcttaaatgttggcaaccaattctttctttgctgaaacttgaagtgagccaatcccaggcaattctgcagagcatcccatctgatcccacacatttgagaatggatggactaacctgaagtattacagagcagcagtgcagaagtggggacacaagtaaaggaggatcaccaaggaagtgtttttgagcaactgcaacattgctggcccatgctagatgctgtgggagatataagctatggctgctgctctcaagaagctgacagcatcgctgcatcagagaaaaaggcagcacactgtgtgattatgggtggtaagtctcaagaaagggagaaatcagcatgcaacagacaagtgaagagaggcaatataaaagctctgggtcttaaatagctttaaagaggaggcagaaggtgcacaaagaactagagattttcctccaaattcaatttccaagtcaatagctgcagttcaacaggttttgtgatttctgcaggaagataggcatgaggtttccgagagcaggtggaaatgagtaaattataggtagaacctgctttcacactaatgatcactaacagaaaagtttgtgctatttattttattttttaaacagttttctctgttccaattgctaggcccttggcatctaacttaagaattatcaataaataataaaaatcctgacagtttatattcggagatgacacatctctgtaaaatagtgagataatccccaaagctggagcatcttattcaaggttggtttatttagggttgcccatggagtgggaaaagaggttaagagaacactgaaattctcaggataggggagggtagtacaaaagagaggatttgtcatgttgtttataactaggctttggggatgcagcagaaagtcaaacagagttttgcttgataatatactctatttgcttcttgatttcttgtctttcttctttttttcttttctattttttccccaaatctctgatgttaacagtgaggagtgatttatttgttgggggataaagaaaatagtgtctctgtcctgagtttgtatctatcattgtatttaaatgaactttttttctgataggcagaatcaatttgtgaaccacatttgatcccctcagtccaattattgcagaagctgcttcctggctcaggtggtgcatgatttgtcc

SEQ ID NO: 2338 - DNA, 8150 bp, Homo sapiens
agtcaagtatgactgccacagagaaatggtcccatccaggaaatcagatattgagtcctacctgagtttccagcaagaaggtacggacttgctgttaggatgggaattatggatcaggaattgccctgagatggggtcctggtaacagatagactctaggataggattccctcctggggattgcggcagagtgtacttgcaagtggagccttgaaggtgtctttgctcagttcaaaagccacagaagaagttctggacgatgtgggccttcaatcttctaagatgggaatagaaagaagaggatctacccagaccaggaccctgctgcccaatctcagctctggctttctggatctgtgcttctctggtagaggaaccctgaggactgatctactcttgcagttctaaaaccatggcccatgcctcgctattccctgggacacaacaatattgaacgtaggctagttaatagccctacaatctcctctaagtgttcgagtgaaaggaagagtcacatgtgtctcactttaaaccaaaagctagaaatgattaaacttagtgaggaaagcatgttgaaagtccagacaggctggaagcgaggtctcctgtgccaaacagcaggccaagttgcacatgcaaaggaaatgttctcgaagcaaattaaaagtattactccagtgaacacacaatgacaagaaagcgaaacagttttattgctgatgtggagaaagttttagtggtctggatagaagatcaaaccagccacaacgttctgttaagcctaaacctaatccagagcaaggccctaatgctcttcaattctatggaggctgagagttgaggaagctgtggaagaaaagtttgaagctagcagagaataattcatgaggttgaaagaaagaagctgtctccagaacataaaagtgcaaggtgaagcagcaagtgctgatggagaacctccagcatgtgatccagaagacctagctgaaataactgatgagggtgactgcattaaataacaaattttcattgtagacaaaacagccttctattcaaagaagatgccatctaggactttcatggctagagaggagtcaatggccggcttcaaagcttcaaaggaaatgccatgtctcctgttaggggctaatgcacctagtaactttaagtcaaagctcatgtgtatttaccgtaatgaaagtcctaggatcctaaagaagggtgctaaatctactctgcttgtgctctataagtagaagaacaaagcctagatgacagcacatctctttatagcatagttcactgaagattttaagcccaatattgagacccactgccaagaaagatagatcattttcaaaatattactgctcactgacaatgtgcctcatcacccaagagatgtgatggagatgtataaggagattaatgtggttttcatgcctattaacacaacatccattcttcagccaatgaatcaaggattaattttgactttcaagtcttatttaagaaacacattttgtatggcaatagctgccatagatagcagttcttctcatggatctagggaaagtaaactgaaaaccttgtggaaaagattcagcattctagatgcaattaagaatacctgtgattcatgggaagaagtcaggtatcaacatgaacagaagtttggaagaagttaattccaaccctcacggatgactttcagaggttcaagacttcagtggaggaagtaactgctgcagttacttgtggtggaaataacaagagaaatagaattagaagtggagcttgatgatgtgactgaattgctgcaacctcatgatcaaacttgaatggattaagaatctactcctggtgaagatgctttgaacattgctgaaaggacaaggatattaaaatattacattaatttagttgatacagcagtggcagggtttgagaagattgactctagttttgaaagaagttctatttgagtaaaatgctatcaaacagcaccacatgctacagagacatctttcatgaaagggagagtgaactgatgcagcaaacttctttgtcttattttaataaaatgttatacccacctcaacctttagcacccaccagtcagcagctatcaatatcaaggcaagaccattcaccaacaacaaaaaaaatgacaactcgctgaaggctcagatgatcattagcaattttcagcaataaagtgtttttaattaaggtatctgcattgatttttttttaagatgaaattttgctcttgtcacccaggctggagtgcagtgctgcaatctcagctcactgcagcctccgcctcccgggttcaagtgattcttctgcctcagcctccttagtggctgggattacaggtgcctagcaccacgcccagctaatttttatatttttggtagagacggggtttcaccatgttggccaggctggtcttgaactcctgacctcaggtgatatgcccgcctcggcctcccaaagtgctgggattacaagtgtgagccaccacgcccagcctgtgcattgattttttagatataatgctactgcacacttaatagactacagtcgagggtaaatataacttttatatgcactgggaaactaaaaaatccatgtaacttgctttactgcagtattcactttattgcagtggtctggaaccaaacccacaatatctccaaaatatgcctgtagtcagtgggacacatgatgcttctttggttgggagatttgtggacatgagtcttgaggaatcttgagaaattgaagaaatgatggaaagacaggctagtcagtggtcagaaggaaaggggtaggtgctgggtaaaagagcaaattgaaacaaagaacaaagagggaggaagagaatttatttatttttatttttatttttttgagactgagtctcactctgttgcccaggttagagtgcagtggcaccatctcagcttgccgcaacatccgcctcccgggttcaagcgattcttgggcctcagcctcccaagtagctgggactacaggcatgcaccaccacacccggctaatttttgtatttttaataaagacagggtttcactatgttggccaggctggtctcgaactcctgacctcgggtgacctgcccgccttggcctcccaaagtgctgggattacaggcatgagccactgtgcctggaaggaatagaatttaaaaagcatttttgaaatgggaagaaacagattttggaggataggagatggaaggaaccagaagaggagaaggtcaccatccaacttactgcattttctggagagtttcgtgtttcttcagcaggtgtaccagcctggtcttggtttggatgcctgtgactcttaccataaggtataaggccttagcctgcacattctcatcactgtccatcaatcccatagccagtggaatagcaaaatgatggttcatgaggcctagcctatccagcgcctcccagggtagttcacggatacgtggattggaatggattgtgtcttgtaggaggcgatgggcagtcttagaaaccaactctgaagatatctggcaagtggcaaaaatacgtttaagtaccctaaaatatctcttgtattcctctacagagcagtaaattgtgaggttgaggatggcctctattaaatcatccataagccttccactatattttcttctcatccaattttggtttgccatgctttcaagaatatcaagggaagttccttttcgcaccttggatttatccttttgttgactccttgaaattttctcttctactagagtcatagatgacaagtcccagtccttaacttggtaggatgaatacagatcacagcataggaagactggggtaccctcaggccaagggcgagcacggatcactgagttggggatggccatcaggagcaaagggccattgccgcccttgaccaaagaagcactgtggcatttggtaggcattgaatccatcccagccagccagctgcaacggagcaggaacctcatgtcggggacgattatacttggaatcaagagtagagaaatcaatatccttatcctccaaaagaggaaatttggtcttttgaatcacaagggacatgcttctctcttcttctacaacatgaggcacagtattgtcaaaagcaatgaaccgtttgttgacaagggtctctagcccctgtaattcctgccgcccttttccaaggtagacaaatctgggtacaaatactgtttcaaacataaagaagaagctaggaaggaagggtttagggacttcttgtatttcatctgcattttttaggatacgcaggtgaaccagctgagctggagggagcagctttaagcaagatactatgtagatacgctggttgaaagtcaacaacaggtcacttcgattactggcaaagcagagtggtccaaaatgcagggctgagtcgaactcggttacaagtctaccgtggaagtcccagatccggactgagccatcaatgccacctgtgacaaaaagtttcaggggaaggcagacatcaaatgaagtgatgtcacactcatgcaggcattttgtctctctccacacaaagctctgttttgattctgaagatgtcagaaagccttcatagtgccagagacaccagcagtagctttcagtgatggcacccacagaacctggcaagagtatcacacgttttagggggcagccacagaggattttgctgacaggctgaaggactaccttgttcacctgaagcacggcctctgtcaagtgtatgatgttatccgtgccataggaacagagcaaggcgtttccctgagggccttccagggtagacaatgccaatactgccccagagtgaacagtcttctctattcgggcacaactatagtgggaaagggttctcacaatgccactctcatgcccacagaacatcaatcctcctaggcctttttgcagatgggacctcccataggccaagcatcttactgtatccttacggtctgctgaagtgcacacaagatacttggctgtacaaggagagcgtgttgcatcaaacaccagcacctctgaactgcctattgccacaaagagttcctctctctctgagtcataggcccaagccaaagccttatccataacaagtagaggccaagtgataaccaggagatcccctgttactggagacaagaagcgcaataaaccatcctcagtggcacatagaatccgagtccagttatggccgcagcagacccgctgcacttgctggggagcagaaccacagacattgaagaggctataaaagtagggcaggtgatgcaatgaaaaactgtaggtggtctggcagaaaaaagtggtattatcaataaactgcagtctctgaagatcctcgtcaatattcagctgccgcagcaagttcccataagtgagattccattccctcactatgccttcactgcctgctgttagtaaggtgtggatctctggccggctatggatacatatcactgatgaggaatgggcttgaaagctgtggaggaagttaccttggtctaaaccccaagcgtggatctctccagccctgtttccagcatagaaattgccctgagagacacaagtaaaggagcaagtgatggaagagccactggcgacaggagtgaacttcacttcttccagctggccctgaccccggtgaatgaagaccctcactgtatcctcacacagagccaacagggatccctgggggccattcagggaaaatccctgtacaagctcatgatcagccataggtactatttgagccatctcgatgcccatgccatttggtaagataaaccaggtaaccacagcccccagggtaccagagagcagcaactcagcttctggatcatagaagaggcagctggtggagaaatgacagggcactgtacccagaaatctgaacgttcgacggtgatctccaaaaagcctcaggcgcatgtcaccacagtaagcaattaacatgtggtaggaacctgtgtggaccattgcttgaatgggcggccactgatccatcatgcgaagcctcatcttctctaccattcctttcatttctgtaccctttttttgtatccaaagtactgcctagaagaggatgagagatgaaagcctgactgtggaggtggatcattttccaaagtgtggggtagggaaggctgaatattcagatccctgttccctctggtgtgactaaggaaagactagacagcttgactttaggaatctcctagtacagcagctcccacttacccatggtttccctttctgtggtttcaactacctgtgtggtcaactgcagtccaaaaatatcaaaagaaaaattccagaaataaacaattcataagttttaaatggcatgctgttctgagtagcaggatgaaatctcaggcagtcccattccatcctgcctgggacttgaattatccctctgtccagcctatctacactacataccctatctgcctgttacgtcacttagtagccattgcagttatcagattaactgtcgcagtatcgctgtgcatgtgttcaagaaaccctcattttatttcataatggtcccaaagcacaagaatagtaatactggcaattcagatatgccacagagatgccacaaaatgcttcctttaagtgaaaaggtgaaggttcttgacttaataaggaaagcaattgtatgctgaggttgctaccatctatagtaagaatgaatcttcttggccgggtgcagtggctcacgcctgtaatcccagcactttgggaggccaaggcgggcggatcacgaggtcaggagttcgagaccagcctgaataacatggtgaaaccctgtctctactaaaaatacaaaaattaatcgggcatggtggtgcgtgcctgtaatcccagctactcaggaggctgaggcaggagaatcactggaacctgggaggcggaggttgcagtgagccaagatcgtgccactgcactccagcctgggcagcagagtgagactctgtctcaaaaataaaaaaaaaaaaaagaatgaatcttctgtgaaattgtgaaggaggaaagacaaattcatgctagttttgctgttgcacctcaagtgcacgcattatggacatagtgcatgatagcacttagttatgagggaaaaagcacaaaatttgtaggtgagccacatgaacacaaacatgttccaattgatggcagtcaggtttggtactatctgcaatttccgatgtccactgggggcttggaatgtatcccccatgaattcgtggggactattatactaggaattgggtatgtgatagaagcaccatgttcaaggcccttttcttggccttcagtctacttgatggagaatatgaattctgagggcctgataacatgaggtgaagaaggatcactgcatccagtcaaactgggatatggagatgggtactaaaatgagctaattcacagtcactaccatcattctaaaatgagggcagttcaggtgtgatgcatgtaaattgaattaagaaggagagggggaaaaacgaggtggctttacctgcatttttccacagggttccatccagtttaaggagacaaaacagttgaccttgatggagtagtagaagcagacaaaaggcttgttctgtggatggtgagactcccggtatagagtctcaggccagtcactcagtagaaccacatcattctttggttcttcatcattctgagagagaagaatgacctgagttaagagttctgagtccccactcattcactcatttcagaaatatttactggccaggtgtggtggcttgcacctgtaatctcaacactttgggaggccaaggcaagcagatagcttgagcctaggagtttgagaccaatctgggcaacacagcaaagccccatctctacaaaaaatacaaaaattagctgggcatggtggtgcatgactgtagtcccagctactcggaaggctaagtaagacaggaggatcgcttgagcccaggaggtcaggccacagtgagccatgactgtagcactgcacgccagcatgggtgacacagcgagaccctgtctcaataagtttaataaataaataaatattta

SEQ ID NO: 2339 - DNA, 10833 bp, Homo sapiens
gcctgggccctgcggctcatgttctgtcggctgcctgtgacgaggtgctcaggaattccactctcctattggcaaccccttctccctatctctagaactctcattctccccaagccaccttcaactcatggctaaatccacccatcaggcacccgtgctgtccatacacttgagaggctgagctctgctgtggagagaggccccgctcctaggacacgcagctgggcctcacaagggaactgtgtatgtacaaaggccgacttctgacagccaacctgatgtgccaagggctcagggttcagcagtgctgcctctgaatccctggtgagtaaactgagacacagatctgagaaaggatgcattcctctttgagctgctggggaggagaaagggttaaggtgaggtagctcggagctgacagcccctttacagaccctaatggtccacagtcctgttttgcaggcattatctgaggtcccccagccagctgagcgcctctgttcaggtggagaggccggaggaagccagggaggggagaaggaactcccagcgtagcttcccttgctttccctctgactcaagagctcgctccaggggaggtcagtgtgcgggtcccaggggatcaagtgaatggttggcagaggagaggagggtacagagtgccaaaggatgattcccgtcaccccccgcaaccgtcctcagaaacctgagcctgttgctctccaggataaatcggggcctgactcaggccccagcagccagtgacactcagcctgacccaggcgcgggctggtgactcagccctcaatatagcccatgagcccaggccctgggcctggccagccaggctggaacagaccgtgcacaatgctgggcccggcctgccaagtagggccccctccccgaggagcgctgacatgctcctccccaagccaggcaggggcacacagggggttacaaggggtttcatcagctgagtatctgggcagtgctggctggggccacaggctgtttatagccccctgactcaccacctgctgacctatctcaggagaccaggttgcctggctcttcacctggtcctgcctctgccgtcaaggggctctgctcatcagccaccaatactggccatatttatcttgggctgagctgaatccaagtgagcggatacaatgagccatgtttgaaaatcctgtttttctggaaccagggacatttccacagtcacctgtgatgatactgggctggccaggtcataacaggcactttcagtgatactgatactgactgtggctctgacccaggttccagggacagtgtggtagagtggaatgatccatgggctgaattccagcctctctacttctagctctgcaaccttgggcaagtaatgtagctcttttgggcctgttttctcgtctttttttttttttaatgtgtgaaaatggaaggaaatcacaagaaagatgattagcatggtgcctggcatctaataggtgatccaaaacaattagtttgcttcctctgattatcttggagactaaggggttctggtgagagaggccttcccctgcagctctgtgtccacacctccgtggggaccactgcctggatctccaggctgttcccctctccccttccctgcaacccaacattccctctgccacaatcagaaccggcagtacctgtcatctttagaaccacccaccctgccccaaaagcagctggtccttgacaggagtggcagcgggtggctgctctacctcttggcctgggaagggaaaccagacagggctaggctgcagggagctcacagaaaggaggcagttatgcagagggcagcagcggggagagatggaggctcctgaaggtgctttgagtccctggttctagcacacctaggcccaagtgcacgcctgcctgtggcttccaaggcatacccctccagacttaagatcaatccctcctgtcttttttttttttggtataaatttagagggtgcaagtgcagttttgatacatggatatattgcttagtgtgaagtctgggcttctagtgtaacatcacccaaataatgtacattgtacccattaagtaatttctcatccctcccctcgccccatgccccgaccgcccccctacccctcgccgctccaaagtctccaatgtccatcagttcacattctatgtccctgtgtgcacattatacacattctttaactccacattttttttttaaagacggagtcttgctctgtcacccaggctggagtgcagtggcacaatcttggctcactgcaacctccacctcctaggttcaagcgattctcctgcctcagcctcccgagtagctaggattacaggcacctgccaccacgcccagctaatttttgtatttttagtagagacggggtttcctcatgttgaccaggcttgtcttgaactcctgaccttgtgatccacccaccttggcctctcaaagtgctgggattacaggcgtgaaccactgcgcccggctttaactccacttataaatgagaatatcctactgccttttttttaagctagctcaagtgaatgtttcacattcaacaaaaaagattcctcttaaaaaaaaaaagattcctctttaatacgcctgggtaacagtgtatcattaagacaaggagacagtccaaaccaaatgaagagaatgggattctaaaatgaacggagggccgggtgcagtggctcacacctgtaatcccagcactttgggaggccgaggcgggcgattcacttgagctcaggagtttggagcagcctgggcaacatggcaaaaccccatttctgcaaaaaatacaaaaattagctgtgcgcggtggtgagcacctgtagtcccagctactctggaaactgaggtgggaggatggcttgagcctggaaggtggaggttgcagtgagccgaaattgcacgagtgcactccagcctgggcaacaaagccagaccctgtctcaatcaatcaatcaattaatcaatgaaatgaacagagaaggacatgtcctaaagggaggggttttgtagtctaagcaaaaaagtgggaaaagcaggcccacattcctgtcattaggcagggtctaggttcaggtcccctagctggggaccaccctactagaacctgacctctatcctggcttgtaattccaggttaaatcagtgatctttgctgtcttagtccatttgggctgctgtaacaaaacactatagaccgggtggcttataaacaacaagaatttatgtcttacaattctggaggctaggaagtctgagatcaagatgcctgcagattccatgtctggcgaggggcctactccctcacagatggctgtagtttgttttgttttgttttgttttgttttctttttgagatggagtttcactcttgttgcccaggctagagtgcaatggcatgatctcggctcaccacaacctctgcctcccaggttcaagcgattctcctgcctcagtctcccgagtagctgggattacaggcatgtgccaccacgcccggctaattttttgtatttttagtagagatggggtttctccatgttggtcaggctggtctcgaactcctgacctcaggtgatccgcccgcctcggcctcccaaagtgctggcattacaggcatgagccactgcgcccggcctggctgtagtcttactataaacttacgtggcagaaagggtgagggatctctctgaagtctctttaataagggctctgatcccactcctgaggcctttggtctcatgacctaatcacctcccaaagcccccctcctaatattatcactttaggggttagggtttcaacatatgaatttgcaggatagggggcagacacaaacatgcttaccatagcatttggctataagtcctttccaccacccatacccatgttcttcagtcaactggtggcggcagtaaagtgggtaaatagcagtctcactatactgaaaagcaagcagccagtggcaccaggtcagttgtgaaataatttctttaggttacaactgagaacatacaatctaatataattgactagggtggtgcttctcaaatgttaccgtgcatacgaatcaactgggcatcttgttggaaatgcagattctgcatcagtaggtctgggttggggcctgagatctgcctttcaaataagctcccgggcaatgctgatgctgcagatctgtgggtcacatggactagcaagaagctagaccagcctaggtcagaactgtcttcaaagaggagtcacttagagctggggtgcacaatccccaggccatggaccgatactgtcaggaacttggccacacagcattaggtgagtggtggctaggcaagcattaccacctgagctctgcctcttgtcagatcagtggcagcattagattctcataaggagcaggaaccctattgtgaactgcgcatgtgagggatctaggttgcacactccttacgagaatctagctaatgcctgatgctctgaggtgggacagtttcatcccgaaaccatccccatcccctctccatctgtggaaaaattgtcttccatgaaaccggtccccggtgccaaaaaggttggggaccgctgatttagacaaaggcaaaagaggcatatggcactgtcctcagtttgcctagttgcagtcacgtttctaggaggctagtcacaatttcagcactagccccatgtctgccaaaatggacttttgattcagccgtgtcacttctctgggctgaatacaacttgaaaatatcctaattctaaatgtccttgctactccctgtaggtaagagctagagaaggaaagaattcatttagcttggcagtgctaccacagtatacactctgtacatgtgtttctttggatgtttgattgaatggaacaaagtccttttgggtgggagggaggaagaaagaggggtccaaagaaagccaggagtcatggggtcattgtttccactatggtttaagaatatgcttggggctgggcaatatgcctcatgcctgtaatcccagcactttgggcaggctgaggcaggaggattgcttgagcccaggaatttgagaccagcctgggcaaaatggtgaaactctgtctctacagaaaatataaaaattagctgggcatggtggtgtatgcctgtggtcccagctacttgggaggctgaagtgggaggcacttgagctcaggaggtggaggttgcagtgagccaagatggtgccactgcactccagcctgggtgacagagtgagaccctgtctcaaaaaaaaaaaaagaaaaagaaaaaaagaaagaaataaaaagaatacgcttggggtcttctttcgtaaggaaacattcatgatgataaactccaatcacaaaggttccacaggaatgaaggtaaacaggaacacacataaactatcctcatcattctacttgtcccaattagatccatcttcaggcctctgtcctgctctaagctccaggaggctgagcttgaaagattacatcacctgggcacctctgcgctttgtcttcccattgagttcagctgataaggtaccagtagaatactggcaggtgggaggagaaggtaggggaatatatatcccacttcctcacggctctggcgggggctgcaccccatgtggctgccactcctgcctggggcccattttcagagctccagctcttgcttcctttccttcctgcttcagcctgggatgctaacagctttacactgttgctagtgcctggtacttcactattttttgttgcttctcctaactctgcctttggtacatagtctcttcattaaactctcttcatgtaaagctttgagtgtgccacctgtttactgccaggaccctggctgattaaagtcatctctgagggcgaatcccttgagaagtcacaaaggctaagtcacgaaggcacacacgtggatcttcttagggcggccttctcatgtagataggtgtgggcacagaaccttaggggaggtctccccagccctcagtcactccatttctccatgctcaggagagcacctcaggatggggttaataagcacagactaacccctctgtgagtcagtcgacagcacaaggggctagcctcatttctgaggccatctgcaaggtgagaagccgcatttaggagtcagacccttatgtgaggtacttggttaaagggggactgctctgttctggttgtgttgtgaggcatttagcaaataaaaatccacagtctcatgtaattcagttgatatttaattacaaggaactcaggttcttacacaaggcaggagatggaagtcagccgctccccacaagccttttcagcctgggtgactgaggctgaggagatggggacacatggaacatatggggagggttctggcacagtgtgtcctgcccaaagctgagggtggtggccactggggatctgccctcgcgctggccaaggtctgccatcactccatgaggcagaactctgactcctgctgtcgcatgttgggtaacacatacagagccacagctgcaatagccaagaataccataggcttccacaacccaaacatgttctgtggggaccaaagagaaactgtgagtgcccagcctcctgaaccctgccctaagccagaagtcacctgcctatgggtgcccaagacacctcaggaacattgtggatcagtctctgttacctcctgggtaaccggtggaggtaagtgatctctcagtcctggcaccactagacatgtggcccaacactgtacgcaccaccttaggtgaccgcctgtattcaggcctccgtttctccccatgggctgagaatactagctcccatgtgaagaagcaggctcaggggccagacttccaagtggttgcaatgagaaaggactggatgccatggcaagaaagaggaggggaaatctggggctttgagaaaagcagcagcacctcattagtttcactgcagtgaagtgaactcagagtcaagaggatggggaagggggaataaggctgaggggaaatgaagaaagtgcaccacggagtgcaggtaagtaggaggttcttaggcagacaaactttgacagagaatgacattggttcaaggaaatttaaggaaacctgtcactgggcctaggtcattagaacactcctaatcaccaggtatgttgactgacttcctggtgcatgtgctagagtatgctgaggcttccagacactgccggccactagggaaccctgctgattcatgggacaagtggcaccatcgaagatatccaaaaagcatccattaggtaatatgaaaatcttagacaagaaaatacatacttggggaaataggttttatttttattacttttttactctactaactgaaaggtagaatttggattttgagtcataagctatggcataggtaacagaaggatggtttcaagtaaaaatggaatatagcccattaatgctaagaacacattttctcagatgataattgatctaaaaagaggactttaagcctgctaaagagcaaagaaaatctcctgagcttatagaaatagctactaagaacaacagaaggtatgaaatggaaagccaagcaatgttacaggtggatatacagagtaactcatgtaagaaaaccaagagatccggaggctgagggaggaggatcgcttgagaccgggagttcaaagttacagtgagccatgatcatgccgctgcactctagcctcggtgacagagcgagaccctgtctctaaaaccaaaaacaaaaactaagaagggagctagctagaaaaaaatatttatatgctcagatgcctctatcctaatgtgcattgctaagaatgttagtctggtgttcttaaaggagggaggagctgaaatccttaaatgtgacccgtgcacctcacactgggcaaaggcaagcttctacatgggatggggaaagggctggtgtgggtgtcccaaaggggaagtcgtgtcaaactctccttttaaactaggtgacctaagtgacaaatcaccggaatcatgtttttggacgttgagttgtttgacagaattttctatgatctttgcagataatatgcagaaataagggtaggatgacagtacagtttgttgaatggcaggtaagtgaccaatgagctgaataaaagaaccccaagagacgacactctagaggctctgtcctcactctgtcctctgtagatgaagacagggaaggagggcttgccacccctgtagatgatgtgaaggtggcagaggaagtgaatattttaaaaccacagggtcaagattaaaaacacatacacacaaaaccttataaggtaagaacaatgaactataatagggaagaatggaaaattctgcctttgaagcctcaaaatcaaatgcaggtacagaatggggagaggacgcttagcatacacaatctgcagaggggcttataaaaaatacatgaaataaataaataatatattagttacctaaagagctaatgtgatctgaggttgcctaaacacaagtatggtgtcttcctacttgggaccaatgaagagaaactgctcaaaatgaggagagacaataaagggaagcaagactggaatcttatttgttgctaatattgagtccttataatctgactcgcagcttcctggctgttttacttaacttctctatgccttagtttaatcatatataaaaaaaaataggagtagcttcttcatggggttgttgcaaggattaaatcagttaatatacgtaagtgattagaacagtgcctgacacataagactgcattttgtaagtgcgtgctctttttattaatgatggggtattttataatttatagaatactttcatctacttcaacccatctggtcctgacaaaaacctgtgaggagggcagaggttcgatcatcctttgcttacatttgaagaaactagagctcagagtgtgcattttgctccctgggacaacgcctgtcagtagagacagactcaaccaagttcttctgaccgcctggcagccacgctttctaccacactgtgctccctcaggtcctggctgcacaggtgcatgttggggcctcctggagctctggggataacaggccccaccaggagaacccttcaccagcagttcttcctctccctctgattgggccgggctgggtctgaggtagtggaaggctgtggctgaactctttgggtttcacccgtagtgccttaagacttctggggggtgacaggggagaaacagtcatagagaggggccccgtcactaaagcagttgtggaccagggagtaaagggaatacctaaagtcaagaagaaaagtggaggcttgaagatgagtaacaggaaagctggggagggagcaggaggaaggacagaaaaggaaatggagagaagtgccaccaacaaatcctccagttgccaccctgtgcattaagctacattccgttcacaggaatgtgagaagagaggggagtggagggggaggcagggaaagcatgagagaggagccaatgcaggactagagagaataccttatgggttccagaaggcaggtggaaccccaggcttctaccttaggccgtaagaccacattctgcctcctgaatttggtatcctgttgacagtgtacattacatgtgtgggagctgacaggaaagtggccagaatatatcagtcttgatttcctgagaacacacatctctggctagtagaaacttttcactaatacctcattctctccagaaaacctagctggggaagccaattaccatggaatctggcccacaaaatagataaatagataactaataaaatttcccggcattctgttctgacttttccggagactggaagtccagaagcagagaactgttcagtagaaagagcagaatacagtaggggttcggttccatttcaccaagcttgatggaccagcttaggttgccctcctaccaatgcccctgggaggatcatgaggatcagagctcttcagagctcctctctctcccaacagaagagggattccttattttgccatcttgggtagcaacagtagtgagaacttggctccggagttaaaccaagacaaagagagtccaggccagccttgcaaatatcagctcatcagaagtggtcaggctagccatcacacagaggatgagcggggataaagaagtagtgaggcagctttgacagcagcaaccaagctgggcttatccaagtttttcccagccaaggattgaaacaaaccatgtctctggcaagcattccaacctcctatgcattacgaagacatgctcagagatgtcagaggctttgcagtagcccaaggaaaagtcagaactaaaactcagacctgagcatcacctattataaaatggcacaagcaagaagcaagcagctgggagaaaagggaaagaggagaggccagggcaacctgcaccctccctctatccctcagaaggagaggaagcaataccagtacctgcattaggacgacgtctcagcccaccagcaccagagcaaagccgagatgaccaccaggcctacaagaggcaaggagaagatggggggattgggggtaggggatgactgcaacacaccaaaatgagaaagaagcacgaggagagaccaggagatgtgagacataaacgcatggatccaacagataatgaagatgagaaaacaaagggaaaagagaaaggaatcaagaggttaaaaaacaggccccaccttcatgtcctgtgatatacagaatccag

SEQ ID NO: 2340 - DNA, 2086 bp, Homo sapiens
gtttgacatgagaacctgcatttaaaaccacagattgggctctgcttgctggaccccagtggttggactgagtcccatgaagccagatcacttctgactgcaaggagcttggaaaagcaagtatctggatcttttaccagctaaatttggagaattattgatcaaatttggatctctgtgtgctgtcctccaatttaatactttctgtgttgctgttttattttctttcttctggaacctggcaaagtgcgtcaagcgatgaggcttcctctttgaagatcacaggtgagaagattaggtgctttctcagaagcccagcaacctgatgggagtgtggagtgagcaagacccaaatcggagcttcatccctgcatggttcattttgcttatttggcaaacttgccctgcagaatctactcaagcttcctcagtttctcaaatcattcttgggcaacaaatgaacaagaaagaggacgtcttattatctggtgtctggcttgctgatttaataacctaggagacagtgtttgaagaacacaaactctaaagtccttcacttaaaaaaaaaaaaaaactttcccaaattgcttaccatttggaaaaattgccttaccttcttcagtcatctctgatgttgtcatcctcagagtaagaagtacgcattcataaggaaccataacgtccttcaggaaatccagtacaccctacaattttacctaaaactttgatgttgttttttctgagcattttaccttctagggaaatggatctcatgctgtttatcagtttctgaaagttgttattaatctcccctcatcccaaaattgaagaactttgcttaaatcttagaatcagaactttggctccagtaataaagacttttcaatatctttatctgccattgagtcttacctaacgaaataaagcctccaaagtgggaatttgaaatgttttagaatctttttttttccttttgacatagtgattggtgggatgctacaggcagttagtggttagggtccagaaatgccagacatcttgcagtgagagggatagtctgtacaaggaagaattctcacatgttctgactaacactggatattattacaggtgaaaacattggaatcttgtgaacctcaacctgtgttttacatatgtatacatgaagtgagttttgtatgctttattttttcactatttgaaaaatgtaactgcttattttctattgttgtgtaacaaatcactatgcacttagcagcttaaaaaatattatttattatctcacagtttatgagtcataggccactagtttggacacacttagctgagtcctctgctcaaggtctcacatagctgctgttaagatattgaccagagatatggcctcatctaaaggttaggttctcttctgagttcacgtggttggtggtggaattcatatccttgcagctgtagaactcatagcaacttgcttcttcaaggccagcaatagagataactctgctgcttccagtctctctgatctctagactctcatttaaagggctggcctgatgaggccaggtcaagtcaagatcgcatctttcttaatgaactcaaaatcaactttgagaaaccctaatgacatgtattaaatcccttcatttttggcacctggtgtgcaataatcactggattgatatctcatcaagtttgtcatagtctattggttagaagcaagccacaggcttcatctacactcaaggggaggggattgtaaagagctataactaattgggagtcacacttgagtgtgcctgcagtaacaaccattgcataaatcaaggaaacattgaattctgctttgtatgaactctacttaggttgttcaccattttgaagaatgagtttaccagcagcacttctcataatagtctacacttacagatattctagtcaccatgattccacatagaagtgcaaacatctgactacttcactatgtcttctagagtacagagctttacatagagaaaagtttaattttatataaatgactcttcttattttctttatattatagttaatacattgcacttgaaatcac

SEQ ID NO: 2341 - DNA, 1789 bp, Homo sapiens
atggcttccaggcccccctgtcatgagcctgctaagggtcagcactgctgcaattagtctctttgccagcaagttttattcaactcttcgttcctccatgtccctgactgggaattgactcgaatgcccagagttaaaagaccaaaagttacgtaacgtctcccagggatgatggcagcttatgagcaaacatgttgattaaacactgcggcaagttgagactcggtgattgcctccgtagctaaataacagctctagtgcgggtgaggaggagccttttgacacgtgtggcagttaactttgttgaagaagtgagcaaggtgacttatctgtaggaagaaaaataaaagtgcttgtgagcaaaatagggcagaaataatgaggtttatgatggcagaaaaatgtgagaatcagaattgcggaaaaccgtgtatcgagcacttactacctgcctgctgggtctctgctagctctttcacacgtaaatatcgcgttcaaatttcggagcaacccttcagggtggtggttattagtctcataaggaaactgagagagggtaagcccaggtcacccagagggaagggtcacattagatgcagacctggatttggccaaaagctaaagcatcccagacccagagaagggagtggaggagcccgagagagaatcccagctcccaggaccaccagcatttgctgaatgcccactaggttctagacactcagctaggctctatataggtgattcccattgattcctcatgactgtcttcgtatttgatgttctgtggttgtaagcaacagaaacacactggagcaagctgaagtagaaaagggaactctttatttcgaggacaaagtggtgtctcctaaacccacgaacaggagacagcaaggctgccagggttgccggaaaggagaactgaagggaaccaaggagttgtgagtcgggtaggctttagtcctacttaacttttaaaggtaagtacctttatccccattttacacataaggaattgagattcccatgagtcaaatgtccttgtccaaggtcacatggctaatcttggtggaggggtaggaagggtttggaccaaatcgatctgactcaaaacccatgtttgtaatcatcatatagaactgctgtagaggaccattagtcttaaatttaccctttaatcaagctagaaaagaaaccaggatggtttagcctgagaagatcaacctgagggtctgtatgatatccagtccatcttgattttaaaatcctttttggaggatggtgatcaactagcccttctctacagccaagaagcaggcctccgataacaatgtccccatgctcgagcccggacagacgtgaggacaagctggtgctacagcgagggccagcccttcttgaaggccaggggctggggcacagggctgctgttggttccatccggtcctcaagctgaaatctgtcctgacaaactgcccctggcagaaaattgggacacctcggaggtttagatgttctcatctgaccctttcacaatccccaagcagatggatccatgtgttttctttggctgtcctgttgcactggagagtgagtgttcattcttcgatatttcagtttacccatggggtggagaggatggggtttgtttataaatgaatgttttggtgtagacctgacttgacaccaacttagctacttcagggattcttggccctaaacgaacattcatttctgtctaaaaaacttggccatgatagtccaaactttaaatgatgttaatttaccg

SEQ ID NO: 2342 - DNA, 2005 bp, Homo sapiens
aaatggtatgcagcccggccaagccccagagactgcagctcaggatcacaccaccatctgcaaagccaggccacagctgccaaagagatctctttcctccccgtcattctgctgatggtcattttgtccttggctacaacgtcccactgggcccgagacactgcaaggattttatgagatttctttgcttcaagctaggggaaggcaaacagaagagaattcagcaactgccactttgaaacaattttggggcaagacatgaagattcacaaaatgcagtttctagaagcggctggaatgtaagctgcaaggaagggagcagaaacgtcatctgtctcaccatggctgtctccctaccatccagagtggtatctcacacagaaaatgcaatcaataaatatctgttaaatggccaggtgtggtggctcatgactgtaaccccagcactacaggaggctgaggcaggtggatcgcctgaggttaggagtttgagaccagcctgtgccccgtctctactaaaaatacaaaaatcagctaggcatggtggtgcacacctgtagtcccagctactcgggaggttgaggcaggagaatcacttgaacccgggaggtggaggttgcaatgagccgagatcacgccactgcactccagcctgggcgacagagccagactccatctcaataaataaataaataaataaataaataaataaataaatatctgttgaatggataataaattttaaaacaaaaatctggcccagagcgctcatcttacagataagttagctgaagccatggaggggcatgtcttgcccaaggtcacacagcttaagttgtggcagtgatggaaccagcagccaagtctcccaacatacctagactcataacactccacagccatttgacaaatatttcttgcattctgactgtgtgccaggcactgaactaggcactgggagcatataaatgagtaagacatagaacgactgggatcatgaaattaagttcttcatattgctattttcccaagcacggaggcaacttctctgtgctttaagtccggctccaacagtggttgtaatcatgaaccctgaagtcagacggtccagccctacatcctgtgatcctggctctgtgactttgggcaagtcattggacttcctctaagcctctgcctcctcatctatgaaatgaatgtgataataatacaggttcaaaggcgaaaaagcacgtaaatagttagaatagtgcctggcacacactgatcactcaatgattcctgctatgagggttgttaagggaaaaatgctccctctgctctggaccttcctacacaaccaaataagtggagatttccacttcatttttctcctctccaggatctctactacctgcttcacgcccacacactcattcatttcctccctcagtgttccatttggtcctgcctgaaaaacagatacccactaaccatgaggatgatgaaaaatgaggttcttcccagagcagcaagcacatcactgccctgtctttccaggcaaacacgttcacggctgggctttgagctcaccagagacacagaccattagtctcccccctgcatgccttctgctaatggaagaaagagttcactatcaaatctactaagaatcacacaaggtaattatcttgcctcaaggaccactgagagcttctaaggtttgctggcatctgtcttaattgatactgagaaagccaaggctgcctaacggatgtgtttgatagaaagtaataaaattctgagagattaaagaagaaaaataaatacaacaagaaatcagtctccttaaaaggaccagcaaggagggataaatgtggaccacaaagactgaagatcttcaaatgtcagggttagatgcacattctagaatcaagaggtgggtgaactcaacggggcaatatcttactccctgttgcctcccccagtgcctagcacagtgctatttgaataaatatttttaaac

SEQ ID NO: 2343 - DNA, 303 bp, Homo sapiens
gctgggattccaggtgtgagccaccgcgccaggacccaaggcccttaagttttaacgcctcattcttcagtcaggttttccttgctcccgcgtgttcagccaattggtttcaagtttgtgttgaaggagaaactaacaatgaaaacggagtcgttgatggaagaaaagttggaatgcagcctctggtgctgtttgagtgatccctctccccaggggctggctgcgcactgctgtgttctggaaaggcgcattgtatggtagatgccgcagaaactactctcaattgtctacaggataaagcac

SEQ ID NO: 2344 - DNA, 2106 bp, Homo sapiens
agcagcggcgcggggtgggtggggcgggagtgccgggcctccgccccctccgcctgcctttccttcctccctccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggtacgccgtgtgtacctggcggagagcggtgcgtgtgcttgagacctgtcagaactcggcagtcaggccacccggcagtcccctgtgagcagacaatctgcgttaccctacccctgtcctccgcccccttcgcacttgaacataaagagccgggcagttttttccccgtgccaggctggaaccacacaggcacgcggatccgcactgatgggctggggtgggtgcagagacgagaccggacagacgggcaagagcccagaggggacatcctaccctagtttggcacggggccactctccctcaccacctaggctggggagaatgaggttcattcgtcggatgcccccgaaccgtgtggaagcctcagtttggtgctgtggagagggtaccgctggctggccgggacgcgggacacagcgctggcttcctggccggggaccgccgctgacctgcttgggcaagccatttaaactgctcagaactagtttttctgtctgtaaaatgggcaagagtagtatactctcaagagttgcttctaaggagctttaaacggggcttcaggactgaacttaagggggcaggaaggtgaaccttagagagctccctttccattttcttgctttggactcaacttgcttgttgtaggttgcgcaaggggaatttttttgtgaggtaggggtggggatcaatataaggcatctattttctagataaaagcgtgagccactgcatccagctggaatatgaacaggttctgaattactgagcccaatgctctgccctgagactcttgctcctctaagagcttctttcctgccctcaaactgcccgttgagagcttctcagtatcctccctactccccttccctcgaagggcaagctgaatttggggaaactgcagaatgaagagggccctctccgaatgcctcatccttccatcacccagctcccatcactactggggaatatttggaaatgaccctgcttcaacaagggatcatctctcattgccttccacccctccccttcctagcactgggctcttgctctgtgctctctggtttctctgcatattcagagaagcactttgtttctctgaattgagactcttacaacatcaagtacagagtctttgcagccccaggagaaggcttctgtctgccaagccaagtcttgttaagagtcccaccccacctccctgcaagtgcgggtcccaggcaatccctcgcaagggaacagaggcatatctctgctgcccatgcctgtggtggccccagatggagagaatttcatcttggggtatgcttgggaaacttaatatccagcagattgagtttctttcagtctatttaacataaatttggggaaggggatttttaactctgagaacaagaaaatattttaaaagcataaaaactctggaaatgtgtaatgggtgtgtacgtgtctctatatgcctatgcaagcacacgtgtgtgtgtatatatacatatattacatatatacacacacaactggggatgtgtctatgtctatatgtgtttttgtatgtggttaattgcatgagcttcagtgccagacaaacccatacgtaaaccatggataactcatttaacctctataaacctcagttttcttctccatacaatgggggttaataatgcc

SEQ ID NO: 2345 - DNA, 3472 bp, Homo sapiens
ggcgagagaggaggaaccgagaacccgacctccctacctggccgactccttagttctacttccctccgtgtggagatacgaactaggtcgaatgtgggtgtggcggaagactgtggggtcaccacagagcccctcttgtccccatttttggcttagcccctcccttcttctactagactcttcatcctccgtcagctccgcactggccaccttagctgcggagcccagggactcccgagccgcaaacacattggggaacttgctcctccaagggaaggctgggccggaaattggaccctgcgcgcagcccagaggagcgaaaacttgtggaaatcggaccttgccctcggagtcctgagtcaaggacacgagtccccaagcggcacggaaaacaggtggcattcagcaaatacgtcacggcgacgacggatgcggccctcctcttggggcggccacaaggtggagctacagtgcaaccctgcaccgcgcgcccggcctccggacgcccccgaggtggctgctctcctgcgggcctcccgcgagcctcccgcgagtccttcattgccgcaggattgaagttgacacttctgggccaggcattcggagctcttcaaggccaagcctctgctccctaccactcccatgaattgtctctctcagttacattcagccacattttattcctggaaacaccctttttcagacttctgggctttacgtgtcctcttccctctgaaggagttcctgttccctgctttgtgcatcttagaagaagactttcatcctctcctgtatgaatccactcctgattctctcccaggcaggaaaatgtttttattgctctgggtttcctgaatcgtctgctgcctaggctctctactaggtggaagtgacttgagagcacagactatgttcttattgcctagcacagggctgagcaaatgcttatcaacagaatgaactctgccctctctgagtgtccctgcagatggctgcctctttgcagaggctgtcctcacctctaggaaccaggatccagcattgagtctcttcagttcagtccaggagaagtcactgctgtgggctgtgattcgggttgggaatacagaggctacattcgtggtcctgctgaggtgctcatcatgcatgaggaaggggaccccatcggagctgagggcacaaggggtgtcagagggccaagctctggggctggtcatcatgtccttcagccccccagatcccctaagccccagcttccctcacctgaccatcacatcagtctcaaacacagtagctccgcattcagctgtcttccgcaaggacatcagggtgttctcgggagccagctgggaaagggaataggtgatgaggtagcagggaagggtgggagactgggaacccacaggcctggtcgctatggtgcaaacgagcagaccctccccaccctcccagcattctgtccaacactcaccatgggggcccctcggtgtcccaccagcccaggcttgggtggtaagtctctgggttccatgatgcagggtgaggagatgcataggggggccaagtagatgaccaggacaactccaaaaaataggagcagtagcagaatcttgggacctgtggggagtgggggacaggctttcaagaatgggcaaggggagagctctggggatggaaggcagagtgcaggtggcagagcatgagtggccagcaagggtgagtggggcagcagcgttggcacctcttcggtggatacggtagaaggtatcagccacaggccaggccaggagggcaattccagcggctgctccaatatgaaggaatggggctgtggcctgtggacaagagctggtgaggtgggctcttctccagtgcccctccccgctttcctcttagggcctgactgctggagttcagagctacctgcagtcttgggggaacaggagcgagatatgttctagggttggctgcaagccaaggctcccgtctagacactggaggttggccactcacctgcagtgacacacgcaagctatgccactcctgctgccattggatgtccagtcccacaaggccagccgccacaagcagcataatgaggagcagcagcacctggggggccagggatgaatgaggcctcttggtcaatttgggctcatggttggtgagctgctccttcactctatagagatgggacccgacccttcccttcccctgacacatctgctttcctcctttcactcaacacttactgggcttcaggtcctgggcttgaccccccgggggtataaaagtgaggtcctcagcaaatagccagccaagtgctgagcccagtggccccctctcccatgcactcccatccctactgtaccttgtggaggctgtgcagatgcaggggctgtctacaaagccgcaggagcagggccaggacctagaggaagagagcagtgggacttatggggtgccaagaggggagcaaggttactgaggtgggcttcccaggctggtacttccctcctacccaagaattagccccctccctcagtggccaggatgagaatagggagctaaaactaagcaggaaggaaggctgaggtggggttaggccagcggcctccggacccaccaatagcaaggatgcatatgtgaccagtagagagatgaccagcaggaatgccagggaccagtccatccagtgtccccagcggcggaagaggaatctgtgggaggggagagggaggtgtccaagtgggggaaggggtgtcaatagtggcctgaggggaggtggggtgggtggatccaggaagactagaagggagtgaggagaaagcccctcgtggccaggggctccaaggattgaggagattttgtggagggattttctaaggagattgggtagcagcagagctgggtttgagcagctgggcagggctgggggatgactgacagtgggccacccccgggtcccagggtggggagcaggttgacaggtatgctggggaagcagggggaatccatgacacactcattgaagttgtgcaggtcattgagaaggacgagcccgatgtacagccagctcagggaaaggaggaaggtgaggaagagcaggccaaaccagatacagtcgcactgcaaaggggcaggagagaaactcacaaccaatacctacttcaaactcagagtccccaacgggtggcagctaaagggagctgcctgccccgtgttgggctgctctgctcggggggcagctctttccatatttgagggagattttcttcctgggagagagagccccttcccccaagctgtctatgagcacaattggcctccttatcccctccagtgagcctctgccttctgacttccagcctcccccctccatccctactccaccttgctggtttgcatcctctctctggggcatttcctccagtggcagctatacaggcagtggaggcagcgggcccagacg

SEQ ID NO: 2346 - DNA, 1030 bp, Homo sapiens
ggcttgtgctccatccagagctgcctgaccccgtcccaccccacagtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatg

SEQ ID NO: 2347 - DNA, 2624 bp, Homo sapiens
agatgctcagccgcagacctttgggagagtaaagggggcacacccacccaccttgcctccaggctctttccttcctattcctgttctatggtggggctccattgcgagacttcagattgagaaatcagatgaagtttcaagaaaaggaaactggcaggtgacagagatgggtggagggactggggaaaggctgtttactccctcctgtctagtcggcttggtccctttagggctccggatatctttggtgacttgtccactccagtgtggcatcatgtggcagctgctcctcccaactgctctgctacttctagtttcagctggcatgcggactggtgagtcagcttcatggtcttggattgacccagtggggcacatatggggacaatggccataagatattgggaaatgcttgttgaatgggaaaatgctgatgtggggttagcagggatagttcctccaacacagcagaacttggccctgtgcttctctggccagctttccttaagatactgaacaggccaaaaatggggccaagatgctctaagactgagccaccaagcatgggtttgcaatgagctcattctggctttgaggctccctgggaatggcagtgtagagcctgctcctctccctgtcctcaccccacattatcttggctcctcagaagatctcccaaaggctgtggtgttcctggagcctcaatggtacagcgtgcttgagaaggacagtgtgactctgaagtgccagggagcctactcccctgaggacaattccacacagtggtttcacaatgagaacctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaa

SEQ ID NO: 2348 - DNA, 543 bp, Homo sapiens
ttttcaaattcagatggtgagaactggtctgaatgtacaattcagtcttactgttttccatcaaggtgtcaccaatcttccagtctcccaggcagaagtttttgagagacaaatggatggaaaaactttttggccctcttccttaggatcagaaggtcacagaacgttttcctgaatcggattctgggttaaagctgccagtaggaagaattcacatgagatttcaaaggtggaagagaaggagaaggtgtttttttcttgcaacagtttggctggggagctgagatcttcactgagggcttcctttggctccgggttcccgtggacaggcagccgatgtcatcagtggtggcttctctgtgatcactataccaccaggtctcctaaagtggccttcttgacctttgcctccccagctctttcaatggttatgtgaaactctaattatgtacattaaatatctttcagctcataatacatagagtcatttccctccccacatatggagtaattctgaatgacataaaggcttaagcacgaagg

SEQ ID NO: 2349 - DNA, 15115 bp, Homo sapiens
ggtcactccggggtggccaggaccaaatgtgcctccttctggcttttgcaccgcaccaactaatccgcgccaggccgcacagctgctctggccttcggggaggactcctggagcgcggtgtacactgctccggagtccctccgcaggagttgaggcagcgagttccgagggcggggtggggcggaatccggaggcacgcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttagagttacttgttattggtaaatagccactatggagactaaggaccagaagaaacaaagaaagaaaaacagtggacccaaagatgaaaagaaaaagaagcggcatctgcaggatctccagctaggagacgaagaagatgcccagaagagaaatcccaaagcttttgcagttcagtctgctgtgtggatggctcgatcctttcacaggactcaggatttgaagacaaaaaagcatcgtattccagtggttgatcgaactccactagagcccccaccaatagtggtagtggtgacggggcctccaaagttggaaagagcactttgatataatgcctcattcagaacttcattggcagaagttgactgagatcagaggccctgtgatgatcgtgtcaggtaggggatgccaccacagacatagagttggcatggctgttgtcatctgagggacatgcgtgtgtttgttgttttcttgagtggaacatgttaaattttgtcatatcatgttacttctcttatgcttttactaagttagctataacttcagaaaagggtaagttcccagagataaggatgtgatacatatcttatcctgactgctgtatggctttgccaagcatgttccttggaagggcgtagcaggcctggtcactgtgaacatatcatttaacaaatagcacgtacctcctatgtgccaggtgcacatgcttgcccttacgaagccacatgctggtggaagtgcgcgttttctctttttcctgtgagaatttgtctgctttgggagatggcgacctttccgagtgtgagggaagatgaaacaaacttccagtggtagaatggcaatgtacactctgaaatctcttgttattgcaataatatagttggattgaggcttttctttatctttggagcttccatattttcttttcctttttttttttttttgaggcagaggcttactttttatgaaaaaaagttcataaatatgtattgatttttgtacacatggcacctctcttctttttttttttttttttgagatggagtctcactctgtcacccaggctggagcgcagtggcatgatctcggctcactgcaagctctgcctcccaggttgacaccattctcctgcctcagcctcccaagtagctgggactacaggcgcctgccaccacgcccggctaattttttatatttttagtaaagacgggctttcaccatgttagccaggatggtcttgatctcctgacctcttgatccacctgcctcagcctcccaaagtgctgggattacaggcgtgagccaccatacccggctggatgttggtttttatcaaaagccttttctgcatctattgagataattatgtggtttttgtctttagttctctttatgtgacaaatcacatttattgatttctgtatgttgaaccaaccttgcatcccagggataaagcctacttaactgtgatggataagctttttgatgtgctgctggattcagttgctgagttttgttgagaattttttcatcaatgttcatcaaggatatttgcctgaagtttcctttttttattgtgtctctgccaggttttggtatcagaatgattctggcctcacataatgaggtatgaaggagaaggagtccctcctcctcaattttttggaatagtttcagcaggaacggtactagctcttctttgttcatctggtagaattcagctgtgaatctgtctagtcttgggcttttatttttttttattttttttattttttggtaggctatttgttactgattcagtttcagagctcattcactattggcctcttcagggattcaaaatttcttcctggctcagtcttgggagggtgtatgtgtccaggaatgtatccatttcttctagattttcttgtgtgtgcatagaggtattcataatattctctgatagttatttgtatttctttggagtcagtggtaatatctcctccattgtttctgattgtgttatatatggattttctctcttattagtctagctggcagtgtttctattttattgatttttttgcaaaaagccaactcctggattcattgatcttttgaatacttttgtgtttcaatctccttcagttcagctctgattttggttatttactgtcttctgctggctttggggctggttttttgttggttcttttgttattttagttgtgatgttaggttgttaaattgaaatatttctaactttttgttgtgagtatttagtgctgtaaatttccatcttgacaccgccttggttgtgtcccagagattctggtatgttgtatcttttttctcattcgtttcaaagaacttcttaattttggccttaagttcattatttacctaaaagtcatttagcagcaggttattctattttgaattgaacgtttatgaaatgcttaaacattttaactagccttttttaaagtgcaatgagaactattaacaaagagataatagatacatgaaatgatgcttatcaatttacctaactttgcatttttctgtcactactattttgtgggagtctaagtctctttgaaggtctctaagaacttgctttatgaatctgggtgttcctgttttggatgcataaatattaatgtttagaatagtgaagttttcttgttcaatcaacactttatcattatgtaatgcccttctttgtgggccagtcccagagaaagcctgttatatttcactcaattttcttggaaacctctcttgtttaaagtgtattgggacccaggtgctatgaggtatattcttattccccacctcaaaatatgtaaattattgatactgttaaaagaaaaactttagacaaatttaagagagtttacttgagaaaagaaaaaaaatgatttgcaaatcagcccttagaatcaaagaaatttcagaaagactttggcactgtcacatggtcaaatatctatgggaaaaaaatgtaatgtgcagaaaccgaaactgaggtacagaaatagctggattggttacagctcagcatttgccttatttaaacaaggtttaaccagttggccgcctatgagtggttaaagtatagctactgggattggctgagactaagctgttgttacggggacacatactactaaacttagacttttagtttgtttacctgctaagtatgtgagtatggagatttttcaggctagattttagttttatttagtaatacattatgggatctgaaggacacttttgtaaaggttgaaacaaacatattttatgcacatttccatttccgacaaaagaaaaatgctcctttagctctgctaagtgtgacagtttctaaattaaaagaacattatttacatctcaattgttaattctaatattaatttcaagtattaataatataatcatttttcactaagccttcccttttatgcccgtttacactttcaaatctaattatattccattttcattttaaaggtcaagccccaactgtttcatggtgtgccttctttctaatcaagtatttgagaccagtgggagtcaggctggaactgtatcatgtcaattttcacaagctgacattcacagtaaaagtagttcttgattacttccctaacacctttgatgttaagggaaaaaaaaacaacaacaacactgagctgtgtatattccctcctcatgctcctgggtgagaaatcatagttagtagctgctgatcttggaaatcagagtttcggctacattgctagcaataacctaaatcaatacagaataacaacacaagccagtatgtggtaagtcatgaaaaatagatcggtagtgatatcaattgaaaatgatacagaaaaaccatattatctagaaagaaaaatacaattttataacactcttggtcctgaatagttttaactatggtacacaaagcaagcaagcagcaaattacagataaagatgactgttactttctttctactgttaacaccctctggtaatagattgtaacagaatgactatttggagggttaagcattgggagatgtccctaattacatagcatgtttggtaacatcatcacattttaatttgcatagttttgctgtttttgaaactgcatttatgagattttggggaacagggttaaatggtgacagaatagtgtcctttgtgagtatgtgaaatggaataattgggataaataaatagggtttatgtttcatcttcacttcatctccaagaagtgaagcattatttgtaccattccttacattttatatattttaggaatttataaggttcttgtttaaggtagggtagtaattggaacatgtttaatatgagcaattttgaccaactctcttatttttacatatattatatatatatataacgttgtgagaattatgtagacatttaagacttcttttttcaggctttgatactgatttctgaaataaatatgctccataaaaattcttgcaatttttaatagttatggactttcaaatcagttcccaaatacttagtattctcactatacttttttagaaagtatatatatatatatatatatatatagagagagagagagagagagagagagagagagagagagagagagagaaaatcattacagctgtgaagtattttatttccctctgttgagattttgagagctattgtagcctttcagagcttagatgagctacctgaggaattatttgcaaagggattgcaatcctaatttcagacaaaacaaactttacaaaccaacaaagatcaaaaaaacaaataagaaaccgtatactcaagtgatggaaatggaatatctcaatttatcaaatcttatagaacttttcataagaaaaatatattttctttagaaatgcgtacttgggaccaaattgtatcacttaatattatttaatattttaactatgagatttttctaggacttgactttaatccttagtgtatcattgattactaattcttgctacagtatgatgagggcaataacatgtttgaaaatttaaccttaaatttttgctaattctagtggtagcaaaatatttatatacccctaaataaattttgaggaatcaaaggattgatacataagtgaatacatataaaatgttgattgcaaacaaaagaaagatgattgtctgagagaatataatttgtcagggcattttatttgcaggacgtaataaaactggacaataatatctatctcatacagtccttgtgagtattagatatattaatcttataaagcatatgaaagaatgcttagcacatagtatttgctatatgagtgttatttattatcaatagtattcttaagtatctagatttagagctaccctgaggctctactgaatacagtatgtaagaaatttctcattgtaactttcccttttctgttttgcacacatttcttgtgggattacttgaagaaatattctcagtattgttccacatcaagatggccactagtagcactgagcttatgtcttactagctaagctactttttcagaaaatgaacattgttttcctcaataatttcaacaaaatttctagttaagtttctcaatacactaggttggatcatgagcatattacaaaataaaccatatggttaatctttattttggacaggttgagacatattatgaccactgcccatgatgattaggtccattgctctcacatggtgtgaactagaagtgaaagagaggtagaaattcaaaaaagattgaaatgctgctacagaagaaaaagaaaatactgaggtctctgtaatcacagatatttatgttataagaaatcaatacagattaaaaattaggtaagaaaattgatttactaataatcttgatctttagccacatttctctgaaataaatttgctctaatgctgtgacggggatcagcaagctacgttttccaagttccttcaagtgggatcctgctaggttctgctattgggaggtactagagaaacataggcaaaagaatggaagaataggtctccttttcctgtttgtttgctgtccttgccgatattctcccaagaacatccccttgcccaaggagcagtaattgtttcagtttaccaattttttcagagccccagaaagtgcctcttcagaggtaacagcagcagttggaacatatctctccctcagaggtctagcctcagctcaggaaggcttttactctgagttaacaaattttaataactccagtctcttccctttattcatctaagcttctgaggaggtctgtatgtggccaggagatggtggtgatagctgcatcttgcagtaattttctttgctttccacagtgttgttacttttttctccgatttcttatgtggtcaattttttaatattaactcatagtcatagtgtagtattcatgctttatgtgaaatgaaatgttttttataatgtagccatggcctaccaatagcatattttcttttagatttggtgatatatattttgcttcagtgactttatatccttatttgttgcccaaattagttttttgtatacaaaacatccactattaccctggtcccatcatttcttctgttatccattgtcctgtgatttctcctggaaagtgaattgtttatccgtccatttcactctgtgaagtcatacaggtctatctatatagaactcctgtgctccaatttattccctgtgtgaaactgggcaatgtattaatctgggaatatgtttcttcatatgcaaatcagagataacacttacctcacaacattgtttagagcattaaaagaaatataatatgatatcattcacacagaatttccctgggtgtgaattgaacaatgtcaatttttctcccatttaatgtgaaaactaactatataaataaacaaaaaaaacaaaaaaaagaagaaaaaatcaataaaaattattatcaaatgtatacatattaaaatattatcgagtcttatacaaattgagtttttcaaaaataataatgattgtaacttttatattgcagttaatgcaagaagcattatgaaggagaatcacatgtctagagcaaagtgatgttaatagtgtttatgtttgagccagatggaactcctcataggagcacacagtgctcacctcctcccaactttgcattcaaagaaatcatattcataagccaaaattggtcatagaggaaatattcaacaccactaaattaagcaaactaaaaatacagcagtttttctcagtgaactggttgttaaatacatactaaatcaccactaggtggtataggccctcataaatcgcaaaataaaaatgggactgcttagtttctattttgttactttctttatttctgaagagaatgagctcaaattttaacagcagagaaaaaaatatagttatgagagaatcagactttcaagtatgtggggctattttaaggaaggacatagatgttctaaatttatcctagccaagaaaaaaaatgtgcttggttggctacaaatgaaaatcaataaaatcctcccataggattattgatcagtctaaaccaagtgtcaatttttttttttttgtaaagggtcatattgtaaaaatgttggtctttatcagcctgtttctgtctcaactaacaaactctgctgcattagtgtaaaagtaaccataggcaaagaatgtaaatgtaaatgaataaatataattgtgttctaataaaattttatttgtatatcaaaatttaaattttagcatgtcatgataagttattctttgggtttttttcaatgagtaaaaaatgtataatctacatttagtttgcttgctctactaagtgagttgggggccagattcagcttgaggagggtggctagctaactcttagtgtaaacaatatatattatttagtattcctttgaagtgatcaacttggttataatcatggtaagctggcaagtgagttgtaagataaggactatgttacttaagttctccagagaaacagaaccataaatgagatagatagctgagatagatagctaaggtagatgtagacatagaggtagagatggagatagagatagatgagataaagatacagatgatagagatagatatagatgacacagagatacatatactgatacagatgagatagatagagatagagacagagatagctagaagaagataattcttgggaggaattggctcacaaggatgtcgaggctgagaagttccacaatctcctgcctgcacgatggaggcccaggaaagttagtgatatagttcaacctaagcccaaaagtctgagaaccaggtgttccaatatcggaggacaatagaagatggatgtcccagctcaagaagacagattaaattcacccttcctctgcctttttgttttatttgggctctgaatagattgaaggatgcccatagatactagtgaggatgatcttcttcacccagtctacctattcaaatactaatttctctggaaacacagacacactcagaaataatgtttcatcagccatgtgggcaacccttagcccagtaaaactgacacatgaaattactcatcacagggaggtctgggacaattcacgtctttgttaatttaaatagacacatgaagaaattatttttcctctatcttttttccttcttctttctctttctttctttctctctttctctttctttttgtttttaactaaaggacattttgtaagcacatgaaaccagggaattgcagtagccatatggctactatgaggtgagaaaaaggaacgtttttgcatcctgcagatctgccccatctatggtctttgtgttaactgagacgacaaatacgttactgtctaagcttcctttagtaacgtcttccactacctttatgttaaaacattttaaaagataaaattaaaaatataaaatgttgtccttttagagtggaataaagttggcttccataagctccgatgtgaattttacactgattctggccaaatttttcagacaattttagaaaattgcctaaaaatactctgtaaatctagtgttaattattagacattatttttttcaaatgttattaatattatagtgttagatgaagaaagtataatcactagggatgagtttaatttccttaagacagacagatatcaggatcctctaataatacattaaaggcccactaaagtcagaggtatgtatttggtaatgtacctcactatattcttgtggacaagaaggagcaatatggattaggtaatggaataatttggtaaattatttaatggttaatagttacatattactaacaaataaaatggttttaacctgaaaaattcatttttgtttatattctgataacattttcatcagtgttttagacatgttcatctgtcaaacacatgaaaagtgaaacaactctgaggattagctaataggttgataaaataaaaacctatatggatgtctgtgtattataattatgaaacagcttttagtcaataaaactaaataggaaagacccttaaatattacatatttaacaataaaccacacacacataatgacaatgctaggatgagagacatatgttttaaaaagcaagattttactacagcaagcagtgtttagctagctaggctgtaaaccaagggttggcaaagtatggcctgcaagccatatccagccaatagactggttttgtaaataaagttttattgcagcatggacacactcattcatttgtgtattgtctataaatgctttctcactgcaacagcagagctgaatagttgtatagagattatatggcccacaaaacctaaaatcttagcctctttccctttacagtaaaggtttattaatcctgcctaaaaacaatttagcagagtaatttggctacaaggaaaataatgaatttctcttatacgtttaatgtctggacaaggttaatgagagctatgtttttctccaggtagagtatcctggacgtgcagtttaaaaaaaaaaaagcatcacattttgagagtctgtcatttgaaggcatggtctagtctaatcatggtttatctcaaatgtaagttcagaaattgtggatgttacagcaagatataatttgactctaaatcagcaagtactttcaaatattcagaactatctggaagtgaaacagcttcctctgtagacagacagcaagtttcttatcccagagccttgtagatagaccatctgtgcaggttataatcaggagattcacaaatgtggtaatgatgacatagtcacattgacaatgaggcttttagtcatacagattaaatatatactctattgtgcaaacctcctagtaattgagaataaacttaatcttgggctgcaagtagatacaaagtattcccagttagattttacatgtatacattttgaaactattaatttttttaaaataaagcaacgactttaaaaaaatttttatttattatttatttatttatttatttttatggagtctcactctgtcgcccaagttggagtgcagtggcgtgatcttggctcactgcaacctctgcctcccaggttcaagtgattctcctgcctcagcctcccgggtagctgggaccacaggcatgtgccaccatgcccggctaatttttgtatttttagtagagacagggtttcaccatgttggccaggcaggtcttgaactcctgacctcaggtgatctgcatgcctcagcctcccaaagagctgggattacaggcgtgagccactgcacccagccaattttcccatttttgacacactaattctaaagtaaactttccccttcattacttgaagatttatttcaggtgtttttcagttcctcctaatttcagctcctcagttcatatttggctcacattaatgatggttatctgttcttgacacatagaaaatacaaatataggacttttactgaattctattttttaaaaagttctaaggaaaaagctattacatccacatatatgtgtaaaatgtaacatggacctaagaactactgtgaataaatagcttgacttttaatacaagagagtatattgaatttaaagctaagaatctgggaattctagagtactgtctgctagaaacattattatgtcaaaaataacaaaaagggttatttgacatgatttgctgatcactaagcccactgagggaagccctccaaggtttatgtgagaagtagtcagttttttactggtgcagaagaaatgctttttattgctccaaggatggcactgagccccacaaagcaaccactggggaatatcaggttaatagcatgaatctgtggttataaaacaagcacactgttttaaaaacatatttaaagtaattcatgagttggatgtttcctgataggtatacttttcagtttaggcatttaaaaaaaagtctgcagtgtacctttattttcacttttactttggtgttttgatgtctatagaaatgagcagtttctctacttctttcccagaaattaatctccaatgctgacgtgagcacaaagaccttatgtactgcgctgggaaatatgttgtgttttaagaataaaaattttcattagagttagttcatgcatcacagatattatccttcctgacaagaggaacactgaagcacagacactgtgttgggctgtagttctcaatggaaaaattaagcttttcaaaatgttagtcactgccatgctagatgtttctttaagtcatttttactacctgttttgatagattctaagaatcagtcttacattgtatttttctatggcttactgttaaaatcttattcataaaaataactatcacgcatggaaatagtatacaccaaaatcataaaccagaaagtaatttatatttaaccctcataacagtacttcaaagtagaaattatctcatattgtagaggaaacacaggctcagataggatataaattgcccatatcacaaaactagtaagtgatggagctagaatacaaacaagatctgcctatttacacaaatcaataatttttcctctataacatgttgtcattacatgcctttggttttcaagtgaaatgcactcaacttcacattttaaaatatgccacaaatgtacccataaagtaagtgaacttgactattgagtgggaccacaattattaaaaagtttgccttgggacctttgaaacaaagacagtatagtgaccctcggggaactgagttacatgcccaagtccagccaagagatggaacttgtgggacctcaggtctcctgctccagtctaagtccagctctttccttccataggaaaggaagaagaaggaaaccatggctcctttggcactttagaaagaaatccgagcaatccaggggccaaagctcacacaggcaatgagttctcttcacctttgtctggaccactgtacccagggctcatggataatcctcaagccctgtgggctgtcaagtaggacgtgcctaactgctaagacttgtgctaacaggagctctgggacctcagggagaatgggctcgcgttcatcttgcacctgcctttgttttagcactgatctaactctcacattttttacccaccagtctccctagtagcctgaaagtcattcagagccaggggttgtgatggtcccctctgtgtccactgtccccagcacagggtccagcacaccacagtgggtagcaaatgctatttaaatgagatgggatgaaattcccttccttcactttcttcacctcaaggtaaggaccatgttcctgtttccatcattccctgtccttctcctgtctgtggtgacagcttcctgctccaaaacaaaagcctgtgcagatacccagaagacctgctccatgattacctgtggcatccccgtcaccaatggcaccccaggcagagatgggcgagatagacccaagggggaaaagggagagccaggtctgggacaggtttctgtggcttcctaaatctccacctccggcaggtgttcaagcaaatctgtgcttgagcctgccacacgagggttaaagcacagacttggggaggctcccctttcatcaggacccatgctacactcagaacaacccctgtaaaatgccattgcctccaaaacaaagctgttcgtggactctctgggatcccatatttccacacaggaactgggggtgtgtggttgtcccttcagaggggtgtcctgcctggttggggagctggccttggtgcaggccctccactaggttgcaggagagtctttcttctttgggtcagatcactggctcattggctgtgccgggggtgaacaggaatggagcattgagcttttggggaaaaaaaaaagagtgacagccactgggtcatcttccctttgtcttgcaacaggtcaagggctcagaggtttgcagggccctcctgggaagatggggcccccaggaaacacagggacttctggaattccaggacctaggggccaaaaaggagatcgtggggacaattcaggtaaggggcacacgtcagcatgtgtggcctgggggtcccgggcctggggagctgaaggaccagctgggaggtccccttttccttcttctcctgctgcctcatgggaagatgcccaactctgcatccaggcccagtgcgcctggccctctcaactttacttggggcctgaggagactcccataggtgcccaggtgcagacgttcaagccatgtagggccattccctcatcaggccccttagcagatgggccctggcttctcttcagtggaaacagttcagtgtgcacctccggggtgccagggaagaaataaggccctttagggggttgggtttacgtccattgtcacaagagtggcacgaaaatgttctgcctcttaggacccctggctgatggggaacatcacagccaacttagttcagagtaaaatagagcaaaattcagtaagaacaaaacaataatgacaatccacttattcatatttgtctaccagcctgtcaaaacaataaaggtatttaaaagtgtatctggaatgagaaatgagaaagaattacaagaaaaattttcaaaaaggagggtaatgagttgagtattttcttatgaattcttacaatatgacaatatgcaagccatatgtggagacgggggtccaggactgaagttccaggttgtgaagggatgtggaggtatagctgggaaggaggaatgtagtcattttcccctttttatttcttctgcattcttattttcctggaataagcattcttcttagtaagcttttttcaaaatgctccgctctccaaattaaggtcttctccataaataccttctccctattgcgttgcagttgctgaggctaagctggccaacttagagagaaagctatagagcctgagatcagaactggaccacacgaagaagcagacaggatctccgtatgttgtccaggctggtctttaactcctgacctcaagtgatcctccccaatcagcctcccaaagtgctgggataacaggtatgagccaccatgcccaacttatttctattattgtcatttgttttatatttcattaatttcacttttatatttatttgttttgtcc

SEQ ID NO: 2350 - DNA, 496 bp, Homo sapiens
tgaattattaacagaggttactttgacaggagggaggaggatacccagcgataacattcttggaaagcaagggaatgagagcaagatgcattatgtcacaaggagaagctctgggctggcatgagagcccacgtggtatctgcaccctccagtttgctgctctcagcctcttgaattcttcccagtatctgctctgaatccccagagctacagctccttcgaaatggcattagtacaatcaatagaaatgagttgcatgactatggaaatgagagtgaccttgggtcatgtagctgatcatcttgtatccaagaagtatttctctcaagttctcctaattacagattcagcagcgggtctattgtgactcctgattttagagtgcattctacctgacacgcagtttctcttacagtaaccaggaggataataaatatttagtgaagagctgattgagatcaagtaacatgttccatcagtactacctgatgtgccc

SEQ ID NO: 2351 - DNA, 4833 bp, Homo sapiens
caggaatggaaacgaaagtggaactcggcctttccctctttctctcctgcagacgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggtcagtgaaagaattgcccttggtattggggcagcaagaaagaggctaatactaattccatgtgtgtgctgtttggatttgaatgtaatttatgtgtatctcagttctgactttgaagaacacaggaccgttaaggtaagtattcagtgggaaaatctgccaagcaatgaagtaggcttggttggggagagtgagaggagaaagttgtaccggaaaatgatggtgaaagctgctaccgagactgagaacaaagtctggagcttcctagagatcagggaaaaggggaaataaggtgaggtcacagaagggaggcaagccatttaacagagagaagactttggtcatgttacccaccccttgcaccatctcttgggagggcgaatttattgttggtgtctcataagagggtccatggatagcaaggacaaggtcctcaaacaggttttattgaaggagcctgctcaggggctgtgtgggagcctctggatgggaaggggtgggtggatgattcctgcttcttgtcaaatcctgtccaggaggtgcccatgaagatgggcacaagtcccgcccgcttgtcctgacctacgtgcggcccggtggccctgccgacagggagggctccctgaaggtgggcgacaggctgctcagtgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggcctcagaggcagtgaaagtgcagaggagtgagcagctgcaccgctgggacccctgcgtgccctcctgccacagcccccggcccggccactgcaggatgcccacctgggccacacctgctggccaggaccaaagccgatgtaatgtgcctgccctgctgtagctcagccagtcttgtagcctttcctagggagggggcgatgcctgttgtctaagggaaggaaactcagactcagagattagtgagctgggtgtggtggtgcacgcctgtggtcccagccactcgggaggctgaggcgggaggatcgcttcagcctgggaggttgaggctgcagtgagtcaagatcacaccgccgcacttcagcctgggtgacagagcgagacctcaactaaaaaaaaaaaaaaaaaaaaaaaaaagagagagagattaggtggcctgcctcattgtcatctagcatgccagtggcaagattggccccgtccctaatagctgagtttcacagggtctatggaaaccctgcagtctttgagacccagagaggaaagggacttgcctgaggtcacacaatgagtaactgatgtgaagggggaaggcatccccatctctccctgtggttgggtggcttcccagcacccactgtgtggtggggtggagagcctcggctggggttcacggggctgtgctctcatctccccagccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgtgtaagctgtggtctcttccctcctccttgggctgcttgtatgtctgagagtgaggcttgccaaagggtgtatgtcagggcgaggggaggtattttgggcagagctccaggtgtatgcgtgggaatgttaaataacatgagtggaacaccaggctgtcatggatggttgggcaggttgtgcactgctcaagaggaccactgagaggtgccagttactttgtacacttttattcttgtatttttattatgaaaaattcctaggatttggtgataacgtccttgaggaaaggaagtcttttcagatgtgcatgaagttttcacattttttgccattcagtcctgattcattcatggataaagcctcagtgctgcgttactatatccttaccacctctctgccatttgttaatttcccctaagacaaagacatggcctgagactctagctgtccagaatgtaataatttccagtcttacttctctgcttatttattgttcaaaattgcccttttgaaataaagatatttacatgttaagaaaagtaaatcaatagaagacaaaagtagtgaatgataaggcaggagccctgtggaagtggcaaaacacaataatgcctaaaattttgaaacccttcttgggaacagtctttcctttgttgatgcagaaagggttctcagcctcctgccacatgagctgcagaggcctccaggaaggatagaagatcaaactgggccatttgagatagaaccaggtgaaagaagagaggagtacaggtcacctggtgtctgaaaaaagctaaatatggttctacactccctggcagccaaagggaaatgggaaacagatttcagtcagatgagagagaaaatatatctctactaaccacctttcctggccaccaaagtggggaatatgtagatgaaaagatgcagaaatgctgttcgtaggtgggggatgtggagactggaggctcttgcgactcctctgcctgtctccttcctgggatgtgtaactaagaaagtactatcattattgctgttgatagtaatttattaattaattataattaattaattatggggcatagtactgaatgtacatactatggggacatagtagtgaaaagaaacaaataggccaggcatggtggctcacgcctgtaatccccacactttgggaggccgaggtgggcagatcacttgaggccaggagttcgagaccagcctgaccaacatggcgaaactccatctctaccaaaaatacaacaaattagccttgtatggtggcacacgcctgtaatcctagctactctggaggtgggaaaatcgcttgaacccgggaggcggaggttgcagtgagccgaggtggcgcttctgcactccaccctgggcgacacagtgagactttgtctcaaaataaataaataaatacatataaaaacacaatatacctaaaaacataacatattacacattttgtaatgtataatatacaatataatttaataatataatatgacacaataatataattagtaatgaaataccaaataaattttgtttgataaataataaatgactttcaggattcatattaatgatgcaaatatatttcatatatggaatgtaaaacaatatttattaaataaccttatgtatcaaatagttaaacatagagttgccatatcacccagcaattccactcctaggtatatgcccaagagaagtgaaaacatgtgtcatctccacctaaaaacttatacacaaatgttcatagtagcattattcactgtagccaaatagtggaaggaacgcagtatccaccaatggatgaatagataaacaaaatgtggtgtatccatacaatggaatattattcagccacaaaaaggaatgcaattctgacacctgcaaaatgtggatgaacttgaaaacattatgccaagtgaaagcagcctgtcacaaaggccacatggtgcatgattctgtttatataaagtgcccagaacaggcaaatgcagagatgaaagtagattcgcggttgcctagggctgagggacataggaagatctttggggatggctgaagggaacagggtttcttctggaggtgatgaaatgttctcaaatgcatcgtggtgatgtttgcataattgtgaatacactaaaaaccactgaattgtacacattaaataggtgactactgtggtatgtaaattatatctcaataaacctcttaccgaaaagcagagtgacataatatagtagatactacagtagatcacagcacaataatacaataaaatgacactgccccccagaacctgctttacagcatgacagtcaatcccagccactgtcttccctagtccttgccacaccccacgaggtgggaatcaacgatcccattgttcagatgaggaagc

SEQ ID NO: 2352 - DNA, 1963 bp, Homo sapiens
tttgaaaatcataatccaaaaagctatttgaaatactgattttataacttaaaattcattatctgtcttaaatattttggagggtagagggaagagtgagggaatagaaagattggaaatggcaaagctgatactggggggaaactgcacatctaagatccaagatccattataatgaaggccctttagtctctgtcacctaagaaaaggaaaatctacaaaaaaaagtatataggcagaacatgttcacaaaggacacatagaagcaactgtgggttctggtggacaatcagtatttaaaactctgccctggaaattgatttaatgatacgttggttagaacattgaaaacaaagcaaaaccactccacattgagcgtcccaaacccaaagatctgaaatggtccaaaatgcaaaaccttgtcagtactgacctgatgctcaaaggaaatgctcactgaagcattttgaactctagatttgagatgctcaaccagtataatgtaaatattccaaaatctgaaagaaaaaaaaaatcccaaatccagaacttaatccatactgagttgtcttttttctccaacataggtaatttgtatagcacttatactcaaaacattcttatgagcattatttcattgaatagaataacctatacctattcccagtctagggaaattctcaatgtaactgtgagacaatagctgatggtcacactagtaagtgaaatttttataaacagcaatgaagatgggataagtctaaatttgtgtccatagtctcactaaaagtggtttaacacaaatgttgacaactgctagtgtgaaatgacatagctctttgcatctttcaaagtattttgtgatctgatccacagaaaagctctaggcaggaagctatttattaaaggtgaggattcctagcaaaataatatttgcaactatatgatttgttttaaaattaatcatgtgatttgttaaacctacatatgggggatagccaactaactacactttggaaaagtcttaaggcaagaaatacatttactatgtaaaagagatataatagaactctgttgcatagaaactttatactgtgattagtttttaaaacaaggaaatcaagagctctttaaattgctgctccaaaatttattttgtaacagatttttctaagcttataaagaagaaatgaactggtaattagaagtgtacatatatatgtatatacacacacatacacatacacaggctgaatattgttcatccgaaatgcttggaaataagtcttttggattttggattttttgaatttttgaatatttatatttactggttgagcatcccagatatgaaaatccaaaatcccaaatgccccaataaacatttcttctgaaggtcatgtcagcacttaaagttgtggattttggagcatttctaacaatggatactgaatctgtttgtgtatacgtgtgtgggtgcatgcttgcgtgcatcaaagtcatttgtaggcacagagctcccttctgttccttaattttcagaaaatgataccagtgaatctgaggaagaaaccagacatgtaaagacagggactgtaagagtaacaattagagttgtacaacgggaaatgctggctcttccagtcaaggtgacttggaaactttatttgtgtagtgaaataagggaaatctagagtcaatctctttttgacagatgagctgattaaagaaagttggacaggcttggtgtgagccatcgcactggcggtaatccactctgaagcctttgagtataataaacttacttctttgaagtttattcttcctgtggccagtgacttctatcataccattattcaacatatacttttttttgtttttgtttttgagatggagtctcgctctgtcgcccaggctcgagtgcagtagcaccatctcggcccactgcaagctccgcctcccg

SEQ ID NO: 2353 - DNA, 1136 bp, Homo sapiens
ggttggagtgcagtggtgtgaatatggtttactgaggcctcaatctcctgggttcaagtgatcttcatatctcagccttctgagtagctggggctacaggtgtaaccagaacagctgcaggtggggccaggaagggcaagagtggatcccaagatcctccaggttgacacgtcactcctgaaaacattctgctttaaacagaagccacttcgctgctctgacgtgaatttctataaccaagacatactcttcgacctagagagatcaaggcatgaaaaaatggaacttctcaaggatgaggaaacagactttgagaggtaaaataacacgacggaatctatgcactacctgatggctgagctgggacttatccccaggtccagtggcctctagagcacaggtgtgttactaccaccccattctgcccaagtgaagcaagcagcagagaaataatatgcaggtttgctttccaaggaacccaaatgaagatagaatgactcaaagagaagatgtatagaagtacttacagcatgtggcacatggtctctgtgcctgggcaccaagcagactgtggtatcaattacagtggaccctgtgcatccctcagccatccaggcaggtgcagacactcctcaggctagggatagcctcaggagactgactcagccagaaggttgccctggagaagaccaggtagtccctgttggcatgctcagaggacgtgtagatctctcatggatggtcaggacaatcaccagtaccaggatatctggatcaggtaaaagatattccaagaggaggttcagttcagaaggcaaatggggcagcaatcagcactgagatccctgttcatacacaatgggtaagagacccagggacctaattcagcccaagggaatgggttcaggtggcgtctgggtgagaatcagggccagcgaccatcatctgggactgagaggacaactcaattcagaggcagaaattcagatttcttgaggggcaatctagcatttatctttgaattagcatgaattcttatagaaatgcagtgttgctttatatgtatatgattttgagtttacacaaatagtacagtattatgaaccttgttctgtatttcactttttaaatcctag

SEQ ID NO: 2354 - DNA, 8268 bp, Homo sapiens
atggggagggccggcgccgcggccaacggcaccccgcagaacgtccagggcatcacctcctaccagcagcgaataactgcccagcatcctctgcccaaccaatcagaatgtaggaaaatctacagatatgacggaatctactgtgaatctacctaccagaagtatgttgaaatctttgtgagtcttccttctggctcgtacatcagtgcttgtggttgccagctattcaaaaatatccttgtattgaaaccttctttttatctaatttagtgggggagaaaaaaaaacaaaaaaacaaaccaacaaaccaaaccaaataaaaacaaccaaaacaatttgcctctgagatcaagacagaaaaaaaatgtttatttttttgaaattgtggtctaaaagttttttttaacgactgtattaaagctcttaggtaagcttctttatattgcaataaacaagtacttatatgcaagaaaatctcggcaaaatacattgcacaggtgctacgcatcttagggatttgaaaggtgtgttatgtataaattagctgtcactttttttcaatcctgtaatggaatgatgagttgtaatttgcataatcctttaagaagtcaaattatactgtcatgtagcagacttaacatgctagctaagatttcagagctttgcagctaattactatgtaccttacaggacagttaaattgaagttgagtcctctgtctttgctgccatttgctttgtccattacttaacagaatctgcactttgggtaacgaggtgttgttactatcactgaagtaaacactctgctctgggaggaaatggcattttaatatatcatagttggacttgtattgcttttgctgtgaagaaagttttcttcaaaaacagtaatccaattggaatcttccccaaaaaagatgaaatttatgctttccataaaagttatgaaatattgattgaagcaacattaacctttaattaaattctcctatggaaaatggaaagtaatgtaaacataattccactgaaggcattatgttttctggatatactttgcaaatatactttgttgtgtttttgtcttcacactcttaacttcttttgtagtagtgtgactattgaacaataccatttttttccttaaaaaatcctttgtgaatgcaagctggtgagtcctactttcatttactcctccaactggttgtagagcactttctttcatggtttccatttttaaaaaatcagaaattctggtggctgtgaaggctgctctctgaaatagacacaaagtggatactggatggagctgggactgttccctacctagcatggtttaggtgactgtatcactgtatctttactatatacatgtagttatctctggctttatttattgatatttcactgtctagatagtgttactagttttatccgaactggtataattataatgcagaattgttactgatcatcattttaaaaaattctttgttatctgtgagtcatttattgtggctcttggtggccaggtttctgtaatttgttagtgatttgtggatttgttgtatactttgaaaaatccttttgttgtataagaagagggtcctttaaggaccaaattaaagcaggatttgattactgaccattcaaataagtgcatatcaacaatcaactgttgtttatttttaattaagtcagtttcacgtgtctgaaattactgttggcttagaggctgagatttgtcaattaggagcccggatggggccaccaggaatttggcgcatagtaaggcttccctgctagctgtaggaatcatctcaagggcttgctttttaaagaattggtgttatttgtagtcaaggtagacacagtaggcagcacagctgtgactgccagggaaagtcactatggggatattcataacaaggaaatattggcaaataaatgatgaagaaggggaggaaatccccaagatgttgaattggagtactgtcactgagatgattaatggtgttgtgtattttagtgaagatgcttatctgaattgtcttgaaactatagtgtacatttaatagcacctataaaaaagcatgtggtacacaagcacactgaagagaaaaggccgggtattccgattttatcttcctattttctccaattaagtttttggcttctgtttattagaaagctggtgttaatatatattatataaggagtatgtttattctatatatttattactcatcagcatttatatagctactttccctagaagattgaaatgtattgtaaaaaaaaaaaacatggatagtattgtaaaaaacatgggtagtttttccacactcttgttgggtgaatattatcaagagtagggagatgtaggcaaacagtcagggtcacagggctgcagtgagtaaagggctacacttttatcaatgatggagtcagtacaattttaaaaacatttctacatcaatttctggtgaaggggtaactgttttggaagatcctctagctttcagtgtcaaaccataaatttcctgattctgtggtgtgaattatcacttgcctggagggattgttatccatgaaagcaggtgcatctttgggcaagttacttaatctccttgggcctcagtaattactagtagatataggaatagatacagacaaatgacatatcatccaatcttcaatgagcttatagtctattacagcgacgtttttctaactcttggttactattcaaacagttggatatgtatccaatttagtggatcaagatcctaattttaaaaatgaaatggaagagaacagaaaattttattgtattgcatttcagtaagaatgtgtcttattttgtgaggctccctttttagtttcatatttgtgtatgtgtacatataactgcacatatgtgtttactgggtagatcatgaggtaatatgtgtttctactgtgtttcatatccaaaaagaatggaagccactgtgatagagttgagtaggtaaatgtataaacagaataatatataggtgttgtcactttgtgttcagggtacactggattataaagaaagaaatggtcagtcttatgaaaagggttcaggaatgaagaggctacgctgtttggtctctcatattcagggatgtgctagagccaacttggatgggtttgtgagagtcaattgtatgcacctctttctcactttgttagttctggcctcacgttagtaacttgaagttgcagaaagtacttgcaccatggaaattggaaaatattgcaattctggtgctctctaagccccaagtgattgttatacatgtaccagcatgtcattgctcatatttgttccaactataattctatggttttataattattttgaattacatatttaaagacattattttctatgttgcatttagattttattggtaattatttaaatgattagacaattgtttcaataatgaaagtttaaaacaagcaggaatataaaacctgtgattattttaaaacgtctataattagttccaaataatagtaatagttactctaacttctgttaaatgcttattatactttcaatttaaaatttcaagtttaattggtaagatcaggttctttggtaaagggtaggtatatagtgttttaaaaaatacacctcatattgtaaatattttacaaattgtatcattttaagttaggcagttattttgctaagtattacaaattttgggcctcagacccctcctttcctttttagtggtcttttacagtttacaataatgtctgtgttttcgcaaacacatctgtaaagtagtggatttcatcagaagatgcaaaagttcttttcaaattaaaacagttgtcaatcttataaaaatattttcaaatacaaaagtaaaagtagcatagtctaaaataggagaaaagacaccccttccatactaactataactttgaactttattgttttttatttagagacagggtcttgctctgttgcctaggcagtggtgcaatcatagctcactgcagcctcgaactcctgggctcaagctcccaagtagctaagactacaggtgcatgcccccatgtctggcttttttgttttgtttttagtagaggacaaggtcttactctgttacccaggctggtctcgaactcctgggctcaagccatcctcccacctcagcctctaaaagtactggattcctggcctgaacttgaaagaaaatattgggtaagtcagaggaaataaaatattcatagacatgagatggaatagtagtagtaagttcaaaggaaatcacctatattaagaagaatatgagatagtgaggaaagataagtaggaaagagtcaactgagctaggtgtttgtagcttcaaaacttaagttgcaattcagccatatagttggacactgccatagagggatttgaggaagagtggggtgtctttaaagccaagaacaatccgttcacccgtatttagaaaagatggagtgagtctgagatggcagtttcaattactaacgtttattgagcacatgctatgccattgtaataggcatggcagtacctattttaaacaacgaggtttaatccaggattcctagactccaagtgtaaccaagattgagaagccctgattgagaaggtgtttgtaatggatttagacagttgtcattgaaagcagaagaggccattggcaaaattgtaaagtttgtctttgtttagctgtcttttccatcctttggaaccccatccttttccaagcccctttttctcctttgtgaaattcattccacctggatgcctggttagtgtttcaaacctgtgcctcatcggcacagagttgtgattgtctatagccctcattgcagatcaggtgttgttagctgatggtgttactgttctcaggacgatttgccttttcataagcaactccaggtgaacaaattcaagaaaatgggtagttttttccaacagaataatttcagacaccatgacagggcttggataaattcatatggggctagaggaaagtttctttcttcctgaaaatacaaatccagaatgtgggtactctactcagtatatagtgttaaggctggccttggccaagaagcgtggatttggattcacaaccaaaagagggaaggaattaacaagttccagggaagagaagaggagaatgagtgaagaaggagggaacgtgccagtctttatcagctcttttgtacaagacagagtgctaaccactttcatgtgttatcccaattaaggcgaacaagacaggcgccttgtcagggattctgctggggggaggatggtcacctatgctgaagaaaagggaaaggtcacggaggctccagcagcaggagtgaattcttttgctggttgtttaacctgattgactgattgctattatacagtcatcttcccctcacctgcacaatagaacaacttatgccagttgtgttaggatcagtaaataacaaaggattgagaaaagagttagaaatataaaatgaccttcataaagagctctaatgctaaacatgttaaacagacattgaactttgtagcaagaactgcttcaagcctttcgatatccaaatgaattctaatttccacatcatgcctttcagacttcagcatggtttctggtggtttctcccagttaattttagcatcacacgaatgcttttgcctataaatgacttgaagtagcatatgttggtaatgtggatggcatgaaagtgtattatttaggggttattctagactagcctagaagtgagtgaatttattcattcatttaacaaatatattttaatcatcacccacgggtcaggtgcttttctacacgaactgttctacactaactgacttattcagaggtgactaagaaaacctctgctctctagaagcctagaagactgagatatcaataagtaattgacattctgcctggagcggtgcctcaggagaaataagtgtcaactatggaagcagcaccacagaggggccatttttaatagtgcagggagcccaaggtcttcatggtggaggaggagctatctgagcttgggagggaacccgaggtaatggtttgggctaaaaggcatttctggtgtggcaaattgcaaaggacacaggcagaagtggagggctggggaacggtgacaggaggtgaggctggagaggaagggagagcagaggcctcagatcccagaggactgccatcctgggagagccctggcaggagttttcaggagtgtgacagagactgcatcttcgagaagaattaccctggaggtggattaggcctgaggctgctgtgggagtgttccatagcttcctctcctcttctttgtttcacaactcttgtaacttgctttgcaagaaggaatgtgatctcattgttcaattcccacctatgaaaaaaaaaagaaaaaaaaaaagaaggaatgtgaaattgtggtgtttgttagtttaaagttgttttttattgataaatatcttgaaggactctcccaatgtgaaatccggttcaggatctgtctgcaaactcattgcttttcctggcttgaggtgcccacctctgcctttctcctcacagaccacttgtaattcaagataaacgaatgccagagagtaaaaatggataggcgcaggcagcatgatttagaatgaaagaatattaattggtttcaccggagtgtatattttcattatgagagaagtgactacctagattttaaaaaataattggttggtgacacacctgcagtgtgcatgtgacctctagaaacttgagaacgaaagtaaaggtcaagatgagaggtgtagcaccacaacgagccttttgtaggcacgctgttgaacagcggcgttcaaaaatcgctaacaggtggtttcagaaagtcagtgatactaatgtgcttgtgtccagactttagaaatactacagcaaacttaaactgtggtttcagtaaattctccttaccttatgaacagcttcttctgtgtattgagtttacaaatgtgtctttagtgaatctttggacttagtttatgcattagagtataatcattatgctttgttctttgactatgagcaagctattttaaacaattaagtccatgcagtaatgtttagtcattgctagcggtggttaaatctcttggaaatggatctggctttgatcctagccccacaattatctgttacatgtgggacagtgactaagttgcttaactttaagcttctgtttgcttatctctaaaagtaggggcaaaacaatacctcagaggttgttttgaggatgaatgtgatgattaggatggtgataataatgaacattactgatcttttaccagatgccaacgtcaggcactgggctaatggcttaacatacatttaaaaaaatccttacaataaacttatgccttaggtatgattattaccacattttacagataaggtaacagaagcttacagagctgacagaactaactcaaggttaagaaggcaggatgtggtggaattaagattagtatcagcaaattatgatccactagccacatctacccccaaccccccagtttttgtaaagttttattggaacaaggccatacccattcatttgtggtggaattaggattagtatcactgaattagggcccattagccaaatctaccccatccccctccatttttgtaaatacaattttattggaaaatatccataaccatttaggtattatctgtgactccgttcctgctataagagcatagttgatagtagtgacagagaccatatggcccacaaagctgcaaatatttacaatctggccatttatagaagtttgctgacctccgcattagacctcaggctatctgacttcagaacctaaggtctaaaccataaaaacactaatcatggtgcttggcatatagtaaacatacactaaatgagtactaccttgttgctcatctaacttactatagaactgttaacctcgcagaattagtatctgcaaaatggaaataataagcattcaaccgccagcaagaaaagtcataatgactatggagatgttgaagaacttaaagttccaaaaggaacacacgctgaattatgtgttatagttgttgtttattactatgctttatgtaatataaatgagaaattccattttcacaccaaagtacagtattgccttaaaggagatcattgtgaattttag

SEQ ID NO: 2355 - DNA, 6135 bp, Homo sapiens
tatttatcatagttatgctgaagttactccctgataaatctaacgtctgtgctttctagagtctcagcctgttgactgttttctcatttgattattgctcacattttttctctttgtgggtctcaaaattttttactctatgttggatattgtgagaaaaatagtagagattgagaaaattaatatttatttaccctaaaaaagtgcatactttttttgttagaccttttcttgggaaagttgaggaaatctgttgtatatttgaggtatgtgggattatttcagctttagttggattagtttaccactgacttcaaatgttttgaaaacagaataaggtcttttctatcactagggcttgtgatctgagcactggcaagatttcagagatctctgtgtgctcccagactgttttggttgctagggagttctttttcctttcctgtttctgactttattaatctcaggaggtctctcttctttttgctctgctgcttcaagcctttggcatccagtgccttgtacttaatgaaagtttgcaacactctgagcaactgttctcagttcttctgccttatttctggcctccgttgcaactgttttgacctagtgaaggcctagactttctcagacagatttcttttaactcttctgccctgactccagtcttcactgggatgctgccttgcacttagggaaggttcacatgcctcaaggatctctctctctcagatttcttgactttccctcagtcttcagtatagtcctcctctgtgcctggtgaagacctgtggtaaagtgctggcagagaggaagctaaatcacgtaaaaattaagaaacagctcagcgtttcacagctaagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagaactgcttcttgctgccgccatatgaagaaggacgtgttcgcttccccttcctccatgattgtaagtttcctgagacctcgccagccatgctgaactgtgagtcaattaaacctctttcctttataaattacccagtctcgagtatgtctttattagcagtgtgagaatggactaatacacctgccatgcctgttccttacttactaaaaaaatttactcccctttctccatagaatgcacgcaatttgaccttatgctacacttccagtctctactcctgcctctttatgctctgtccacatgtgatttctcactattctctacatggcttgtgcccctataaggtttgtgcccttcatttcctgtgccctctacctctggttcccatgctcagaatatcagtgtccttactgcaggggtgtataagctcagatctcacctcctccatgaagcccctatagacacccagagaggattaataatgaccctcctccatgtttccataacactgctaggctttctcctgaatttttgtttttaggctaatgaattaggctttaatctcttttaactctaaggtataattagatgtactatattcacagaatcaagggaatttgagttggaaagggccctagagatcagctagaaccacctcctcatttcaccagaaataattgaaattttaggggacttgtccaatttactatttttggctagttgtaggactcaaactagaactgcttcctggatctgtgctttttcattagaatatgttgtagccatgtggtagacagaaaaatctgctcccctcccctcttcagatgtccatattctattccatggaacttgtgaatatgttaggttacatggcaaagagagattaaggttgtagatgatattaaagtggctaattagctaaatttaaaatagggagattttcctgggttatctaggtgggtcctgtgtaatcacaagagtcctttaaatgttgaagggagaaacagaagagtgtcagagcaatatgctatggaaaagtttggctgccatcactggctttgaagatagaaggggccatgaaccagggaatgtggacctcttttggaagatgaaaaagacaaaaaaaaaaaaaaaaaaaaaaaaaaagaaagaaagaaagaaagaaaaaggattctgtcccagagcctccaaaaggtatatagtcctgctagcattttgattctagtccagtgagacacagatttctgacttccacaaccataagataataaatttatattgttttaagctactgaatttgtggtaatttgttaccataacaagaaatgcatgtacttaagtccaaacaaggttaaattgataactcaaagcttactaaagaggaatatgattactgaggggttttttttaaggcatattttatttccacaaactttgagatttactctgaatgttttgggttctatttattcattcatccaatgaatctctattgaatgtgtgacgtttgctgtagtagacattatggtagtttaattttatgcctcagtgttttcagtcttccctgcatctatcttcttaccatggactcattatgggtgaagggtactttcttatgctttgactttggacttggccatgtgacttgttttggccaattatatgtgggcagaagtgagtgtgtcagttttgagccaagcttaagagccatgctattgctttagagaagcttctccttgtcatctgctccctagcctggataacacatggaacacttgaaacagaatatctagctgagccccagacctgtgagtaaagcaaacttattgctctatgctagtagtgttactgagtttgttatacaaccttattatgacagttcttgactggtactgtcatgtaaacacatgatctaaacacacctgaatagaagcataggcagtatcgtagaggtatttcaagtataaaggagagttgtgtcaaagcacctgactcttgctgggagaatcaaggaagtcttcagagatgaaatgacatttgagctgaatcataaaggatgaatatgatttctttaggtcaataaagggtgtgggtgagtagataggaaaggttatgcgaggtaagtaaaataactttaagcagatttaaaggtaatttagtttcagctgaaggagctggtaaatatgccctttctttatttggagtttgctttttttgatactttttctatagaatgtgaaaagtaatatttcccaagtagtttgttaaacagatctcatgtctgctttctgaagtgataattacaagattatgtcaaaacctgtttaagagagtgagagtgtggaagaagcaagaaataaagagggactcattttaagaggtctctcatggtccaggtagattctatgcctccttcgtgggcagaaccaatttcctgtctctcttcttatgtataacaggatggtagcaaaatcacgcatctttttctgagatgatttttaatgcaaaattgtactttccatctgaattgttcttggctcacttggattgttaagtggtcttaattaagcatgggaatcaataactaagaagaattaagagattgttgggaacatcatgactatcatttgtaaactatatcatgagtggtgcttatgagaccaaagccattgttttatttcctcagtgttttggtgttttctgaggtctggggtatcctcctgtaccctaaccctagttggcattttccacatgcacactttcagcaacaagggaaagaggagacagtgtagaatcctttccttctagagagaacagcgacattttccaaatgatcatgggtcaatagtatctttgtctaaaaagattgatatatgtcatgatttcaacagttttggaatttgttcaacaagagcggtcttgggaatacttaagagcatgtgcacattgagatgtgtgttaacacctctcactatcatatctgaaatttccaattttaattcttgtgtaatatattcttgttacttaaaaaatttcatattcacatacccaaattctatgcaacctgcaggaaaacatgcatactctttctctatggcaaatggcatgcaattctggcatgagcagggttagaaatgttaatgaagagggatctgcaagtgtaactaatatgatctcatatttaaacaattcacaaatcaataccatggttggatttagataccagatgtcaaaccacatagtaatgcagatacagttgcttgcctccctgtagctggtcgccagaaagaaacagatggttaaaaagatatgtagccgaggcaaggcatggaaataggaaaccacagagcagaaattctgccatttaagtaacagtaattttctagtctgaaaaacctggctgttttatacctccacttatacacttaagcagtttaaatgtgaaacatagcaaaaatagtccaagcaaggctggcaacttgcaaattttgcaatgcataattgcatctcaaaaatctcggaggcagacgcacagcagtaaaaagtaaacacttgtatgcagttgaacacaattatgtggtggttattaccttagctcattatggcatcagaagggactctgtgaacttgtgctctaactagcaggtcaggcaaaatgcaaataagtaccaaatttgaaagcgagtgacaaaaaacagatacaatttagactgggagtctataatttggcttttaaaaataatcctcagcaagaattatcctcattacaataatggcttgtttattctgcacaacttgtttgcaattacagaccctctttcaaagctgatttcaacaagaaataagagcatacaaaaaagggagagctttgtggctggtcagttgttataattagagttgatgcatatatgtgtcataaaaccatttacgccttttctccaaatcttttaatttcagatttctgtcactaaaatctaaagtctgaaatagtcttttattctaaagaaatcattataattgaatttctaatgagggtgtctatggagctttgttcatggtattcctattatagaactggagtcctctgcatctattatggtcaggtgaccatgaaatgatgagctacagctgttacagggcatgtctctgctggtgcttaattcatagcaaatacacattttattgctaatgtgcttcctcattcatttcttcaaatatttattcaaatatttatggggtacctacaacgagaaggcatagatcatggttaaggatgccagacagcttgggctggaatcttggcccagacatttactagttgtgtgacctgggacctctgtgcctcagttcctcccgttttaaaatgaagacaattataactcccttataggattgttatgaagattaaataagttaatatacctaaaaaactcagaagaatacttgacacatagtaatgtgctgcctgttgttatttgctgggccttgggggcagagtagtgaacaagacggggttgatttctaccttcatagaatttttgttctgggaaagagggaagaaggcattcagcaatgaatcatccatttaattattaaattacattggaattaagagcaatagggaaggataaaactgtgaaggtattgtataaaatgggaacttgacctgttctgagtaggtttctgccttcctgaaagaagtgatatttgagatctgaaggatgggtaggagttacttagaagagatattagggaagttgctttccctacagaagccataggagagatgaaaggtttaacgtgggaaattcaattagagaccctgtggctggaaatgactcagtcaaacaattataaaaatagtttaattataaattgagttttcctgtcattgattcttgttcttccagtgagaccctaccatgctttgcaagcctttcactcatgcaactcacagtgaaatcctgggcttttcattgatgtagatgtttctgggtttttttcctagctcatgacaaaattggtttccactgcactttgttgtattcagagaagtcaaataaaagtcccaattgaaaaatacatgaaaatagatgtctaataagc

SEQ ID NO: 2356 - DNA, 735 bp, Homo sapiens
attgaggtttagaagatgggaatttttccctggaaaagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaa

SEQ ID NO: 2357 - DNA, 24980 bp, Homo sapiens
ctaggcttgtgcccatggaggaattcactaggagactaaattccactttcaggctgcctgcaaaactcccactgctgtcagggagatttctgggcctttaatgaggggagaatttgattctaagacttcttgttaagataaagacctggctggtttattaactctatccagctggggtacggactcacagacaaataattaaacattccctgcctaagaaagtcagggtctcagagaaaacctgggctggatccggtgggaaaggggaaaaggattatcccttacccctgtaccaagaatcatttcctgaaagcctaaagctggtgggccttttcctctccagaagaacttttctttctctcctctccacatatctggatctaatcttaaattgcatcctagaatatcagagttcatttattcaacaaatatttattggatacctactgtgtgccggagactttgctaggcttggggtggtaatgggagtacttagaggacttcctggtcattaataccaggttatacaggaagagactggggccccaagggaagaagtcacatatctgggacaacaggtttagtgaggttgtgggcccactctcactcccataaaatgcttcccctccaccctccctgttttctcctgggagtttgactctccttagggcacctctgagttttagctgcgggattgcaagtttcctgaatgtggaaccatgcctgtcacctcttggctggcctttcaagccactcaggaatctcagtacctgcattgactcattcaaaaatatttgaatacatattcaaacagaaatttttagttcaagggctcaatgcctggaagttagtaataatttaatgtttggataattcatagtaactgatattaataacaataactaatcttttctcagccttctagtatgaaaaatatgttctcacatatctgcatattaactctcatgattgccctggcattaagtattattatttacttttttgttaaggtgaagaacttgagactcagaaaggactttcttaaattctttcagcaaatagtggaatggagacttgaatactgagtgtcaaccttgtgaccatcctattgtattgtactgttgtgcacaaataaaaccccaaaagtgtgatgcaagtgtgcaggtaaaccatctattaaaatagtgggaatttgatgaaagaggtcatgcaagaggaagggtttaaattgtcttagagattcctgtactcatatgtttatggcagcactgttcacaatagcaaatatatggaatcaacctaagtatccaccaatgcatgattggataaagaaaatgtggtatatatacacagtagaacactattcaaccataaaaatgaataaaattatgtcttttgcaacaacacagatggaactggaggccattatcttaagtgaaacaaatcagacacagaaagacaaataccacatgttctcatttgtaagtaggagataaataatatagacacatggacatagagtgtggaatgatggacattggagactgggaaaggtctgaaggtgggaggagggtggataatgagaaattacttaatgggtactgatatggtttggctctgtgtccgccctcaaatcttaccttgaattgtaataatccccacatgtcatgggagggacctggtgggaggtaattgaatcatggggttggttttccccatgctgttctcatggtagtgaataagtctcacaagatctgatggttttataaggggagttcccctgcatatgccctcttgcctgccaccatgtaagatgtgactttgctcctcctttgccttccgccgtgattgtgaggcctccccagccatgtggaactgtgagtcaattaaacctctttcctttataaattacccagtcttgggtatgtttttattagcagcgtgagaacagacaaagaaatgtacaatctatgttactggagtgatgaatagcctaaaggccctgacttgaccactacatgatctatgcatgtaacaaaattacacttgtaccccataaatttatacaaataaaaaataaaataaaacacaatgagataccattgcaccctagcgtggttaaaaataaaaagacaaataataccaagggttggcagagaagtggaacctggaatttccatgcattgctagtgctaatggagaatggtacagcactttggaacctatttgtcagtttctttgagaattaaacatacacttaccataggacctagcaatcccagtcctgagcttttactcaagagaaaaatgaaagcatagaaaaataaaataatatctgtatatgagtgctcatggcagttttactcacaatagctcaaaagtggaaacaatccaaatgctcatcacctggtgattggttaaatacatttcagtgcatccatacaatgggaaagatggccttttaattaaatggtgctggaacaattggataacaattttaatgtgataaaaaggaaggaactgctgatacttgtaacagcattgatgaatcacaaaaacctgatgctaagggaaggcaaccagacacaaaattattctaataatgatgaacttctggaaaaggcaaaaccatagcagctgaaattggtgaatggttgcctgggactggctatggtagggaattcactgtaagagagtatcgatgttacttttgggggagaggaaagtgtgctatatcttgtttgtgttggtggttacattattgtacatatttgtcaaaactcattgaattgtacataaaattggtgaattttattgcgttaaattatgtcataaagctaattttaaaataaataaattgtcttagaaggaggaacagtgttcagaagagaggttaataattaaatatgtgtgtgtgtatgtgtgtgtgtgcatgcatgctcatgtgtgtagaggggaaagatgtgtgtatgtgtgtgtgtgtgtttgcttaggccattccagaaggaggcaataacctaagtgggccttgcatgaagcatggtatgtttgttgaatgatgagtttgaagtcctaagctggaaggtgtattcatgaggcaagccagtgagcaggaagtgggaaggagacaggcccaggggtggtttgtgtggggtggataggatccaaatctccatttggtaatttactagctatatgactttgggcaaattatttatctcagcttgtttcctcttctttaaaataagcataatacttagctactgcaaggtggttgcaaggattaaatgtcactatgcatgtcaacagcatagttggcccattcccagatgattttaggtgttcaagataaattagtacttgctcttcaaccataaaaggggctttgtgatgcaaagtctataaggaagcttagcaccagtcatgaagcataaaggagtatgaatagtgtccccaaactgggaaaggttggtggtttgtgagacataaagaaataatttttgtgtttactttcgtttgttcatttgttttagaaaattgtggtcaagataggtaataaatcagagtctggaggcagaccaggttgggggtacttaaaggacatacatgagaagagaaattcttgtgatatagtagaagaatgaaggggaaaggtagggacagggcatgaaacaacaaccatcaacatttactgagtatttcctatgtgccaggcattgttctaaatgctttaaagcctgagctcatttaacacatcagatgaattaacttgtccagtactcacatcacacctgaggtggaagctgctcttatgtgtatctggaagtaaggaaactgaggcacagccaggtgaaggtgcgtgcaaagaatgcatgcatctacctcaatttacttttaaaatggatttaaaaagtccttaaagaaacatgctctcattatagaaaattcaaaaaagatttccatctctacggttctcttatattcaatttatgttggtgcgttttctttgagagtgttttagattattttactctctacttatatgtaattacaatcatggtgtgcatttatatatatcaggagcatattgcttcttgtcttcatgactatagttttaaatggtggtttaatatttcattaagtgggtatattagaactatttttttctgctaatatgaacatcttgggacagaaatctttgacagcaactcttattatgttttaaagatgcatttcctgaggttgaattactgaatgaaatagagtggccaatttcatggctcttcattcatattgccaatttgcttttcccacagggttgaacacatttatagtatcctgaacaacgcaggaggctatgaatttaattacatccttgccagcattgtgtgtttttatttttatttttttgttaaatttattagggaaatatggtagactgtgtgaattttaatttgcatctttttacttattattgggattgatcattttctctcacatgaggtccctctttcatgatttaaaaaactttttggtgagtgtaattttttcaaaacaaacatttgcatgttaggataaatgaagtacataacggggcaaagagggggtaaacttgcagaccaggagatttttgagcctagaaaactggaagaaaggccacccccagcctaaacaaacagaggggaggcaggagtcattggtagaatacttggaacctgtttcagtgctgtccagaaagtggtgagtcttgccatcctctggttaatatcttctttttcctttttattacacaaataaagtatgttcattgcagaaaaaaataaaaataaggacaaagaaataaaaatcagccatatttccaccattcagacaatcctttaacatttcattgtatactctctccctctttgtatagaaaatataacacacatacacctctatataatagtgtctcttttgagctttcttctcttaaccatgaatttcttgctcttccttccttccatttccctgtcactctctctcacagctcaaatgcctttgatcttgtagttgtttgcacttccttattcagaattgcttaagagacttgagaccttgggtcacatcttcaaggtcctatgggagtccttatggaatctgaaccaagccacacagttggccacagttatttctgtgtcttttttcaaacctgactctatttgttatcatgtgcttctgactggcagagggcaacttggctagatctggaaggacaaacacaagataaatctcatgtgtgtgctcatagtcatcgtgacttctttgaagaagatctgtgtaatctagtagatattctccaaaaaagtgataaaaaaaagttcatgtcggactgatctcaacacttctattattgacttccattattgaaaaattaaagtttcaagggcagctctcttcataggctcaatttatgaaaggggagcctcattctgttcttatgtctccttcatttcttcttagccttttaaaaatttggtctatagggatagatgggttctaatgaggctcagcaggccaccagctcctaaattccttgtcagaggcagaattttggatggaacacttatgtgcttattatatgataaactcgtttgtatacatttaaccactctagattctccaatctttccaaacttcagttactgtatctgtaaaagtagaaataataatgcctattttgtagatttgccatgggaataaatggtagagagaaggtaaaagcttagtccaggaactggctcaaagaaggcacctcatatatggcagctcttattacataaggggttgcaatggtgatttcaccctagcactgatcatgacctgcagttgtgttggaagctcctctgggagaaggatagcctacaaagtatgcaagatgatttacacaggccatcccatctaatctgtctgccatcctactagataaattattaccctccattttatggattcatttattcattcaacaaatatttataaagcacctcctgcgtgcgaggcactatttcagaatgttggaggcacagatgttggtgaacagagcaaagcccctgttctcatggagcttacattcaggttgaaggagacaggtgacaagtaagtgaatgactatttcaaggggtggtaagattatgagggaggagagagcaggacatggaagatagcggagcagaacgggggaggctgctattatacagatccatctgtttctgtgaaaggcagatcagaggaggcctccagtagtgtaaatccgagcagagacctgaaattagtgagagagtgagccatgctgataacccacggaggcacgctctgggcagtaggccctgcatctgcaagggctcggaggtgggaacgcactggttggaggcacaaggagggcattgtggttgggatggagtgagtgacagggagtgcagtgggagaagaggtgagagaagaagtactggctgtgggagaaaatatttagtagggccctgcagggcattgtgagttctttagcttttactgagggaaataagaagtagagaagtgacacatgatctgactttgcaaagtgtcactatggctgctgcatgagaaaagtctttaagggtgagggtgtggaagcagggagaccagcgaggtgactgttgtagtaatctaagcaagggataatgggaatgtggatctcggtgctaatggggtgggtggcacgaagaggtcaggttggggaaggtagagctggcaggctttgctgacggactggaaggtgggggtgtaaatacagtatgatggttttagacctgagtaactggtggcataggagttgccattttctaagatggggaacacagggtggagcaggaatcaagagtttggttggggcatgttaaatttgagatgtctgttaatggtccagttgagatgttaggtatgtacttaaatatcagagcttagggttttggggagaggtctgggctaaacatttggaagccttttgcatataactagtgtttgtcatataaataatatttaaggccatgggtaagatcgccaaggaaatgagtacagacagaacagagaagtggcccgaggactaagctggtagcatttcaacatggcacaggtgagggaaacctacgacccatgagaaaaatcaaagcaaggggagtcaagccatttgcttcacagtgagtagcagagatggaaatccaagctctatgggtctgactctgaagtctgtgttattaacccctcagcaacactccaaatgctggagcaaagaggtcttttcctggagacataaaacgtaggtggcttgccagtctcacctctcaatgcgccaggattgcaagctaagccctcaggtttgagcaaataagatacttcagttgctggtagaaccagactacatccatcagttccagctggtgcagtactcaaggatctccagggagcaagaaagggctagtaattaagaaagattcctttcctgagctgcactgggtcacagtgactgtcagggttaaaagattgatggcttaataaagaccacctgaaaaggcaattgaccagccagggaaaaacaatcatcgccacccacccactaccggcagagtctccgttgagtcccaccatgaaagcagagctgcttggaactatctgcactcaatatcaggattgtttgaacaatcctcaaacaagcataagatgcattccttcattaactggtagtctactctctgcccatttcctcgactaggtatgtcgagataaataagcagttcccctgctcttaggagttcagaatattgcagaggccatgattatattcaagattctgaacaagccaagccctccatttaaaaatgctgcaggtatgtatgttttaatcttttaaaacttcacttctataatggtgtggtgatttagagcccagtatgtagtaaatattcaataggttattcactgaatttgaagcatgtgtggagtcatagagaaagggcccagaatcaagaattaggagacctggctgggcgtggtggctcatgcctgtaatcccagcactttgggaggctgaggcgggtggatcacttgagatcaggagttcgagatcagcctggccaacatggtaaaaccccatctctactaaaaatacaaaaattagccaggtgtggtggcgcacacctgtagtcccacctactctggaggctgaggcaggagaattgctttaacctgggaggcagaagttgcagtgagcggagatcttgccactgcactccagcctgggtgacagagtgagactccatctccaaaaaattaaaaagaattaggagaccagcattgcagctacagttttgccaaaaataaaaataaaaaataaaaaaaaatggccttctaactttaaacagatccctccctctttcttcttctctggattttagtttgcccatctgtcaaaaatcgggttgaattaaattatcgttggagatattttagatctaagattagaatttgtctaaaggtctaaaagcctcggttaaaaaaaaatccccttcctaaaatgctactaaatgtcaagatgtgcttttcgtagcacaggtgttccagaggatttaggaaaccgaagcagatgcatgcctgctgtgtgaaacccgccatcttctttgtggaaccagcccctaccccaatattccacagattctaattgctcagcagttcagcttgatggaacacctggctgggcagtttccaggaaacttagcccaggtcattctctatggcagcccaacagtggcaaggtggaaaatatatgagctacctttgcctatttcagtgcctgccagaagcagtgcatatgttggccaggaatatggcaactgtggagcgtcctcatgctttgagccagatgaaggatggatctgtgggtgccccaacccagaattcgggctgctggtatgcatgttgcaaaaagaaaaggtgcttttttcactggatacctcttggaagagaaattgctgtctatttactttaagtttaggaagtcccttttggggagcttccagtgcagaattttcctaagggagagagtccagtgaattttcatccttagtgccaccatattagttctagccctggctttttttcttggcagaaccattatatagcctcctttttaagtgaggacctgccttcagtctccttccaattcattttctgtaaaggaactattaatagagttaccttttagaaaaaaataaataaaagggagctgaaaattcctcaaacaaattaggtcacgttactgccctgctgatgaggcctccaaaggctcccatagcacttagcattgatgcagacacccaccatggcttgcaagcccaagtggcttcacctgtctccccttctgatctcttgtcaaattgcatcattttcctttcactcattaatttcatccactttcggttttctgagtttgccacattttcacccatctcagaggcttacccaatcttttctctctgctgtggatactcttctctctcccattcctttctccttcttctaagtttgcctctgaaagcatttccctggacactttatctaaagttaaagctctcactatttttctggctcagctccttacacatcaaaatgggcaaatgttttatttatgtgtttttcccccctactaccccaaccccgctgtgaatgctcagcttcaggaaagcagaaaccatttctatgttatttactgttgtctgtgtcaccagggcctccctcagtgccaagcacataatagatactcagtgaatgtttgctaaatgaccgatctggttctgctcaacttcccaatgtcaacccccatcccaacccacatacacttaactatgtccgattcttgcagcttctgccaggtccagcactcttcctggctgctgctcatttgcgtgtactgttcccttgccagaagtatccttctcccctattttcctcctgagaaacaaactcatctttcaagactcagttcaaatattatcttctctttggtgcttgttcccatctttcctagcaaaattaaaagcatctgtcccatgatctgtgcacacccaagttgcagcctttgccattctgcatggtcctgatctgttttcatatctacttcccccactgaactgacctcttagagacaagaacaatatccagcttaccttacatccctacttcttaacagcgtttgttgtatagtcaacattcgatgaatgtttgtggaggtaatacataccgtaataaataaaggagctgtctttgtgaaatttcagtatgtagagtcttcctatctgagaaacctatatgtgtatacttgctgtttgaatatttcctcttagaaattttctctggggttcctggctcagggagaccacctctatgttttgtgtcttctaggattaggcagttggtttggtttagaaaacaagagtttgctgttacctgctttaaaagcaacctagcagtcaacaaaagtcccctgggagaaatcaggttgctagtgagggcacagctccactcacaaatacttcgtttgctagtctacccacctgtagaactgtttgttaaggattcattcattcattcatccacagactaatgcattcattcattcattcactcactgtccattgttcccatgccaggcactgtgttggtgctatggttacagagatacaagaggtagagtgatggtcctgttccttgtgggtgaggaagcacagacagaccaatagtgtagtgggatcagtgttctggttgggggtgtgtgggcaaagtcatgtggcagcagaaggaggttaaggaagcatacagaggctctttatgctgacttctgatacatgatagaattatttgatggataagggaggtgagaaagagaggaaagaaagaagatggggggaacagcatccacaaaggcatgaaacaaggagtagtaagtgtgcttgagaaatggcaaggagtttgcaattaactgtcttcagagctttgttactcaaggtttgataagtggaccagcagcattgactttgcctggacacttgctgaacaacagaatctggtgttctcctctggcccaactaagtcagaatctacattgtaataagatccccaggtagttcctatgcatgttaatgtttcagaaaaactgggcaagaggcatttttcaaactctagcacacatcaaatcacctgcaaggtttgttaaaaaacaacaacaataacaacctccacaacaaaaacagatcactgggctccatgtcagagtttctgaatcagtagctctggatggggcctgagagtgcacatttctctaaggttcacaagtgatgctgctgctgatggtccaagcaccacactttgaaaaccactgtggcaaagtgtagtagaaagggtaatttctggaaaatgaatgggggcaggtagcagaattcaaatcctgaaggaccttgagtgcagaagtgtttggactttgccctggagtgctgaggactgctgtggagttttcacacaggagagtgacatggtcactcgtttatgttgggaagatctccctggcagcatgtggaggatggttgggatgacagtcactatattccaggtgaagctcatggatttccaaccaagtcaatggcaatagagatggcttcaagataaattagggggtcagaatctacaggattcagtgacaatagagatggcatcaagataaattatggggtcagaatctatgagtcagattggtcgaatgtgagggtggtaggcacacccctgctttctggggacctgggcgctggaggacatcctgttgcttttttcctcctgtggctgtcacccttttaggtccagaaagccatcccactttatttgccttctctccacaagtcggcctctggctccatctgacaggtttcagcctgcagtgtttgcagaaagggatgcagtaaaccattcagaaataggatttattaataggaggcatgtaattactgccagacacagcaatctgaagagtttatggcttaaatgtttggtgtcattcattaaaacaaagtgggctcttggcatggacgctgtcaccctgtgaccagatccatctgtttctgtgaaagcccctcccctcccgggtctgctagttgagcctggctgaaggggcagagccaggcaaatcatcagggcagggtgtttggtgctgggagtgggccttgctgggagtcctttaaggagcaggtcctggtttcagggcagggttcccagaggggatcttggcctgtctgcatttgtctcctgaacctctgattccatagtaacatgttggaagacctattattaacaatgatctctcacatttataactcctccaaagtctttctcccttttattttgcatctcaccagcccctcacagaacctatgatgcagatggcagaggttagcatggcctcttgacaaatgaaaaactgaggcccagagaaactgggtgagtccccgaaagtcatacaggcaaaggagcgtgcttgaactgaggtcccacaaagtcatgcttgaaatcccagctcagtgatgagagtgttggtttgtctcgaggacagacccagctgtcagaggtactgctgctgtaggacttgagttcaaacaaaggatttcttttgactagcactatgaacttgggagagctgctctgagcatcagtttcctcaagtataaaatggggagagggaaatatgtgacctcctttacagggtgttgtaagggttaaatgcccttgcagggtttgttgctgctcgtccacttttccctgactcgtggccctctctgggcctcccagaaaaccctacactattcaggatagatatgttggtgctcagatgagataatggagggatatgctttggaaaatccttgtacaccattcaaatgtgaggtaataataggaaaatagatctgctaccatcctgccaagaaaccagcagcttttgagacaaaaagcagacctaaaatctagaatcctcatcatcatgattagttttggacagaggaatttttctgccctttcaaacatttatctcaaaagttattttattctgaggactaaagagaatgcctatgaagcacaatgtgaaacccatagtagatatcctgcttagtacactaatcaggatattgttccattcaatggtaagctcttcccagaggactgacatcttatttatcttagtattctctagtgtttagcacagggtctggcctgtggtaggtgcttagcaattatttaaactgaaccaaattagattctgtcatattccatggattctttgaaagcagagcctgtgttttacccatttctctctttccagaactaagattagtgtctggcacagagtaggtacctagtaaattcaggttgggttgaaataaagcactgtgaaaaataaggtagactcgcctaatgtctgccctgaaccatgggggacccagggctccaggtaggaaaggagtctggaatttgtagcctgagtaggtactggtcaaatgacacactcacttcaaaggcacgcagtggggagggaaggggatgtggtttcccaaatgcctttttggctgggtgaaagcttcagttggcggcaagagtcaggtcaggggatgttggcagcatagagaagacggcagccaggactgccaaggcaggaacgagtcagaggagaggaagcaactcagatggagacgaaaagtgcttgaaatcttcccctctctgcatctgcaggaacagacgtggcagcagtatgcacgctggaaggaaaacaggctttgcagtcaaataaatctgcaggtcctctcagtgcaagccagggctggggggtcttgaatgtcatgttttatttttctgaatctccatttcctcatctaaaaaaaatgggatcagtgattcttaccttacagggttgttgtggatatcaaaagagtgttttgtgagtaataaaacagccatttattaagcacctgctctctactaggcactgagcctagtagctgtatggatataattagtaatcccctaatcatcctgcaaggtagtgattatcatctctagtctccacttcagagctgaggaaactgaagttcagagacattgagcaatttgctcaagtgatacagccagaattccaaccaggttctttcagcaaaggttaccatatgaatatggacatgatgattaaattgtataaatctttgtcaagtctaaaattctcccagagcagcagggttccttcattgtcagtgctttttctttcccaacttcccccaacttttttttttttaaactaaaactttggctaacctggcaatctacgaaagaggggttccactaagtgatttaaacatgatttgattctctttgtcctgttgctctttggcatcaatgggacatggatcaggaaattatttctaggtgtttatatgaggaaagaggaaaagctgctgagagttaatcttttagacaatccaacagaatctgaaatatcaaaaactatccttccaaaagaaaactatcaaccctttcaacattttttgaatctttctttgaagctttagccaaacagaagataaatgtaaaaggtaaggaaagcaaattaacttctattgaaacccaccatgtgcctgtgtcttgatgtattgtcttctcagttcctcctagtaaccccgtatggtaggtatcattagattcattcttccacataaggatgctcagaaaggtaaatatttgtctgagttcatacaatgatttggcaggaaagccaagattcaaaccgcagcctgcttggtcctaaagcccaggctttttttttttttttcttcttctccctgcttctgagtctgcagtctcctgaggggagcagttgtttcctctttgtttaaggagtccgtccttttgtcctggatagccccagagagatcctgcatcttcagaagaaaaaggacttttcgctttaagactgcttgggacctccaaaggtctttagcagaaaatgcaagcaagcaccctattggaaggtactcttaatgaaatgaacaccggctggatggttctatttttggatgtgggctcagacattaggagcaggcagtatcttttctttttctttttctttctttctttttttttttttttgacaggatgggctggggttgggggaggaggaagcaagaattaagcagagaaggcaagctcctttctgttcatctaactcaaagtgagtattatggatttaaataacccatgtgcagttctattacttagtggttttacccagatctaggctactacaggtgaaagatgttctatctgtcctgtgcttaatttttaatgcagtcttgaattacttttgtagaaaaatccaaacacttagtttgcatgccatcctcaaggttctccttctggggtggaaagctcacaggctttggggattgtgaggcttgagttcgaccttctgccatgccactgatctgtgtggctttgggtaagccatctagtatctctgaccttaggcccctcctctgtaaaatgagtacaatcatgcatgctttttaaggttgtcatcattgcaaagtgcttgatgcttggcagacactcattaaacattagttactttttctccctgtatctcaaagtgcaaattctttatctttattctcttaggtcgagaagggcatgagtgatgacctatatttttaggacagcttggatccacccagattgttggcaggggctattggctgtggtttaagacttaagccaatgcccattatgtcattatggagcctgcaaaagtgattactaatgttacttttccagttcactgcagagcagaggggagagtttttcacactgctggcgttttgttggagcacgaagatacgaatcacagatggcttcctcggcagatgtggccctgtagaactgcagtgctggtttataaggggtttaatgaaaacctggcaccctcccagacttgaatcaatcctctagggtctcagcttatgcacgtacagaccaatctgcaaatgtgcaccattattgacggtgtggggaatgctggggtgaaaagtttttacctgagaaacaaagccaaacctatctggccaagttcacaggcttggcctgggagatggaacagtgccgtggaagggaagttggtaggagaagagtggctgcagctggaggatgtccagatggccgctgcccagctgggggtgatccgggctcagggtagaatgatggttttaccagctgcttcgggctcacagtattttcttccttgccatggctaaaaagagtgagcaggactcgcaagtgggagatatggaatatcgaaatagtttctgtctagttcatattatggactggaactgaacttgcatattgttgcttctgcttgaaatgttcttcaaatggtcagcttgctatttctcatctgttttattttggcttcagtgtcattccttggcaaatgctttcttgatcacttccctgaaagaatctccaagctctttgccatattctatcttagttgtgcatttgttcataatatatcacaatttatttgcctatttggttgctgttttggtcctttactaaaatataagctctttgagggtaggaagtctgttcatcttgttcaccaatgcagccgagtgcctagtggagtacctggaacatagtagacattcaacaaatattgttggatggatgaatacatttttgtgacaagactaagataaatcagtctttgtagattaaagccaccatttacaagctgtataactgtctaaattacttaatctttcttagtctcagattctttatctgtgaaaaaaaagatggccaggcgcggtggctcacgcctgtaatcccagcactttgggaggccgaggcgggtggatcacccgaggtctagagttcgagaccagcctgaccaacatggtgaaatcccatctctactagaaatacaaattagccgggtgtgttcgtgggcacttgtaatcccagctactcgggaggctgaggcaggagaatctcttgaacccaggggacggaggttgcagtgagccaagatcacaccactgcactccagcctgggcaacaagagcaaaactccatctcaaaacagaaaaaaaaaaagataaaaatatagtagagggagctgtttgtgtagaatagtgtctagaaataagaaatggtcaataaagctattattatccagttattgaagaattaagttcaccaccaacaaatatttatcaatatttctattctaatatctattgagaatctagtatatgctatgcccccacaccaagcacttttacatgcattatcttatgctattcttcacaaccttgtgagatattcttcccattttagaacaaaggaaatagattaagtggtttgaacaagcttacatagctactcagtggcagaggcagtattaactccatttctatttttaaagccctaattttcccccataattccaggctgcttcctattaacactcattctggataaataaacataaggaagccacattctctgtcctctggaggctctggtttaggtgataagacatatgtaagagtaaaatgaacactaataaaaaccatttttttggtgctgctttgaagtttacaaagcttgtcccaatatttacaatacattcaagttttaaaagattattacccaggatatataaataattcatacaagtcaataagaaaaagacaaacaatggaaaaatctacagattatgaacaggcaactggaatggccaataatcatataaaaagatgtttgacattatgagctgttggggaaattcaaatgagaacagtaagacactatttcccattgtcggataggcaaaaataacagtctgagatacccaatgttgaggaggataaggagacatgagaactatcataccatgctggtgggactataaattggtaaaacagtttggggagcaactggcaatacatagtagcagtcaatatgaatacacaaccagggcttcctctatgaggtaatagcttagagaaatttttgcatatgtgccaaaggagatgtgcaataatgttcagtgttagcattgtatataatagtgcaatattggaaataatctaaaagtacattaatagaggaatggataaacaaatggatctttttttagatagaacataaaatagcaaaaataaagcaacataaaatagcaactaaaagaataaattagagctacatttagcaatatgataaatcactaaaacattattgaataaaaaagaccaagttgcagaaaggcacagacaagatatcatttatgtgtatttaaaaacgtgcaggctggccgggcgccgtggctcatgcctgtaatcccagcactttgggaggccaaggcaggcagatcacctgaggtcagaagttcgagaccagcctgaccaacatggagaaaccctgtctctactaaaatacaaaaaaattagctgggcgtggtggtgtatccctgcaatcccagctactcaagaggctcaggcaggagaatcacttgaacctgggaggcggaggttgcggtgagccgagatcacgccattgcactccagcctgggcaacaagagtgaaactctgtctcaataaataaataaataaataaataaaaccatgcaggccaggagcagtggctcaatgtctgtaatcccagcactctgggaagctgaggtgggtggatcatgaggtcaggagattgagaccatcctggctaacgcggtgaaacccagtctctactaaaaatacaaaaaaaaaaaaaaaaaaaaattatccggcatagtggcacatgcctgtagccccagctactcaggagactgaggcaggagaatcgcttcaacccaggaggcggaggttgcagtgagccgagatcacgccactgcactccagcctgggcgacagagcgagactctgtctcaaaaaaacaaaaaaaaccccatgcaaaacatgttttcacttataagtgggagctgaacaatgagagtacatggacacagggaggggaacaacacacactggagcctgttaggggagggcagggaggtgggggagcctcaggaaaaatagctaaggcatgccgggctcaatacctaggtgatggtttggtaggtgcagcaaaccaccatggcgcatgtttacctatgtaatctgcacatcatgcacatgtaccctggaacttaaaataatattttaaaaaatgcgaaacaatgccacaagtttaaaattaactctttatgtaccataaagatctggcaaggaagaatacatgcttctagatggtaataattacttctagggtagaggtagggaaagcttatcgagggaacttctatggatcttcaactaaatgttttaatttaaaaaaatctgaagcaaacatggcaaaatattaacattgttagatccaggtggtgcgttcaatgcgtttgttatacttgtctttgaacttttctctgtgtgggggatattttctgtgtatacgggatatacacatacaaacacctcgttaacccagagcttcttccccaaaccttatctaattttgtcctcattaaggccttggaaacagcaatgaaagagaagacgttaaactctcgagtttcagtgcgtgtctctcctgacacctgcttttgttttgctgattgggaatgctggtcaggtggagtagagatgaattgattttcattagaaagggtctgcagctatggtgagggtggggtggagtcagggaaaagtggaagagaatcaggagggcaaaggtgcccaagttctgagaaaaggctgaggaacccaaggttcggagaaggagagtaataaatccagtgtcctatagggatagagctggaatctgctcctggttacctaacctcatatttaagtcaaaggcaagtgtacgctagggacaggagcatgaacactggatttggacagatcttggtcagatcacagctttgctatttagtgtctgtgtggccttacacaccccacctaattctctgagcttgggtcactattgcctctcttagagtgtcactgggagaacgaataacataatgtgtacaaagggacttagtgggaccagcactcttggcatttcactccataaagaatagttattaccaccagcagcagcatcattccaatttgtttcagccatttctcaataactcgttcttttaccctctttccttctttccccagcccaaattgggacagtttcctatgggtgagaatttggtttatctctgtccaagaattggtctcagcattccgataaaagctaccaaaccgagagacaagcagaaagatcacctccttttctctggagtcgttcttcctatgagtgcagtctgaggtctcatcaattttgggagcagccaaatcatatattactattcctatcaactaaagcccttgaatcttttaatatgacttaaaatttgcccaccctatacagttgggttttctaactcaaatgaagaatcttgattacaaaaaggagaaaagaccaaggtatttaaaaagaacttagtattatggaggaagtaaaattgctcttatttgtgagtacttaagacaggcctatttttgctccttttggagttctatgacattaaaactttaagatcataggctgctctgcctagggagtagccattcttttattcttttacttccttaataaacttgctttcacttaaaaagaaaaaacttgaagaccatagagttgaacccaatattcctccttttcctagtagtaactatttcaaagaacaacttccttctttcctactttaaattttatatttattatcatgatcttatggattcttctttctttcttattcttaagtggactgtgaattattatcactattctttttgatttcccaattgatttgaccagtgggaattccttcaaaccaattcctatgttcttttgatatttcgccatcaatctttgagtacctctttgttttctgacaacaagagattctcgacttaccttatattttctttgccccagagccagaatcagctgtttctctaagaggcagtggttctttttagtggagaatggtatttagaaatcaagatgtagacataatatgtgctctctgctactggggtatcattgcttctgggccctttcattacagagctaaaataaataaatgtatgtatatgtatttctgtctctatcttcatctattggagtctctgatggttagttttatatgtcagcttgggtggatcacagtgcccaaatatttggttaaacgttattctggaggtttctttgaggatgtttttggatgagattaacatttaaatctgtagactttacatgaagcagattaccctccttaatgtgaatgggcctcatccaatcagtcgaaggcctgaataaaacaaaagactcatgtcccccaagcaagagggaactcttcagcagatggccttcagccttaaactgcaacattggctcttctctggatctctatcttgctggccaaccctgcatattttggacttggaagcctccataatcctgtacaccaattccttgaataaatctctctctatatatttgtgtgtgtgtgtgcgtgtatacaaatcctattggttctgtttctaattaagaatcctgattaatacaaagtctgaaacaatacaataccgtgttcttgctcaccttcctcactgatatttacatctcccatcttttacagtgagaatcatggtttccaattaaagtcaatatatttactcattttttgtcctagtccaaatatacataacaagacaactgtcttagaatctttaaaacagtcaatatcatgaaaaaaagaaagtaaaaaggcaggagaaatgttctgtgttagatcaaactaaggagatctggcagccaaatgcagggtgtgatacttgtttggattctgaacattactggggaactttgaatatggaatgtatattaaataatattttatgaaattaaatttcttgggtctgataatgatattgtaaggaagaatatcattgtaagagatgagagattcatgttgaattatttaggaatgcaatgtcttgatgtttgcaagctattcttaaatggttcacaaaaacatatgtatgtaaatagatatagatatagacagattgattaatgagggagggaaagactgtgtgtgatggggggaacatgtgaagacatggcaaaatactaacagttaagtaaatctaagtttaggaaaaataggagttacttggattatcctttcaacttttctgtttgaaagttttcaaaataaaaagatgggggaaacagtagcaagtgttatgtatcaagtatttatatatccttgtgcaggtattatataccaaatgttaactttgttttaggcatgtgtcaaatactttatgaacatcattcattaacttgtttccgtaatccccactacaatcctctgaagtaggtaacgttatcaccctacttcacatttgaggaatctgaggctcagagaagtaaaggaatttgcctaaattcacccagctagcaggataggaaattgaggaccagagagaggagtgacctgccaaggctgtcaactagatagtgaccacagcaggactgggactacaacatctgattctaactctggggctcaatcccttgcatcagaaaggtttttactctttgttttcttgcccactttggttccatttagagaaaggtttctgctagctctactagactcattctgaagagaaaagattgtttccctattccccattaaaaaagataagcatccagcttcctgtcctctggcttttacccagaccttttatactcattattctccgcaatgcatgctctctctagttattgggtcacaactttatcagattccagagatgtgaaaacccaagcaggcgcagaagcttcagactaagggcaagcattcccattcattaacagagggacagtgattctttgtctgcctcgagctgtttgcacgctattcactttaaacacaagcatagagttggcccagtatagtcttctgcacactgggggttatgacccattagtgggtcctgaaatcagttgagatggtggctgtcagcatttaaaaaattatttataatcaaactggatagagtagaaaataaccgcacccatgctcattataaaggtaggtattgttttgtgagtgcacagacagacacatatagatgtctattctgggtgatggtataaaatttatttcttatgagtcacagttaaaatgattctaaagctgctgatctaagacagagggtggcaaatgcctgtttttgtgaacaaagtttattgagacatagccatacccacttgtgtatgtattatctttacgtattatctttggcagcttctatagaacaatggcagagctgagtagttgtgacacactgtagtgcctgcaaaacccaaagtatttgttacttcgtcctttacagaaaaatgtgtttgtccccttatagcctaggatattaaagcaaaaatttcaaattcaaagtcaaataaagcccccattgtatataatctctggaatttctatctctagtatttctcccccaataactaagttgtgtattcacatatagacttatgtaaatgaatatataattacagaaatataggtatagcaaaagtaattattgctttggaaactaggagtattccaatgccatgtccttttagcacatagcaaacaggatgacctttccatcctaggaaaatatttttatgtttaacctcattgcactcaaccagacgtttccttgcacagattttcaagtgaaatatttcaatcctgcattcatcttgggggccacgtgtcttatccaagttaaatatttccagaaaataaatgtctagacaccgtctcatataaattaagcacccggtttttaaaagattcctagcagacctcctttctggtgtgtgggtgaatataattttactcctgtgaaaaatgctgggtaaaacctgatgtgcctaagtcagtgcacctgcaggtgactaatgagtgctgctccgtcattagtggacaatgcatgtgtgtacttgtgtgtgcgtgcatgtgtttgcctctgtgtgtgtgtgtgtgtgtgtattagggaggtggaggccagatggaaagacaagactcagggagtgtatttcatgcaagagccccctcttctttgagatgatcatttataagaatcttggataaaagagtacatgtacttcagggagtctccatatttgttgaatcctctcttcagagaataagaaatgtgtgaacgaagtgcatgaagataaatttctattgtagctctatgactttttattttatttgtgtttgacgtttttcaaactgatgggttttatttaattcaagtgagccatttttagtgtttttgctatttataatttctttaatatagacttctgtatcactgtgatataaattacagtatttttcattaaaagtgaactcttggccgggcatgatgatgcatgcctgtaatcccagctacgtgggaggctgaggcaggagaattgcttgaacccaggaggcagaggttgcagtgagctgagattgtgccactgcactccagcctgggtgacagagtgagaccctgtctcaaaaaaaaaaaaaaaaaaaagtgaagtctttaagaaaaaccaaatacttaaaggaatgagcacacatttttagcttttattatattttattacatatttatattttatatacctgttataaatatgggta

SEQ ID NO: 2358 - DNA, 623 bp, Homo sapiens
tgagatttttttctgaagatgaattgacttgtttcacgaagccaactaattttcagtctcacactcccgtatgtaaaaaaataaggcaaagagagccagggagtacacaaagcaaagctagtacacaccaaacaaggcaatagggtgagttactttctggttgggaaacaaaacccctcttctctctactactccattcctttctactcttaagcatccgttccttcaaatgctttctccactatggatctcataaagcagttcatagtaggatatgaaatgatcaataaaagctcaaagtttaactctctcatgggaatgtatatttgtgtaggaatcaaagcctttagtacaagtctccagtgtatttgggtagagagaggggtgcgtgctatctcattgtctctgaaataactccttcaaactttttcttaccctcaggcctctaaggcttacctgcatgatgaatttccgttttccttactctcacacccagctttcaatttagcaagaaacagattcgcccaggccagtctcaagaatttgtattctgcctcatatgactacttatagtcagtggacatccacagtacacattaaaagctctgaaaagtcatgcagtg

SEQ ID NO: 2359 - DNA, 13716 bp, Homo sapiens
agaggtcaggaaaaaaataagaatatgacagtcccatggcatgaagttaggcatctgaaaacgtgtgtgctccaaaacagaggtcagttaatggaaaattttagaagagaaagttgggttagagccagcacagcaagctgaaatctgctcttacctaactggcaaagtcagaccagaaatacaagcaagaataagaaagacacaaatattttagaactaaatgagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccggacacagtaattttagcagaatgctaataggacaaaactgaaaattacagatgacgggagaccacttactatgaaaagcagctactataaaagctagtcctcagtttggtccagtgtccaagtcccacctccagagccaagtccctcctacctcatcatgaaaactctcagcagccctgtggaaagaatggaggcctcctgtccacaacaagcaccaacttcccatgcgtgtgaaggagccacctagaaagtcatcatctggctccagtcaagccttcaggtgacatctgaatgacatcttgaatacaaactcatgagagaccctgagccaggaaaacacagctaacctgttcctgaatttctgatttacggaaatgttgtgagatgatgtttattgttttaaactgctacattttggagttatttgttctgcaacaacagaaaatgaatgcagctcaaattaaacttagctacttggtggccactttcattttaatatcagtgtagttatctatccagaaggcacacccagggacagcgactgtatacttccaaagcagcccgaagtatgtagctttagcaatattccttcatcattcttatggtggcttactctttgacaatcaggtgactgaaatcgttctcatgaacaattacttaagaatgctttcctttcttgaatctagggtgaatggttgaggccagagaactgtagtcttcaagctctatccttttagagggctgtcgaatctcctcagagtagagactttgtgtctttaatttcagatatcctcccttgagaaagtagatgctacttcatctgtcatatgtcatcagggcatttgagactattagatctatcctgtcagctcactacaaaggaaatgtaatctattataaccctctagtttcttattgggttttaatgacttaaaaatattatattttatttacttataagattacaggaagaaagaaataaaggtaaatggaagcacacagtgatttctttcaaaaatactgagaaaaaaaatgaaatgctccactgggtgcttcaggaattaactttacaacctaagggactcataagataagaaaatacatttttgaaggttatatttaaaagctaattactatagaaacaaaattgcattttgttgggaacttccatagatttacagtgttcctgctcaaaaaacacaaaacaaaacaaaacaaaacaaaaaatgaaaaacagcaaaaaaaaattggaaacattaaacttcaagaaaccttaaaggtcagtttctctaaccacatgtcggaagctttaattctcaatatgctttacttctcagaacaacataagatgtgttaaaaaagaaatgtacctatactcggtaggtttcattacataggataactatttatcattataagctaaatgtgaaattttccttgacaattttttaatgttttgaaccaatgaaaaaacgtttttcataaattaaaaataaagttgtaagaatatgaaaaataccagttttttaacagctatgaattttctttaagtaaaaaaataagcaatatgtgtaacatttttattataaaggagactgtaatgttatagtttacagattatgttttaataaatatgttaaatatgcatgctaaatatgcatgacttaattttcatcaaggaatctttgttaaactatgctgtgaattgatttcatagctaaagtctgaaaaccaactagtatccacttcaagaaaggacaaataacaaatgcttgaacaaggatcttacaaatacagtaatatttgagactaacaacttattttacatagttgctaaatgatgattaaaaccaacactatttggaccggacgtggtggctcaagcttgtaatcctagcactttgggaggccaaggcaggcggatcacaaggtcaggagatcgagaccatcctggccaacacggtaaaaccctgtctcttctaaaaatacaaaaaaattagccgggcatggtggcaggtgcctgtagtcctagctacttgggaggctgaggcaggagaatgctgtgaacccgggaggcggagcttgcagtaagccgagatcacgccaccgcactccagcctgggtgacagagcgagactccgtcaaaaaaaacaaacaaacaaacaaacaaaaaaaacactatttgaaagtgaaaactgcctaatttccacaactgttacaaagcataaacaaagattattcaaccctgtttattgctatattaacaaattataccatctttcattataagtataaagagatgccttaaccatatatttttaaaatttgccttcctcacctttggtattattctgttattaagacgttttcagtctgaaatacatggtataacaaatggaggatagttatatagatagatcttccagggacaaaaaaatggcccattcttatcttgacaatgtttaccaatagtgatttattcaataggtttcaatccagtgcatttcagaaaatgtaagtcatcagctggtttctgctgtcaaatcctgttattattgcagacaagtacacaaagaatcgtgaaaccaaagtttccgggtgagtgtgcttacatttttaaattttcaatcttttcagaaaagtcaactaggagtactgttttataaactctttaaaaagaatataatttttagagaataattttcttctgtatagttttaataactcctgaagaaaggattacaagaatgattacaagaatgttgaacaagtaaaatccccattataattaataattttcagtcttcattacagaactctcaatctaatatctctaatacaatgtttttcctaaatatcaagtggtatttttttaatgtgcttaccatatacaggatgtgggaaaattttaaatacattgtttacagataactgatacttagtcataccattcttaacacatttcctcttgctctacatgtaataattttgttaattattattaattaataattattttgttgactagtttgacacctcgatattcaaaactcaatatttctgacttaagtaatggaagactgcatgtgcaattacttccagagacactaatgattatttttaaaccattactcattaaatttcatataaatgcatacaatctgcatgggtacttaaaattttaaactttagtgccatattttgcatatcacatgattcacacatgaatgagtacatgttgcacagttaatctgataacagaatataaaattatgtaattatatgcattatatgtgtctctctatatatatatttcttaatattctgcatttcctttgagtcatgtacagctttaagtgaccacaaagaaaacaatatttatctcttcttcaaagtggcccgtgtcctttgaaaaatctaatatgcttgagatgattcccaagctgaaatcctgtttttttgtgatgttccagatctatataacctttaaaagtgcgaagacttctcctattttaaagacaatttaaaataaaattaaggaaaaaatttcatttacattaacaccaaaaataaaatacttagtgataaacttagtaaaagaagcacatgacttatccaggaaaaactacaaaacatcattgaaaaaaagtgaaaaaaaaagtataaatagttgaaaagaaatcctgtgtttatgaatcagatgatttactattgctaagatagcaatatttcccacattgatctgcatacatattcaacacaatcccagtcaaaatctcagctggctccttcactgaaattgatcatctgatcctaaaatttatatggaaatataagggacccagaatagccaaaattttgaaagcaaagaataaagatggagtattcacatttcctcattttaaaacttattacaaagaatgtcataatcaagacaacatagtacaggcataataataaacaaattagtggcatagactagagagtccagaaataaacctcatacacatttataatataaacgtgtatgttcacgttatttttgacaagatacaaagaaaattcaataaagaattttttttttcaaaaaatgatgccaaaataactggatatccatatgcaaaataatgaagttatacacctacctcacactgtatataaaaattaactcaaaaaggatccaagacacaatgcaacaactaaaacttaaaaactcatagaagaaaacaggagtaaatctctgtgaccttgtgttaggcagtgttttttagacatgacaccaaaagcagaagcaacaacaacaaaaaaaataaattgcacttcatctatgttaaataattgtgtgggtcaagagacaccaccaagattgttagaagacaacccacaggataggcaaaaatatgttcaagtcattattatctctaataagggatttgtatccagaatatattttttaaaaactgttaaaattcaacagttaaaagaccaataatccaattacaaatgagccaataaattgaatagacatgtcccaaagaagatatacaaattgtcaatagtgcatgaaaatatacctaacattattagctatcagggaaatctaaatcaaaaccagtgcaccaactaggactattataataaaaaataaagacaatagcaagtgttgataaagatgtggatgaagacatttggaattctttgcattgctgtggcaatgtaaaatggtactgtagctttggaaaatttgacaattccttagaaagctaaacatagggttttgatatgacctagcaattccacttctaggtatataccaaagatagttaaaaacatatgttcccacaaaaatttgtgtataaatgttcataacaggattattcataataccccccaaaaccagaaacaacccaaatgaccagtaactgatgaaaggataaaaaatgtggtatatctatattacttagcaatcaaaaggaatagtgtattgacacctactacaaaatggatggaccttgaaaacattacactaagaaatgaaagcagctaatcacaaaatactaatattgcatgtttttattttatatataacatccagaataggcaaatccattgaattccaggagctagggggaaggaaatagagaatgaccactaaagggtatgggatttcttggatgatgatgaaaatgaactaaacttagatattggtgatggatgtgcaacactgtgaatatacgaagaaccactgaattgcatactttgaaagagatcatttttggcgtgtaagttatctctataaagctgttatttaaaaaatgtggagactatttaagtagatattttcaagtggttttaagactcagtcctataatgctgtacaaaaacatagtccatgcccattttgtttaaggcacaaagttcaatgtgagaattcaacaagaccaagacatggttcttgccctccagacacaacgtagatggggagagaaaaaaacaaaggccaatcacagctcacagtgagtctcccttacagaaggatgaggaaatggaactgctagaggagcacacagcaggaccacgaagcccagggttcatggatgtgcagacagcagtctggaggttgcacaggagacaaggcacagaagaggagctcaacagcacatcaggcaaaaaacaaaattactaatatatagtttcaaaaagccttgacaaactggaggaactaaaagtattaagaatagcaggaaggtagataaaagcagtggatggagtagcaagaaacaggccaggaaagagggtacatgtgagatcatgaagggccttgtgagccattgagaggagtttggatgccatcctgaaggtagttgggatcttccatagggatatagccaggataaagatgatgagtcacgttttagaatctctggactgtagcgtagaaagaagactgcaggagtccaagactagagagaagtcaatcacgctgaggctgttgcggaattccagatgaaagatgatgacaggaatctgaggaatggcaatggccatgggaaaaatgtgagtattctatcagctgcttcttcaaggaccatctaaatttgttagatacagattatcaggtacaaaggtacatacaagaaagattcctggagctaagagctacttgagatcgtagcattctaatcactaaatacttcgttagtgctaaggaattctgttatgggttgaattgtgtacctcccaaaattcatatgttgaagtcttatccctcaatatctcagaatgtgactgtatttggagacagaatctttaaagaggtaattaaagtaaaataagattactagggtgggacattatccaatataactgatgtttttacaagaagacagaattaggacacaggcatgaatagagggaaggccatggaatggcacaaggagaaaaccatctaaaagtcaaggagagaggcctcagagaaaaacaactatgccaacatcttggacttctggcctccagaactatgagaaaataaatttctgttatttaagccacccagtctgtggtactttgttatggcaaccctagaaaactaatttaggctctaaagggtcggcatttgtattactaaagcatagtcaaaagatacctcatttgtcagctaataaacgtggatttttactagggactgtacatacagaaaggaataaaacagtttcttctttcatagaatcacagtccagggaacagaaagtcaattaatcagtaatgattataaaaattacaagtgatgttaaagagtcatgcaaaggatactaggggaacatagagctggggcacttcagcatcagcacaggggtaaaaagtttctcaggggaggtgagactgccttgaaagataaaatggaactggagaagacaaagaaaggcatttcaggttggatgaatcctataagcaaatgtacactgtaatcactgtaagcaatatggcatgattagaacatggtgtgtatcaatacaagacagtcagtgaccatataacgaagggctttgtaagcagcatctagtttccagactttattctttaaagctgtggtgagtaattaaaggacttttaggcaaatatatgacatgatagtattattttttaattttagagaaatcactgtggtgacagatcagagggaggatggcagagaagcaagaatatgaattagagaaatattgccataatgtcaggcaaagcaagactttgtgaattatgtctaagtggtggtgatgaagaagataggatagatttgagatacagtaaagacaacagagatcatggtagagtaagggcaaaagatgaatgaaaagatgggatctagttttctgatttgacatccatccttagtgtttcacttctttccactgcatacataaatccaataaaccagcctacatggacatctatgcatgatcttgtccctgtctaactcccaggcaatgcgcaaccatcatttagcaatcctccttagtccttttagtgttcttccatggacttttacagtacatgattatgtatttgtttgattttatttttattttaaaaagtgggctttaaattttaggttatattcctaagaatcacttaagggtttacttaaaatgcatatttctcgttcttagagattacaactcataggtttgagaaagaaccctatgttggcatgtttaaaagaatccctccttcctctagtgattctgacacatgcaagtaatgaactgtactttgctaagccactaattaaaagtttattttcctaagaagagtagaagtcaggtctgattttccaccactgtgttccagatcctaacatcatgactaagacctaataggcatcaataactatttttgaatgaatgaagaaagactaaaatgccatgtgaataggtagtggtatccttcactgaaaaggggcgtacaagggaatgactggttttgaaaggccgatcatgacttagttcatgggtttgtgagccaagtgtgcctagaggtaaagatttcaaaggcacaggtatatgcaaggcaattgaggtcatgaatatttatgagagagctctctcccacagacatgatgaaaaatacaaagagaagatggcacaaatggatcactggaaagagtcaatttaagaagcacactcaggaagaccagtggaaaacgatgtaaaaacatgatcaaatggtaactagggaagaatctagtccacagtgcaagaggccaatcaaatagttaatttcaggaatgatgaagtagttggcaatgtatgaagacagtaatatttcataaccataggatttgaaaatttaggggccttggttaccttcatgagataagttttctgtgaagtctctcttatctactttgctccagacaggtagatatgttcctcctctgtatttcatcctcctccaagacatatttttattgtaacactttggcattatatggtgattatctgttgatgtgtttatttccccaccagactgacagcacattaatctcaaggaccacccaacccctatataagacttaggacttagtaggagttccatgtttgataaatatataacttgattaataaatagaacatgtgataaactagtctatgactagaaatgtataacttctctctatttagtgttttgagtaggcctggctttaggcagtaggcagatgggagtactaaacttatcgtttcctaaatctgtgtggtctctagattatgtcatccgcagcttcagagaagctaattttgaggagactaagtaccctgaccgcatacctcacaaggatgtttggaagacctaacaaattaatattttgaaagtttatttattattattattattattttgagacagagtctcactctgttgcccaggctggaatgaggtgacacgatctcagctcactgcaacctccgcctcccgggttcagacgattctcctgcctcagcctcccgagtagctgggactaaggtgcacgccaccacgccctgctaatttttgtatttttagtagagacggggtttcaccatattggtcaggctggtctcaaactcctgacctcatgatccgcccgcctcggcctcccaaagtgctgggattacagacatgagccaccgcacctggccttcaaagtattttatgaacagatgatgtggaagacagaaactctgcaggttcctttattaggactgagaggagcactggagaaaagatatccacgctctacccatcattaaatacagctggtctgtctaaaaattatatcagaagcaaaaagtcaaaagccaccatctctggatttcatccagatctgctattacttgtttttatcgtccgacaatctcagctcttaataatggtttctgatatttgttacatgaagtgccccatctttcactcaagttctatgcagaaaaagccacgtaaaagagtgccttctccccttaactctgagtccacggatggtggcatcttgagtgtgcatgttggcgtatgtattgtggatgcggtggtttaagggaagggtgcaggaagtcagacctgtaatattttgggtaaatgggatgtaataaccttattataaggcttcaccccaacacagtgcatatgcaaatatgcagggcacatatggtatttgttgcaagactattgaagtagaataatcttttcccttaaattttaacttatgataattctaatttggatatcacagagtgaccatttttaattgaagccattgagttatgtttttgttactatgttcatgtttatattatagatggccaaatttagagtttcaaataatttcc

SEQ ID NO: 2360 - DNA, 48839 bp, Homo sapiens
ccataatcccattacttgtagataaatgtgatattttgatgtacttttttcatttttaatcaatgaaatatataaacatatacatgagtatggttattgactctatgcaatgtcatattctgcttttatcacctggcataaatttccatcttgttaaatattctttgtctttaattcttgcataacaaagcagcacaagaatatgccatgctttgtttattttaccattatcttcttgccaaacatttagatttcttttaacattttattgctttcactggaatgcatattcttgtatatatattttgagcacttctgtgattatttccttataatggattctgtgaattggaatcagtgagttaaaaattatggacatgtcatacatatgttttaaatgtgtaggtggtttagtttgtccattaattaaaatgccacttgggtggagtggatagtgtgtatggggtctggcggggctggtaaggggtgaggaaatggagaattggagttacatattctcaaggaaagaaaaggaaaatcatttgttagtagatgattcaagatcttagctattaagtaattctaaacactctaaaatgtgattttataatgagaaatcttaattctataattatagagaagggagaatttcgaatcttttcatcttctaatagaataaaaaaacacacacatttaaagtgtgtaattagttgtttatcttggcataacactgagattgtataatctctttaaaatttttttaaaaggtttatattattttcttcctgtcataaaaggaaagacacacaaaatcaatactgtaaactccgtgaaggcaaaagatggcggctgtcccaggggctctgcatctcagtcccccatagatctcttgacacatgaagagtacacagtagatatctggacagtgtagagaatctcttccttgtgacttctggagtattaaatagatctggtcaagatgattttattttcatcaaaattcttagagagtgatataatggagaaaaaaacccctgtaaacaaataaaacaaaaacagtatgtaaaggccattctgaaggttgaagtacttagaaggctggaagtgctcctctgtctagagattgcggtagatgggatttttttcttaaccaggaaagtccaggaactcacagaaaacctttctctctctcacttttcaaaggccagttacctgaaactctgtctctctgttcttcctttgccttattacagcataaagaatactaaataacaccttcagaaatgtttccttttaaaatgtagtctcctacgactgagaaaaaaacggattagagttttaaaaaatctaaattctaccatttgtagcaatacaaagaaaacacactattctctgttcatgtatctaaggtaataagcaaatttaaagaataatacagaaaaagctagataaattaacttgaatgaaatagtttctttttttcttgaaatggctcaagtccttttcaaactaccactgaagttttttagaagttaaaaaatccatggcaggatataggtttcttccttcttgtcccaattaaaagcattctgaatactaaaactctaattttattctcttcactttcgtctagatgtagaaatacaagggcagatgagcaaaggatctttgtagcagattgtttgaaaaaaggaggatttaaaagaaaaaaattagctttaactatagaaaatgttgacccttaggaaaaaatttgtaaatgcaattaaaggaaaaaaaaaggaaataaaaatttagaaataaaatgatctgtggtagggatatacagagtgctacattgaacacacgttttcacccctcatactcctggagcaagtatatgttcaggagagatgaataacaatgtcttcagtgggaagcaatggggaaggacaagaaatgctaggatgccaggggagagcatgctcttatgactttgattcaataagaaacccatccatcattccaaggttgatcattcttaccactgataaatgaattaatttacattcctttgtgtaatggccttattgcaattgtaaatttataagtgatgttttaggatcttatgcataattactgaaaaaaaaagtttgcatttttgagcctgtacacagggttggaattttactaatcaaagatttcattttggatgtttccaataatatgagtgtaagtaggaatgtgtcttggtagtttgcttggtgtacctaggatcattcacctttgacttctcttaactgggaaaattgatcatacctatttttttctttgaacatgccaagactcttggtaaatatttgtaaatttttataaaatatctggaaaattgtgttgaaggtctacaggtcaaatagcatttgttccacagaagagtcctttattggacgatttatttattacatgttctccgaacctagatataataatctattcagataaaggtaaatgaagtaagtcctatattgttttgctttcagtctttagtgtcatatttttatagcaaacactttctcatcgtactgttccagaaaataaaacagagcaagatatctgtggtatacctgtgagggggttgtctgttacaatttcctctatcataaaagcaattcctataaaaatgctcataaataaaatgagaaagggtttggaggcaatcaataagggagaaattatacaataaagttactaatctcttttcagagataattttcatcaaatgaattgtacaaaaagtcttcaaggaataattgacttcaacaagctttccactggtcagcaagactttttgctttgaagtaaaacaaaataaaacaaaacaaaaaacagatcagaaaaaaaatggtaaataagaagtagtgcctacagatcttcccaccaagaaaaatgagcagggaaaggtcaccagcgtgtgttttcaggattatttgtctatcccacagtttgtggttccaaagtatttttatcagcattaatttgtttttgccttaaaattgtggaaacattcaactcagaagagttatgccaatttaaatctcaaagaaaaatttgggcaaggagcatgtttcttggaacagggggtataaaggaaaactgatttctatttatttggtttccattaaaacaccacaagttattggcttaaatgtccctattttttatgttttgaaattaatacatgttcagcttagaagagttggtatgaaataagcagaatatgaaaatatatagccctaataatgttatttcatagctataatttgtaggtcatttttatatcagaagtagctttgtatcctccaccctcacatttttttcttactttatggtgaccattttcccgtgacatttcccattctgcaaagtatttcaccatctaggtttatcataatgtatttaatcagcctcccttttagtagccatttgtctatttattcttaattaagatgaatatcatcaattgaatatgaagtcaaccatgtaagccaaacacagttatgaaattcagatgtgtgttatagatcccagttcggcataataaagcaaaacttcgtttctctgtcttccaagtgattcatttactttcaaaaggctaacaaaggaaatgatatacaaacctagtcaattaagaagtgcaaaaatgtggagaaaatataaaaaaaatccaggtagataggagcacccaaagtccagggtcatagaaggaaagcagaggatacttcatccagtcactataaacctttaaaaatagagccatttctctactactgtgactggtttgttttcgtggccaagaactggccttggttgcaattctacatggctaagataaatgggtatatagagagtcatgtggtggcatgaagcccaagtagtattataatcccagagcctctgcaggcctgtttaacagggttgaactcatcaatgactctccgtagaatgtctgcctcatctccctcaactcacttgagtgcagagagattccctaaaacactgaatctccatgaaatggagaatgaataatttcccaaatttatttgaacgtggggctatttactcacctaaaatagctattaacctttcacagatgactactgtcctttggaacatagtttgaggaacatagctctgactagacagcattactctttctcgtactcctctagcacttatatctgttgctccttcagtatacatccttttaatatgacagcaggagtaaaacctggagtgaatatgacagttacgtgggaagtacttaagaattcctctgttcttctttctgaaaccaggtcccaggcagtggtttggttttgagtttcttgggcaattctattatgaagctgtgttcagaaccattgcctgacggtgcactttttctttatgtattttacagaatacattcaatacagcttcagatatccttaaggctaatgcaaggaccttgtagataatagattctcaatagatatttgttgaatgaatgaacacacccgtaaaacatgctaatgcaaacagtatcaaagtaagatctaaaatcaaaattaaaaagacaatccctgataacagcctccttttctgaccactgtgtatgtaggctttaaaagctagaaataattccaataagtagccatacatgcttttcaaggatactctgatcttcccagaggcttaaagagttttaaattctacaagcaaagcagaaagcagagcttctaggtatgtagcttccacgtatggcattgcaatggagctggccctccatcttttcttcttttctttcttctatagctgattattaagtgattaatatgtaatgaacactattgtaggctttgagattatgctagtggacaaaacagacagaagttcttgcccttacagaagttaaaatgtaattggggaaaataaagatcatgataagggctaaagaggaaagtaaaacagaaacggttatagggagtataaatgaggctgcaatttttatataaggaggctagcttaggccctgctgagaaggtgtcatttgagcaaacaatggaatgaggtgaaggaatatttgggtgacaacgttctccaggctgagggcacagcaagagcagaggttttgagacatgaccacacacctggtatattcgagaaatagccagggtattaggagtaagagatagtcaaagaagaaatggggaagccagatcttgcagggccttgcaggttctaatatggacattggctttaattcttacagagatggaaagtcattgaggcttttgaataaaggagtgacctgatctgacattttaacaggatcactctggtttccatgttgaataaactgaacaaggtaatggatgtagcaaagagaccaggcagaaagcaattgcaataatccggatgagataattgtggtttggaataaggtgttaacaacgggagataaacagtggccagattttatgtgaatcttccctttgatctgtggaccaatataacaagactggagagaacacacaatttcctccctggatatacatcatcactgttcatattttcttggagctcagtgtacacttctaatggcttcctttttataattgcagacaatgtacaataaaagggaaatttgattcacattcagtaagctctcagcttcttttgcttggattctgactgaccaatgagtgaaagaatctgaagaggagatttctgtacccagcagcgggtggaaatagatgaatgtgagcattctttctaattctgagattctgtgattctgtgatccttagtaactctggaaattgaatgttcaaagactgaaaagttatatatgatagtggcaccaattgtcacaataaattggaagcaaatactaatgatcatggatgtatttaaaatatttcacacctgtcctagcacagaccagtcagaacagatgccaactgtaaacagcaggcacagccatgcatcaggctgaatattagttgtgcttatgctcaggtacaaatcaaattatattttagctgacatggtctgacaaagttctacgtctgtttgaaccaagtcaagtgagcaagtgcagtgaacacagatgttttgcctaggtttgtgcctgatattttgagaaaaatattaaaaggggtataaaatacagttatgaccttctgagtgtttttaatctgtttcagaagacaacactttgcactcaaaacaaattaagaatgttgcaacatatgaggccataacaactattttacgggttcttggctcccagcagcttgcccctaacacggtaactgtgtctttcctgagatttcagagtagtgtaataatgaaagaagaacaagcttacttgcaagatattaggaattgttgacttcatgatgcttgctggcatcttaagaacagacatgcaatgtctcaagccagcgttcaacacactaacttaggcaacagccgtataaggcaatatatcttttccatattcatgatccctccctcctaccctggtttgggtgcttcccagcactataagaaccaacaatcataagccaaagtatatctggagagtgggagaagcagtcctgcaaatgcagccttttcacacgcttcaccccccgtttatgattggcttcaggaaaatctgtgttgtatggcatctgatcaagtatggtcaaggtctgcctatgcatcatctattcagcatgtaacacagttagctgggtagagggtgtgactaccgtccagaatcaacacaccaggcttatataacaaatatggagagtttgcagaattttagtttatttgacctgttgaacccccgtcattaagaagaatctagaggaagaagagaatgatcacagctttatccagaaggaacacagaatttccaaagttagctaactacagattctgtcccttaagctggatgcccattatagctcagccaaatgccttttttagtatcctcctctttaagcctgcctcactaagctggttaagtgccagaatatgtggaactgaccatgcacttcttctgcattaaatatttcggagctggtaaatttagaacaacctaaagagtcatgttatgtctctctctactgcttatcaaattggcataagggttagagacttaaaactgggggctggattttcccagagggctgaattatttaaccgtcagcaattttgaggttcacagtaaagtagcaataatgaaatcatctgcttctagatgtaaaagcatcttctcggaaggccagaaggagtttgcagctttttctatctgttgggtgttctgggctctgcctaatacacactgtttatctgacctgaaatatgagacgattctgccataggagaataaattccatataaatttaaaagggagggtctgcatgtgctgatggctccttataaggggatagtttgtcaaatttggtacatattcctctccttttttaatttttaatttttgtaggtatattgtaggtgtatatatacagagcacatgagatattttgatacaggcatgcaatgcataataatcatatcaaggtaaatggaatatccatcacctcaaacatttatcacttctttgtgtcacaaacattccaattatactcttttagttatttttacatgttcaataaattattgttgactgtagtcactctgctgtgctgtcaaaagctagatcctattcattctatctaattatattttttgtacccattaactgtcatcacttcccactgcccccaccacccttcccaactctggtaaccatcattctaccttctatctctatgaggttcgattgttttaatttttagctcccacaaataagcgagagcatgcgaagtttgtctttctgtgcctggcttatttcacttaacaatggcctcaatgatccagttttctcatctgtaaaatgggcacaataatggcaaggacatgttcctaactgggtttttgtgatgcggaattcagtcagaagagggactggctcaaagtaagtgctcagggaatgttaactattcttcttcttctttttttttttttttttttttaattttcagtgttctctgggtatgttaactatttttatttgctcatggtgaaacgaagagagctgacaagaaaatttccaccaacgaactttttatgtcctttttaaaaattgtcaaagttctattgaaatacatggggagcttaaataaaattaatgaatcatacatcagagtaacaagagtaataatcattgtatttttaaaacagtcaattagaaatgaagaaaaccttttactccaacaaaggaactgacatatttttgaaagcgtgctatatgtcaggcatttgtaatggcattgacatcatatttagtcttcccttcaccctggcactactatcagcatgtaataaagaaactaaagctctagttaacagaagctctagtggaaagcaggatgaaaactcaagtctgacacccctgaaactcctcctcttccactaactccaaataccaccacattcttcgttcttccttatgccaggcctcaattttctttctgtggtgttgaagcaccttctctctgtgctcctctcttctttgctcagcagaacggctttctgatactgctcctgaacacatggggtttcctggataaggtggatttcatgggaactgctgcaggatgtggcagcttcatgtgggtttttgtccaactttagtcaaatagcaagcctcttatgtccagtagtcaatggctaatgactctggttgtagctgttaaataaacaacagtgaaaacatttcaaaagttacagagaatcagtcagagcataaatggtaaaattgtgactgaatggatagtgtacctgcgtgtgtgtgtacctgcgtgtgtgttgggggagggggttgtccttgaagctgtctctgcattcttatgaagttccagtaataaacatttgtattcacctggcttattcaacatgctgctgcaattactttaagatatttcacgctgtttggaagagggggatttatacctgggagtcagggggaagactgaagtttactggaggtgtggagcagggaattcccagttggaagctgtttgatagcccagacttgagaatagaacagatccaggttcaaatccttgcactgcttttaaataactgtatgaccttggacagcttacttaaccccttaagccttgtttcttcctgtgtaacaggaaaataaccatatcaatgttacaagattctctgtgatgatcaatgaagtaatgagaatcaagtacatggcacataaattagatagtgcctagtgaacagtgattattaatgtgcactaatttattattattattttaaatttcaacttttattttagatgcagggggtgcatgtgcaggtttgttacctgggtatattgtgtgatactgaggtttggtgtacagttgatcccatcacccaagtactgaacataatacacaatggttagtttttcaacccctgcaccctctttctccctcctctttctggtagtcctcagtgtcagttacggccgtctatatgtccatgagcacccaatgtttagctcccatttgtaagcgagaacatgcagtatttggttttctgttcatgcattaatttgcttaggataatgatctccagctgcatccatgttgctgcaaaggacatgattttgttctttttttggctgcatagtattccatggcatatatgtggcacattttctttatccagtccaccattgatggacatctaggttgatttcatgtgtttgctattgtgaatagtgctgtgatgaacatatatgagtgcatgggtctttttggtagaataatttatttccttttgaatatatacccagtaatggggattgctgggttgaatggtagttctcttttaagttctttgagaaatctccaaacttctttccattgtggctatactaatttacattcccaccaacagtttataagcattcccttttctctacagctcaccaacatctattgtgttttgactttttaataatagccattctgactgctgtgagatggtatgtcattgtggtcttgattttcatttctctgataattagtgatgttgaacatttttttcatgtttgttagctgcttgtatgtcttttaagaagtgtgtgtgttcatgtcttttgcatctgtatttttctgtttttgttgggcctttttaaaatgagattatttgtttttggcttgttcaattgtttagctttctcatagattccagatattagacctttggtggatgcataagttgtgaatattttctccctttctgtaggttgtctgtttactctgttgttagttgttttgctgtgcagaagctcttaagtttcattaggttccgcttgtcaattccacttgcttttgaggacttagtaatagattctttcccaaggccaagccaatgtacaaaacagtgtttcctgggttttcttctaggatttttttttttttttttgagacggagtctccctctttccccaggctggagtgcagtggtgcgaccttggctcactgcaacctccacctcccaggttcaagagattctcctgcctgcctcagcctcccgagtagctgggactagaagtgtgtgccactatgccaagctaatttttgtatttttagtagagacagggtttcaccatgttggccaggatggtctcgatctcctgacctgatgatccgcctatctcgacctcccaaagtgctggaattaaaggtgtgagccactgcccctgaccctcttctaggattcttatagtgtgaggtattacactgaaatctttaattcagcttgagtttttgtatatcatgaaagacaggggcccagttttactgtggctagccagctatcctagcaccatgtattaaatagggaatcctttccctattacttgtttttgttgactctgctgaagatcagatgattgtaggtgtgcagctttatttctgggttctttactctgttccattggtctatatctgctttgtacccatactatgctgttttagttactatagccttatagcatagtttgaagttgggtaatgtgattcctctggctttgttctttttgcttaggattgtttttgctattcaggctcttttgtggttgcatatgaattttagaatagttttttctagttctgtaaaaaatgacatttgtagcttgataggaatagcattgaatctgtagattgctctgggcagaatgaccattttaacaatattgattcttccagtccgtgagcatggaatgctttttcatttgtttgtgtcctctatgatttatttcagcagtagttcgtagttctccttgtagaaatctttcagttccttgattggatgcattcctgttgtgggaagtcagggaccctgaacggagggaccggctggagctgaagaagaggaacataaattatgaagatttcatggacatttatcagttcccaaataatacttttataatttcttatgcctatctttactttaatctcttaatcctgttatcttcataagctgaggatgtacgtcacctcaggaccactgtgataattgtgttaactgtacaaattgattgtaaaacatgtgtgttcaaacagtatgaaatcagtgcaccttgaaaaagaacagaataacagcgatttttagggaacaagggaagacaatcataaggtctgacagcctgcacgtgcatgcaaaaagagccatatttttcttcttgcagagagactataaatgaacgtgcaagtagggaagtatcactaaattcttttcctcacaaagactattgatattaatactctgggaaaggaattcattcctggggggaggtctataaacggccgctctgggaatgtctgtcctgtgtggttgagataaggactgagatacgccctggtcttctgcagtaccctcaggcttactaggattggggaactccatcctggtaaatttttggtcagaccagttctctgctctcgaaccctgttttctgttaagatgtttatcaagacaatacgtgcaccactgagcatagacccttatcaggagttctgccttttgccctttgtcctgtttcctcagaagcatgtgatctttgttctgctttttgccctttgaggcatgtgatctttgtgacctactccctgttcagacaccccctccccttttgaaatctttaataaaaacctgctggttttgaggctcaggtgggcatcacagtcctactgatatgtgatgtcacccccagcacccccagctgtaaaattcctctctttgtactctttctctttatttctcagccggccaacacttatggaaaatagaatctatgttgaaatattgggggcaggttcccccaatacatccctagatattttactttatttttttgttgatattgtaaatggaattgtgtacttgatttggctctcagcttgaacattattggtgtacagaaatgctactgatttttgtgcattgattttgtatcctaaaactttactgaagtgattaatcagttccaggaaccttttggcagagtctttaatgttttctaggcatagaatgatactgtcagcaaagagatataatttaacttcttattttcctatttggatgcctttgatttctttctcttgtccgactgctctggctaggacttccagcactatattgaataggagtggtgagagtggacatcatgtcttgttccagttttcaaggggaatgcttccaacttttacctattcagtatgatgttgcctatagatttgtcatagaaggtcttattattttgagatatgttcctttgatgcctagtttcctgtgggtttttatcatgaggggatgttaaattttattgaaagcttttcctgtgtttattgagatggtcatatggtttttgttaattctatttatagagagaatcacatttattgattttcatatgttgaaccaacgttgcctcctaggaaagaagcttacttgatcatagtaaattgactttttgtgtgctgctggatttggtttgctagtattttgatgaggatttttgcatttatcttaatcagggatattgacctgtatttttctgtgttttttttttttttgggcctttgtgcactaatttaattagaagtgccagatactcataaacagcaacgttttcctgggtcccacagtggtatcatagatcttttccttaacaagtatctattgaaactttgctgtttagaaacagttgcatacacactgtggcagcaacttgtacatgcctgagagtggacacttcttatcagcgttaattcaactacacttcacagctctgagaggatgtgtaatcatcaacatagaatttgatggataaggtggtagaaggatttgcttagttggatccttctcattttttaggttttgcacaaataccacctcctgggaaggagcttccctgaccatgatgtctcaaatacccctcaccttacccatgacccagccagctgtaatctgtcctctttagtattatttatttgcctactaattttttacttcttaaataatagactttatgttttgagccattttaagttctcaggaaaattgagcagaaagttcctatatatcctctccctctcaccacatacacaatctccccactatcaacatcttaagccagaataagacatttgttagaattgaattggtgaacctacattgacacatcattatcatccaaagtccatagtttacattagggttctctctaggtgttgtacattctatcagtttaaacaaatgtttaatgacatgtatccacctttatagtaactaacatgcagcatacagtcagccctccatattcatgggtgctacatctgtggattcaaccaactgtgaaacaaaaatacttaaaaaaaatggacagttgtgtctatactgaatatgtacagacttcttttgttttccttattccctgaaaaatattgtataacaactatttacatagtatttgcattgtagtaggtattataaagaatctagagatgatctaaagtacatgggagaatgtttactggtgatatgcaaatactacaccattgtatgtggattttggtatccacaggggttctggaaccagtcccccaggaatactgctggatgactgtagtttcactgtgtttaaagtcctctgtgctttgccgattgatctccccatcttcactaacccctagcaaccagtgactttttttttcttttctaagctgacctataataattgtacatatctgtgggggtacattgtgattttgcaatacatgtaatgtatatgatcagagaagggtaattaagatatccattatctcaaacatttatcattttcttgtgttgggaacattcaatatcctccttgtagctatttgaaactacatattattattaactataatcacactacagtggtatggaacactagaacttactcttcctatctagctgtaatttttatgttttaacagatctctccctatttcccctgtaccctactcttcccagcctatagtattctctgttctacttttaacttctatgagatcaactttttcagcttctacatatgattgagaactttaactttctattcctggcttatttcatttaatgtaatgccctccacttccatccatgttgctgtgaatgacagattttattcttttttatggctgaatggtatttcgttgtgtatttatatcatatgttctttatccattcatcagttgttggacacctagattgactccatattttggctattgtgaatagtactgccataaacatggggtgcagatgtctctttgatattgctaatttcccttccttgggatagatgctcagtagtaggattactgggtcgtacagtagttctatttgtagttttttgaggaacctccatactgttttccatagcggtgttatgagtttacattttcatcaacagcatataagagtaaccttttttctgcatccctgccagcatttgttattttctgtatttttgattacagccattataattggggtgaggtgatacttcattgtggttttgatttgcatttccctgttgattagtgatgttgagcatttttttcatgtatttcttggccatttgcatatcttcttttgaaaaatgtcttttcagttcatttgcccatttttaaattgaattgtttgttttttgctgttgagatgtttgagtttcttgtatattctggacattaatcttctgttgtatgaatagtttgcaaatattttatttcattttataggttgccttttcactttgttggttatttaatactacccaaagcaatctacagattcagtgaaatctctatcaaaataccgatgatattcttcacaggattttttttaatcataaaatttgtatggaaccacaaaagaccccaaatagccaaaacgattctgagcaaaacaaacaaagctgaaggcatcacactaccagacttcaaaatatattacaaagctgtagtaactaaaatagcatgatgttgttataaaaacagacacatagaccaatggaacagatgacagggtccagaaattaatccacatatctacagccaacatttaatttttgacaaaggcgccaggaacagtcattgtgggaaggacaatttcttcaataattagtgctgggaaaacaggataactatatgcagaagaatggaactaggtccctgcttctcttcctacacaaaaatcaactcaaaatgaatcaaagactgaaatataagacctgaaactgtaaaactactagaagaaaacatagagaaaacaattcaggacactggcacaggaaaggattttatgaataagacctcaaaatccaggtaacaaaagtaaatataaacaaatgggattgtatcagactagccactaactttactatctccacactttttttctctataatgtcatatagttggatactttatttttaaaacatatatatcactatttgtattatttacatgttttattatttatttttttctccctctagaatgacagctgcatgaaagcacagtcattctcttactttttaaatgtcgtatcctcagtgctagactatgattgtctcagaaaagtcctcaataaatatttattagttaataaatgagtaaatcttccctccattataattactctcatccttctgctaacattagaaactggtcgttggaaatacttacatagtggcaataacaatattggttgtcatttttattatcttatagatgccaggcactgtggtatacattctaagtgcattattttattcaattctcagaactaccttctgaggtaggtaacatttaacaggtaatataggtagtatataagtagtcgagatattttttaggtacaaaaatgagattcagagaagttaacttactgaagatcacatatttagtaaattgcaaagttaaggcctaaattcaggactgtaggattccaaaggtaacagtctttattattattattattattattattattatacttcaagttctggggtacgtgtgcagaatgtacaagtttgttacataggtatacacgtgccatggtggtttgctgcacccatcaacctgtgatctacattaggtatttcttctaatgctatccatctcctagtcccccaccccctacaggctccggtgtgtgatattcccctccctgtgtccatgtgttctcattgttcaactcccacttagagtgagaatatgtggtgtttggttttctgttcttgtgttagcttgctgagaatgatggttttcaacttcatccatgtccctgcaaaggatataaactcatccttttttatggctgcatagtattccatggtgtatatgtgccacgttttctttgtccagtctatcattgatgggcatttgggttggttccaagtcttcttaaactgtatgttggaatttagagtgagaggaaagtgtatagctaatccactccactctttggatttgaaatacggttgcttaatctaagtgccttgatatttaactctagtccatttaataattacacatctactatttgctgtgccatgtgctctagggttatcacctgacttttcttagaaatgcagacttttagctgtactccaggcctactgatgcagaacctgcatttaaacaaaatctccagcagctttgtatacatgagatatgtgtgtttgagaaacactgccctctaaggaatatcaagacccaaaactcccatgtccttgactagtgagcaaacaaggatcttagcttttagaataccttgcactttaggaggggtcatagttactcatgcttatcacacttgctagcactaatacacacccagaattattataaattatacaagcaatgaactatcagccagctagtaaggcagatagtgttgctgagggtgaacaagccagcctctagcccctcgacagtataaaatattcttttccaataatgcatagacaatgcaatttctttttctcttgctgtgattcactggtggcgtgggcatttggtgtcatgttagcttttctaactgtagttgtgtagagttctgttataccagttagactgtagtacatctgcaattatgcagtaatgtgcattgccaggaagggctgatattttactacaaatcacagaagagctactgcatgtccaccagggaagttgtgggtggtcaatcttagcacatcttgaggctgctgtgttcttacaatagggaacaaagtgttgactgttttctaacatctctggtccaaacaaacccaaccttcgttacccactttacagtttatgagcatttatttacacaagggaaaatgaattttgatactccaggtatgccatctatcccagcctgtctgcatcaaaatgccagattgtcatctccagtttaggccccctctttttctgctgtaagttgtatttcagtctgaggatgaattcagcactttaatcagtgcatttgttttctgctttgtcatccacgtaactggcaagtctggccagggcactgtttgcagatgaaatctgcctgtgtctggaatgcagagtggccagtttctccgacttttcttctctttctcagtcaacacagccactctttccatttgttcccagttctatgcagactataattatgtatatttcctttcatgccacttacacttgtacatttctgcactagggtgaatgcaattattccattttctccttttttcccctttgtggctcaaactgttgccttgttctttctcattgattcctgcactgcaaaacagtcaaatggaaatacaatatgttgcacctgacattcatttaaatcacctgccatgatggtaatacatgctggtgatttcttagtgtactagtcaatggaaaactgtattagtattgcaataatatgcctatatttgctttttctggaatatactgtggtttggtgcgtgaacgattcaatagaattttgaggatgtagtgggaatgagtaataacacttcactcaatatgttctttaatgttcaaatcctaacagtcctagcacatccttttgcccttccaataagttagggtaggaattaactcttattgtgcactctcactactcaaggccctggactaggtactctgtatgtacattcttagtttcacatatatttttgcgtaatccttattagagattaaaattttaacatatacatatactttattttacaggcaagggacttaacattcatagaattaaggtgaattttttcaaggtatcatagctggtcaatgacagaatgaagatttgtttgactccagcatttatccactttctacacactatcttcctctttgcaaagttttaaattccagaaagtttagcagcctccttgctatctgatgctgattaattgggtggaatagagtctattttttaaatctcactcaaagtattcactgcaaagctgccgtgtgtaaataattgtgtgtgtgtaaaatagatgctttctgtaatttgtgagtaatgtattatgggtccaattgcattttaagaatcttttagcttatcctaaatcctcatggcatttttaatctagttttcattgtgtgtcagtaaataatcctggtgagcaagactaaagatcaagtgctagccctggctttgccatatatttgctttgtatcctagggaaagacatgtcaagcctctaaaacttagcttatttatctgtaaagtagagtaatacacataccctattcacctcacaggattgttgtatatgttgaatgagataatgaatatgaaaagcttaggaaaccacagtcatacatagaaatgtatcattgtaagtcaataggtgtttgccaggtccatagcattagcctacgttagacactgcactgaggaggctactaggatttctttgccttcaaagaagttaaaatgtagacaaacaaaaaaagtagtcattgaacagtcttgacgtttcaataaatttacaaaaattactcattgttttcaatatcatcagcagttaattctcaagtagagtaggcatcatgagaaatgctattatctaatatgttgtaattcacattttaagagtatattatattatattatattatattatattatattatattatattatatttttgagtcagggtctggctgtgtcaccaggctggagtacagtggtacaatatcggctaactgcaacccccgcctccctggctcaagccatcctcccacctcagcctcccaagtagctgggactacaggcgtgcaccaccatacctagctaatttttatatttttggtagaaacagggtttcaccatgttggtcaggctggtcttgaactttagctcaagtaatccacccacctcagcctcccaaagtactgggattataggtgtgagccactgtgcttggctttcaaagttttttaaaaataagtcttactttactatgtcttgcattcaacttgtcaaattgttacagtgaaaaatgccttctaatctaccaagaccaagttcaaagcctaccacttactacaacaatgattttccaagtgtggtccctgcactagcaacatcagcatcatctgagaaattgttagaaatgcgaattcttgagtctcaccccaggcctactgagtcagatactctggggtgtagcccagcaatctgtgttttaataagccctcctggagattttcatacatgttcaagagtaagaaccactgctctactaaaacctcaaggtataagtcagacgttaagaactcaaaggctcaccgaggccaagaaggacacatgaatgagggaaaggactggaaataagattatcaggagtgggaggaggaaactgtgttgaattggagagctgcccttgcttaatgggagcagctagtgattattctagacattggttcccatttaggaatgtgaagcaggtccaaatataattttccaaaagctgaaagaaagcatgactgtcttacaaatatacagtgaacgtgtcaaagattaatttaactcataataagaatttagtaagatgacagctggttcaaaggagaaaatgagaggctggaatatttatacagtcaacagaaataagaatactgagagaaaataaagttagttaaaaaattggttaataccctacaaggaaacaaaactgttacctatggagttatttattctattgtacaaaaataatttacaatcactcaatcttctacaagttggcatctaactttatagacttttaactctaatcagtagtacacagtaaatgtaacaatattgcatcactagagtctagggcctagacaattgtatgagtcttaggcaggtatcttagtccattttctattgctgtaacagaatatcacagattcggcaatttataaacaaatttatttcttacagttctggagactgggaagtctaagactgaggggttgcgtctggtgagaaccttcttacggcatcataacatggcagaaaatatcacatggtgaaaggacgagagcatgtcagctcaggactctcttgctcttcttataaaaccaccaatcccatcatgggggcccaactctgtttaggatcagaccttatctgatcctaattatctcacaaaggcctcatctccaaaagccatcaacgtatgaatttggggattacgtttccaacacatgaaacttgggggacatatccaaaccatagcagcagattttttagacaatattctattatgactgaatgagcatgctgtagtccctttgtctcatttttgtcttatttccaaggcctgggtgattttttcttaacaagcaagtgtggcagaccttctacttttaaaggaaaatggagatcaagatttatatgtgaaattttttctttaacaaatataggctaaataaagtgtgcttgaggactggcaactgtggattgccaccttgcaaaccagagccttctaccgtttgagccagtatctttcaagcctcagagggagggcagaagcaacccagaacaaagaaatcaatgcctagctttgaattgaaaaatgaacttttaaaagtgcaccgcagaaaaaataattttgaaacccaatgcaggcttcttgtgagattgtttttcggttcgtttgtttgtttagttccaaagattgactttgctaataaagattcaaagtttggtgaactcccaatttagagtttgttcattcattcattcactcatcctacaaacatttattgagtatctgtaaagtgccaggcactgggtattcagtagcaaacaaaataatgtgttctcatggagtttatgttccaatgggtggaaatgagcatatatcagcaaataaacaaatagtatgtcaggtgataataagtgctgtggggaagaagaggcagagagaaggagaagagggtcacagagggcatagggttgctattctacgtatgatcatgagggaagagggtcacgcaggtgcatggcagttgaccagacctgaaggcagtcaggaaaaagatatctggagtctaagcaatggggacagcttgtgcagaggcctgaggcaaaagagcagagtgttagagaggaggcaggaagggcagataatatagggcttcctgggtcaatatcagagctttggattttattaagaatgaaggggaaaccaatgaaggattttgcggaacagaagaatgatgctatgttacttgcattttaaagggatcacatggctgctgttctgaatataggttctagagaatcaaaagaggaagcagatggaccagtgaggaggcaatcacagtagtacaggtggaggatgatggtggctcagaccattattgtaatggcaggcaggtgaggaattatcagcttctgtatgtatttatcatagtcagtcagaaacgtgtgacatcaaagcagacaattttgtgcctaatgggcaggaaatagcactagaggagctatgagtcgagctgaggtgtactgagtctccatgaaatgctcaacccctcttccctttgcttgataccaagctctggagataaagagaagatggagacccttggagaaatttgagggaattctggaaagtggttttgtttttgttttgtttttttctgcaaggacaactatgccctgtgaagtatcctgcatcctgcatgatattatgatggtagaggagcaacaactgggcgaggagcttgggaagatggacaagagtgttgcttctcaaattcctatgcatcccgcatggtgaacaactaaaagtttcccataaccctaagaaagaaacaacgataggaggggaaaaaaccagcagaaaagaaggatctgtgactaggatcaggaggacacagtttgcaaataccactttaccaggacccgtgaaagggccagagatgctggtggcagtagacaaataagattggattccaatacctagaaccaggtagtctgaaatgtgctacagtgtacaccagcaaagacaggggcaaataacgaagacataatctcttctcccaaaaaggagggtttatcccaacagagctttgtaaaatgtgtgcaatcttcatcaacaagacaatactgataaaacaacttcagacaaaatgtctgtttactctatcaggcccgagttgaatggggagcaattataattctagaattttgaactaggtaaaagtatccaggtatacagggctacttgtcctaatagagatttttttttccccctgcctaacctatttgtattgcctacacagcctgtagcaaaacagagtagcaagagtagtcacttataagtagtttttcttataatttttttttctggttaaaccactgagattatgtactgtggcaaaaaaagaaaaaaaatgcttagcttccaattttatttgtggtaggaataatctagtcccagctttccctctacccatacccttccacccatccttccccaaagtcttcagattctccatctataacgtgaagggcttgtgcagaaaataattacagttcctttaattctaaacatggtggactttctattgccacgtaagcatttccaactataccatcccctttcctgtcactcacctcagtgtctggcacaatgccttgcttatgttgggtactaaatatctttttgccttatgagtaaatgatgcatgagaaagaagacttcagcctgagcccactgtagggccttgttgaggtaaagggcttgatgggccttggcctgaactccattggaaccagattataaataagccacaaccagcttatttcctgtctctttttcctcagtgccaccacttagctactttctggtttagtcctttaggaaaaacaataagcacctttctcatttcttctcttttccttcactggcagctgttttaaggcattaaaactgggagccgagcatgtccagaagtgaaagattctctcatgatgacaaattgagtctctatttttaaaaaatgtatgtaagagtgctccaactggtcatcaaaagggctaattagaaacttccaatccccaggagcactcaagtagaagacggatagaagacacttcttagagcaacactgctgctttggtccgactgtgcctatgaaggaactgggttttgcctggtctccatagataccgccttcttcactgactttatcttagactcacactacttgtttccaatacgagatagcaaagcatatgaatagaaaatgaagagaggtgacctgattggactgaggaaggcaaggccccttgaggagacagacagtttggtgttttgttagaaagtgatatgcatgggaggaagagggagagagagaactattcagagaactgtgtgagcaagggggagcagaacaaggtttatgtcaagaacagcaagctatcaggtcatcactgtggctggagctgtttttttgtttgttttattgggacagaaacttaagttgatggtgccacttttgagaggtttaaaatctaaggccaagaagtctgtatttcacaaaatccataattcaagaaaatgtggcaaggtccatgtgattatctgctagatgtgtggtacagagaggagtggaacatgagtaattgtgatccaaacctccatctttggccttgaagcaaaaggaagtcattcgttttaaagatggatgtagaaataatttctgttgataatttttgggcagcacttgacttctatggggtttttgattcagaataaatacttacctacataatttcatttatttgttctgctgaaaaatattgttttcctgctaaaaagaaaaaccttcaagtgttcataaacctttctgattatctgcagttctactgatatgttcacaaaaaaatagggataaatgaattcgaaatgtaggaatttaatttcctgagaactatgtatgttttctgaatgaattaactatctataaagtatgacaatgtgcaatgcagtttaggctttacaaatttttttcatggtttgaaatttttctctttatctgtgttctgattttatatatttccctggttccatacatatactggttctagaatgaatcactatggtgtctagttttacactcattaatgcatgaatttgatatctgaagcctgagttttaggttaaatatggtggtagggtggaaagagcaaaggactttgagagagaagaaccaaggttgggatccccattctaccacttcagagtccagtggcccttgagcaattaaaaaaaatctcccaagatcatttttttctcatctgtgtagtagtaaaaacaataccaacctccatcttggtagagaaggaagataagagtttctctcacaggtgctgaacaatcactattcttccctcttctttttccataaaatatattacttgcttgcatagtctttctcctaaaaattgtcattttctctgaaaagtcctcctaccgtgtgaccttaagaaagtgatttgtgtcctccgagcatcagtcactctttatgtaaagtgagggactaaaggagattgccaggggaccttacttcgattagtgtcattcagtgagtttgggggatttcatctacttcttgactccactcttccttgactgtccatttcctccctccatcccatgaatcctatagggtttcagtgtgacttacataatgggtgttctatatcagacatcctggacttgctgatgagatttaagcctagaaataagttgatagaatttgatgagacctactcatggagcaggcagtgtttttcctcttgttagctaactttcttttccattccaaaacattgtgatttgcaagtctttaagaattttatatcttctgacaatttagcacaacctgctcgtataaaatggtgttatacaatccagtagcagttgttttctttttttaaaaaattttaggacttttttttttttttgagatggagtctcactctgtcaccaggctggagggcagtggtgcaatctcggcttcctgcaaacttcgcctcctgggttcaagtgattctcctgcctcagcctcccgagtagctgggactgcaggtgcgcaccaccacacccagctattttttgtgtttttagtagagatggggtttcactatgttggccaggatggtctccatctcttgaccttgtgatccacctgcctcggactgccaaagtgctgggattacaggcgtgagccaccacgccttaaaaataagcttaaaataagctaataaagtgtgaaattcttgaccatgctgatacagtttctagcgacctctgtcacacacatccctattagtctcagcacttgagtattctgttatggagctcaagaagtggtcacaaatacatacaacaggtaataaggtaagatgataatatgtttcattcttttactctctagaacaaacattataattactaatttacctctcacctaaagaaaaatcccaggaattccagcgtgctttaatgtagtggaaagtgaactcaaataagaagacctgggtataaatactgtctcccagtttctagctgtatagccttggtgagttaatttgagttaattttctgagctttaacatcttcatgtataaagtaggaataataaccctggtatcccaggatgttgcatggattaaaagagttgatatatgtaaaataacactgtaaagtctaaaacacaaaaattagcattattataaaataacttctttcttgttcctaacatcgttactattattgttttaattttatttaatttttttatccagatgctgaattctttaatatgccactgttttataaaagaatttctttcttgttcctaacatcattactgttttaattttatttaattttttatccagatgctgaattttttttttctttttttcttttttttttttttttttgagacggattgttgctctgtcgcccaggctggagtgcagtggcgcgatctcggctcactgcaagctccgcctcccgggttcacgccattctcctgcctcagcctcccgagtagctgggactacaggagcccgccaccacacccggctaattttttgtatttttttttcagtagagacggggtttcaccgtgttagccaggatggtctcggtctcctgacctggttattcacccacctcggcctcctaaagtgctgcgattacaggcgtgagctgctgcgcccggcctggattcttaaatatgcccctgttgttaaaaacttctataaaatacaaggaaatcatagatgatcaaagaaagtctatagagtgatgaaataactaaattaggtaaccaaaagtgaaggcaaaaataaaagtattatttgtctttttcacccatgttttaagaaggtggtgcccaaagttttagaattagaaattctttttcctcacattttcagatttgagagagattacgtatatatgatgagaaagagggtctccctgtgtcacccagctggaatacagcgatgcagtcatagctccctgtaaccttgaagtcctgaactcaagcgattctcctgcctcagcctttcaagtagctagggctacagctgtgtgccaccacatctggcaaatttttaaaaaattaaaaatacagtgatagggtctcactatggtgcccaggctggtctcaaatttctgggctccactgatcctcctgcctcagcctcccaaagtgctgggattacaaacatgaaccaccatgcccaacctgggagagtatcttgagttgattttcggcatgaatttatttctttgttattatatgtaaacataaggctgacatttagctgtcatgcttgttaaaatattacaatatatccatattctgctgttcaaagaccctcctactaccaccacaacctctgccaggagtgcccgctccacagcccagcaataaagtgggtccactcctagaataagtgggggcctctagaaacttgcttgatcacaaggcattcattctgattgatgaccctgcagaactaactggtaaccgttttgagtaccactcttaccaagttctacattgaggattaagtggctccattactaccagaaggtaatgtcttttcattaacagaaatgctagatggagcagttatgagcagcactttcccttcaaatgccttgctggcattaaccttagagatttaattcaattcataaattgctttaaactatagcttttatatatatatattctgagtagaccccccggggtcagtgattccaaaaaagtgtaagaattatcatgttagactctttctaaaataatacattattaggtttataatgtagagacacagggggaaatgtgtacaaatggaaaccacactaacaagaagtacagttgtcagcagtttaatagaaagaattttaacaagacttgaatgatttttttaaagagtaaaaatgagtgtggtctagtctgcagcaggacatatgcacatttccaacataaacaaatggatctctatggcgttacctagacttacatttatatttactaaagcctctctacaaaaatgagaggatgaaatttagtctttgatacccacttctggaggaaaatagagccttccttgctggcttcttccttgctatccagttcaggcaaagttatattgcaacatagactgtgtcagaggcaattaagctctttctggagacactaataccaattttccaagcactattttggaatgatttaattatattaagatcaataacaatagctgattgtataactacatttactatttgtcaggtactatactgagttctttatttacattctttcattaaatcattggtaacaaccaatgagatggatattattatggcccatatatagatatggaaattgaggtttagagaaattaacttgcgtaaatttccagagttcattaggtagctcataagcaggaatccagagccttcataagctcatgagcagaaatccagtgtagggtaatatactgtctgcttcagtatttcatttgttccaggtcttcagttttaggagatgtgatttacctgcttgttacccatgcttgtctcatctgggttatatccccacccccctgaaaaatcacaagtgcacaagaagcaaagactcatacctttttattcagtttgtgtatggtggctttcacatgtacacttggttaatttttatgtttagtaatcattataacaatgatttttttcttttatggactattccccactttccagtgtcaagttattttcttttgaaaaattttttcaatacaatattttctcttcatatattattactgctactactgtatgctttcttcactagttcttagatatgttgctagatttcaactaaatgtatgtaaacacattcgactaagtataagtaatcatggggtttcatcggtgaagctaaactcttagacataatattacattgctataaatacagttatccccttccccacctccattcaagacaattgactattggccccagtcttccacctattgttgttgttttgctggttgtgggtgttgaggggctcggggagttcatggatggcaagataaggctgagcaggaaatgtcacgcaacccctcctcagtaagtggggagaaaaaaattgggtcctggagtccccagagttctacaggcccaacctccttgggtcaagctggtgagatacctaccagcttgttaggtgtctagaagtttcagccaatcactgagcctagaatctcttatggacattagagtgggagcaggaaacttgccaccaggttgtgccaaaccacaactaagtgttggatatgatctctactgagatccctgaaactgctcccacccctcactcctgcttacagctggaaagaggcacaaagataatttattatatatggtagaacatataaagatttatagttgaagagacctgggttatatcctgttgcttccaaggtttttgtggagtctaaaataagacagtggtgagtgcaagcaggcaggaagcacagtgtccagcatttaccaggcactccatagtattgtttggacccgacctagaaagaattgacttggcatgcagtttgttccttaaatattgaattcacctatgctattgccacattactttattgaaagcagggtaactttttctcacttgatgttgaatgcagcagaataaacctgtttccagaatgagaatttttttatctgaaaataactgaaccacatcttgtctttaaccaattcactggcttcagcaaggcacctagctagggcctggcatacactattgaaaagcagatgtcatatcccagagatgtctagagatggggatggcattctttatggaggggcagagttttgttggcagctttacagtaattcatcaatagaggaaaagcaacattgcataaaagcccaagagaagcttgagacctgaggaaatgtcttagccaagcagagagagcagagaaaggaaaaaatcttagaagctgatcacaggatagcctgaggatcagacaatacagggcagcctggcacaatccggaaaggtaggagacaggagtatcagattttgtctacaaactctggtgataaggccagggatgaaggataaataaatatagaaaatgtggctgacattctggtatgcaactaaaagagccaaacctctatgtgaaatcgtctgaaagtatctagggcaacagtaggcagcacattgagaacctcaaactctgaacccatcgcagtctgcttcagggatgcctctgacttgagataaggcctcagtgtatctctggacctctctgggcctctgttttccacagggatcgctaatatactagataaaaattcttataattatgttatcatgattaaaaataagactgcaaataatattcttaattggtgcaaatttacaaggccgaagaagatcggcatacaacaaagaaaacggctatggcttttccatacttgcaagtatagagttgtgccctcaggaaatgcccagagatttcaaaggttaacaaaggtatcaaagaaacagtaattactaaggttaatctgccagtaattattcatctcttttgctccttctgaaacagagcataggcaatatcagaggaaatgaaggtgtgggatgaagccagttccacgtctcttaaatggctccttattgaatttagaaataccggaatcattaaactccatgattccatggtagatcagcttgatgttcctatgtatttctaaagaagattatgagctcagattttttttaagtcagcagaaccctattcttcacaacagctcagcaggctttgtaaagctagtcagactgaatttttttccaggatttaaattaacagagaaaaagataaaacgatcatttcagaagcagccctttaaggcctataaaacaagctaaattgaaagtcagagttaggagatagagcctttgtgaaatatgtctgtagagatagaaatctagttactgatgcctctcctagacacctgtctgagtgtggaagcaccaaggaaacaggtcagatgtcaagactgtgacgttgctcttcaattgtaggtaggatgaagtcagggggtctgaaagtcacatttttttttctgatccattttagaaagattcacatttagtattctgaaactcaaaactgcttcagtctttttctgctattatatgtgacttaatatccaagtcttgagtttttgaaactgttcttgtcaattcagaagggctgaaaagtaccactaaagcaaatcaaagataggttcactctcactgccaaaagtatttttttaggaccggtaacagtattttctctagaaaaggaagaacatcatattgtgaagatgcttgaaaagtataaactattttgtgcaataatatcattaaacgattcgcatcgctcatctgatatcctatgtaccttcaatgttttccaccctacactaggccccatggagaatataagagagcacgaagccagtgatattcaccgttgacctgcagagaaaataaaggtgtgtgttatttgaggcagtgtataattagatagcaaactggatatcatttagcaatgcataaaataaagatttggaaactggagaaatgaatgagaactaaggatctcttcatggaggagatgtgatgtgacctagctcttgaagaaaggggatggtctggaaagattgaggaacagataaaatctcatttaggccaggctatatgtgatgagggggaagggaaggaggaacaaaatgagcaaattatagagccaggaatgaaaagtgcacagtgtgcatgtttgtgttgaggctagggatgtgaggaagggaaacagagtggggtaggcctggggagtacctgccgagagctcaggtgtggtagggtcaaatgaagctgagaagctaggcacaggcatttgaactgcctcattcatcttcaccttgatcctggttcatacccagacctttatatctatgttcataatgacagtaagataaggatttttttttttcttttttttactagctgtggaagcatttcctgctccattttctaatcaccaaccaccaggactgaaattctacttagtttcaaagctattcaagtcagtttagctcctgacccttaggactgctctcacttcttacatggcatttgaagttttcttttcatttctctttgtgctggaccagatctcacagtgcttagtagctggaaggcttcatccttgtcaaacgtcagcccatcctcttcataacttgctaaactatgtattaaggtaggaaatagtaatccagtaataacaatgagtgaacgtgataaagatacaaactctaactttcagttagagttcccctcctttataggctaacaactcccatttatatttatagtatgtgctttggaagaagatatgaaataaaacataaattttttatgttaacagtctatggcagattagctacaatcctaaaaataactttatagagattctaaatacacagccacaattatttttgaaagtttaaaactatttttaaagctgccataatttagtaattctgaaataaaatgcaaagtgtaatgcaacggtgaaccaggttaacatctgtacagctatatatagctgcttaatatatcaagagtttggaaagactctactttagtgggcctagaataattttattttcccacaaatcctgaacaagtacaagtgttgcagaaatattgtcaaagagtaaaacattgagtctatcaggacatttgagtaccctgaagagagtaaggcattcattgttttaagcatttttatatgtatttataatcttttaggtaattaaagataatgatattttagagataactgtgctcagcacattgagtaattaagaattcaccatgccatgtagatttggatgcaggaaaaatttgaattacagtgtatttagataaaaaagccatcatgccatttgggttctaaagaatggaaaaatttgaagtcctctaaaatattttcatttacattttagaaatcttcaaagtccacaaagagtgatgggagttgaatatttcaatggaaggaaagagaacacttgacctcaattatagagagcatgacaaagtcaagaaattttagaatctctaattgtccagagttaatatttttgacatttttgcatgtattcttcctgtatatatatatatatatatatatacacacacacacatatatatacatatatatatacacacacatatatatacatatatatatacacacacatatatatatattttagagaggtgaggtctcatcatgttgcttaggctacagtctcaaactcctgggctcaagacatcctcctgcctcagcctcccaaagttctgggattacaggcataagccactatgcccggctgtattaagatgtgttgaaatatattttaacatgctttgagtcttataattctctacatactttatttatttagtaataaattgtgtttattggcccacatcattgaaagtcttctatataatgtttaatgataacaattatctatgaaacaatgatttcataattaaccattcccttctcactgagtatattatgtccaatttttctctattataaaaatagaacattttaatagacattttatgcatatctgattatttccttcatctcaaattgctgttcaaaatgcatggacattttaagacttttcatatgtatttcaaataaatctacttcaaattaaatcctcacaacatgtattagtgtcattaaaattctttattgaggccggaagtggtggctcatgcctgtaatccaagcactttgggaggccgaggcaggcagattgcctgagatcaggagtttgaaaccagcctggccaacatggtgaaaccctgtctctactaaaattatctgggcacagtggtgcatgcctgtaatcccagctactcaggaggctaaggcaggagaatcgcttgaacctgggaggcggaggttacagagagctgagatcgggccactgcactccagcctgggtaacagaatgagactccgtctcaaaaacaaaacaaaacaaaacaacaacaacaaaaaaatctctttattgagaaggattttttgaaaagccccacatgtgggacatagaccaattttcctctcagacataaactatgtggagctataccttaggatcccggtatctacatattatgacacatttccttagcaagctgctccacagttcagcggtcactagatgtttcctaaaaaaattattgagttggatttcagggagagcttgaagcagttttcatctctaatcattttttataagggatttcataacatttgcaaaaaaaaaaaatagaaatgttgactccatgataaattccagtagcttcttctaataccgcacattggctgtcacctttatggccagtgagatagcacacaggaacttgaatcactgcataagatcttgcataaagtgcctcagaaaaataagtaagtatataagcaaataaagagtaagctacaacgttgtatgtcttggatttctaaaaaaagaaaaaggaaagagcaagcactgaattaaaagtcaagaggaccctagtctgcctccctcccagattgtaagttatttgaggtcagggagcatggcatctgtcatcaccatttctctctactgcctatgagaatgcccaggaaacggccctcagtaaaagcacgttacctcaatgaatgagtgaatagataaaagaaataatgaatgaaggaatactgagcttgaggctcttagaagaataacatgtggggccaggtgcagtggctcacacctgtaatctgagcatttggggaggccgagatgatcggaccacctgaggtcaggagttcaacaccagcctgggcaacatggagaaaactgtctctattgaaaaatacaaaaactagctgggtgtggtggcacacacctgtagtcccagctactcgggaggctgaggcaggaaaatcacttgaatcccagaggcattgaaccccggaggcagtggttgcagtgagccaagatcatgccactgcactcgaacctgggtgacagagagagacttcgtctcaataataatgataataataacatgtggtttacagcaacatggaaacagtgcttgtgtgtcctgagcttacctaccctccaggggatattttcatggagatacaggaagtgcctaccccaacaaatacctccactccttgttcaggaatatatatgcgcaattcagtttttactctcttaaatgtatcttgagaatgagttgtctgcacaatttcatcttttctttgtgtgtgtgtatgtatgtgtgtgtgtgttttaagaattgcttttcatagtgctgtaatcaagtcttgtaccttgagaacagatagagatcttaattttctttattggaaacaggcttattaccagggtgcaaggtaaccttttcccaaataggaaaatgtttcctcaaaatgaagacacatcatagatggaaataacattgaaaccctgtattttaaagaccattgtctatttcagaaaaaccttaatgatgaacattaggtacttgaaaaagaactagtgaaaatcattaaaagaaaagagaaaaagaaattataaacttaaaggagtgttggaatgaagatttggtgatagacattttacaaaccaaggcagcgtgggaggtcttcaattggtatttttaaatgtgagcagatgggctgagcattcttatagaaagtggatgtgtgtgtctatgtggtgaaaatgtagttcatgaaggctgttcctttgcaggtgggaataatatgagctactcgctttgcaataacaggagaactaaaatcaaatccgcaaatcattttacatatggtgacccagttcttattttctcattaactgtccagggagttgtttttttcttttcatttgataatttgagtgaaaaaggtaatattatcaaaagaaatttgaatgtccagcaagtaaagatcagacacatcatagcagaagaatatctattacttggctctaaaagtactgggtgtctctgaggttaggtgggacaaaaattaaagacacacttcctacttacaaatctaatctgagaggcaaaactgccatgaaattaaggaataagagcagttaataaataagttttgaatatatgcattgttgttattgttgttgttttatcttaaaagacagtaaagggttaagaatgcagactctggagccacaagacttgggtttaaatcctggctttactaaatatttcctagctgcgtgaccttgggcaaatcactcaatcttcctttactccagtaaaaagaaaggaacaaggagaataatagtacctatcgacagggaagtttaggaagactaaattagttaatatatgtaaagtgcttagagcagtgtctggcacattgtgattgctacataaacaaagtgtttttatttactattacttacttggtattaatttgatattacacaggtaactagagtttgaaattatctttcagacaaatgtaccaaaaatattttttgttgccatagagaacacgattatctttcatgaagtgaatgtacaatgttgctattttagataccctgccccccgccaaccataacccctttcactagaccttgctatctccctgcacctttctttggagccaaatatttacccatagttactgcttgtcataaaaagagcattttcttttgttttgtttgaattgaagcatccttttagggctttatctaacacttcacattagtattttaagacttcttggataaatacatgtttattcaacctataaactacaactcaattcaggcacctgctatttgccaatactatgcatatcattgtgagattagaaagatgagtaaaacagttattattcaggagagtaaagtacagtggtattcagatattcaaatatataatgacaaattattttatgaacctcaatcatatcactttagtcttaagggatctctatttaagattcctaaattttagtgaattcctctatgccatatggcagagtttcctcttcctttgttctctgtcccagcttttttctaagtctgttctggtttcatctctccaacactgccaaaatgcacatagcattccaggtaaagttggcaggatcatgtttccactttgttacatataccctttgtgagtgttttgctgctggaaccgagtacatacaaagggccaaatatttagaagataagcacaatgactctcagaaccatttgttcatttaaaaaaagattctatttcttgcactaaggacaatatgctcacagttcaaaagtagaaaagtatagaaaagaataaacaaacacaaaatcgtttattgtctcaccaccagaaagagcatggctaccattagtattatttatttatttattttttattacactttaagttctgggatacatgtgcagaatgtgcaggtttgttacataggtatacacgtgccattgtggtttgctgcacccattaacccatcatctacattaggtatttctcctaatgctatccctcccctagtcccccacccgccgacaggccctggtgtgtgatgttccctccctgtgtcccggtgttctcattgttcaattcccacttatgagtgagacatacagtgtttggtactctgttcttgtgttagtttgccaagaatgatggttaccagcttcatcccctgtccctgcaaagaacatgaactcgtccttttttatggctgcatagtattccatggtgtctatgtgtcacattttctttgtccagtctatcactgatgggcatttgggttggttccaagtctttgctattgtgaatagtgccgcaataaacatgatgatttatttttctgccctcccctgccacctagcagatttgggactaaactgttgttctttctctgcctttcaaacttaatattaaaatatgagcattttttttccataccatcaagtattcttaaataatgtatctgatggatttaattatcatttatttaatcattctcttagtataaggagaggccatagcatgcaggtaagacattgacctgatttcccctcagtacctttctaagacattactctttactttaagtcacacaatacttccttttcttacctccttttccaatcaaactttcttcttaaacatttcagtgttatggaaaatgtgcaagatttagagtcagttgttctaaaactagcttgcgtggtatttggcaagttactttatctgacttaccttcagctctctcatctgtgtgattgggtaacattccctgcctttgttacaacatggttgctgtgcggatgaaatcatatggtgaatatgaaattgttttacatattataaagtgagagatggttctttccctgtgctgtacttttctaacccaaaggcaacattcattatttttcttcgtttgtaagcagaaaaaaaagggctgcataaatgtgctggaaaagacatcattcaattgcctgacctcccaaaggatttgttaatgtttaaccccaactcaccctttcccctcagtgacctgatttatctgatgatttaaaacaaaggttatttggatggtgaaattacaattctaaaattttcattgcaagtaaaaaatctattggtgaaagaaaaccttagttatttttttcaagtacctttttcatatttatcatagaatataaccttatagtagtaacaatatcaacataataattacaatgtattaactattcataaagtggcagctaggtgctacatatatcagtttaaagcttctcaacaccctacagattatttgttggggtgaaaagtttatcaataggccagagtcatttagagaagagatccagaatagatctttaaaaaaaaatcagtctgaattagaaagaaactaggcttaagagggaccaaaacctaaatgcaaaaaaaaagcattagcaaaccctactggctaagtggtaccaaaagaaggaaaaggaaaaacaaagaaaggacttcaatatggaagccctagtgggaggcagagaacaggagactttcctcctcctcctcctcttcctcctctttcttctcctcctcctcctcttcctcctccatgttgctgtgttagcccttcttccactgcactgtggctattagcgaagttaatgtcctttattccaaactgaagtacattaggacagggccaatgccaatgctttgatcaccatttttacttgattttttatagctctattgaggtttaattgacagattacaacaaactgtgcacaattaaaatgtacaatttgacaaattttgacatgaaactattaccatgataaaattaatgaatataacaattgcatccccagagtttcattgtacgtgtttgaactctttctctctttgcctcctctccatccttaggcaatcactacttgttttccatcataattgattagtttgtctcttctaggcttacttcactccatgtaattatttgagattttaaagcatgttatatataataatagttcacctcttgttattgcttagttgtattccattgtatggatataccatagtctgtttatccatttatctgttcatggatgtgtacattatccattattgcataaaagattatcccaaaactcagtggcttaaaataactattcattatctcacagtttctgtgggccagacatttgggagcggcttagctgggtggctctggttcagggtctctcatgagattgctgttaagcaggtgaccacttctgcatgtgcagttacctgaaagtttgactgggctggaggagtcacttccaaagatgcatttttatctactgtctcaattattgtacctagtacacagtagtattcaacaaatatgtgttgctagagtaggttaagctttgattatggaggttcttaaattttaggctaagcatttgaacatttgccctcatcccccctaagcaatggagaatcattgcaggggtttgaatggggaatgctatgataacctatgttttggaagtctggtttcattgacaggaggtggcccatttttgagtaggacgacatgaactatccaattgtgcagtgctacttagagattcagaggtttattttcttgatttgatctttaagcaaaagtttatatggtaaagggtcagaagcatagcccctcctgcagagcagacatagtggattttcatgaagctccaactacactttttaaaaattcttgcatcttaaagacatgctaagaattgaggcttcattatatagcaggctttacagatctgctaataattgctgtatggtacagataggacatttttctcctctgaggctttgtttctccatatccaaaataaacaatattgactagctaacttctgcactccttttaagttttaggatatgtactatgagaagtagattattaattgcagaaaagtcagtaaaatacaagagtcctgtatgtgatcccttcccaaagcagcatctagctttatagctcaacgataatgtttaatctggacaggaaagacactatacttcactcccatgatcctctgttagggaatggctgggcagaggcccttgcttcaagggcaccttagggtaaaagaggctgggaaaggagaaaactgggttaaacctattattgaacttttgttcctaacttaaatgaagactaaatgacacttgctgaacatgtaagaggaagggcatggataagatggcaattaaatgttgctgacacaccagcagtgttgacattttaaaactcagaccgcttttgaaatgtcttcttgctctgtttgtttcttatacccaaatttggttgggttttattttttctaataagtatcgtaaaataggtattatgttagtcaggggtctctggagaattggaaccaataggagatttttatttatttatttatttattataagaaattggctcatgtgattattgaggctggtccactgtctgcagagccagtgtcccagtttaagtccgaaggctagtaggctgctgtagaaccaggaagagttgatgctccagttcaaaggccttcagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttgaaaaaaataaaaaagaaacttcaacactatgggacactggctcttttagcatgaaatgacttgagcttttgtagtgatgatacacatacacactcatcagtaaaacgatggtttcataaataacacaattgatgcaaatcataaaaatcaattacaattatgatttcatgacaaaatatatttaattaagtttgttatgaaaaaaatagagatatgaatcactaacaaaattcctccattttcagtggctattcatcatttatcatctagactcacatttgtctccttcctgatagcagttaagaaaaaattctaaccacacaatttgtatattgtttttctccgtattatgttaagcaaatgttcactgcagtaaaatgttttggaaattagctttgtcttatttccagtttagttcagagaattaattggaaacctgatttcttttacacataaacctgacaaaaaatgtagcttagagcaaagggtgaatgtttgcttaactcctgcttacttctcaagtacatgaaaactttaatagaatatgccagtattcactgagtttttaaaaatattaccatgtgtaaacatataatatccaacttcatccaaaaatatggttgagtttaagtactttgtttttcaggcttatttcaagtataataattctttgattttcattgttctgatttctgggtcttcaattcattcgtcacttttcctttttaagtaaaataagcttttttttttttttttttttttttttggagttgcattgggatttttcccaggaaaaaatatggcttttagtaatgctttgcaattggctacgcagatataaattaagatatgtttattctgagttcttattggaataagtttcaaaatcaacgagcttaagaatgaaaacaaaacttttgagagtctcacaaaatagctttctggtcaatacaccttacttgatttttaagctcgcagaataaagtatagaaacaaatggagctgaagttccatttgctaattcagagacttttgtgcttccgcaaattggagggcagcaagccatcctattctcatagtaatcgttttggctttgaaatttacatacaatttaatagcacatttttagccattatggattggcgcaataaagagatatcaatgtaatgcaatgtgatgctttatgggcctcattctaattcagaaagcttgtttaaaagaactaagactcttctgtttaataaaatagcaacaatctaatatctagattggtagtcctgcggtgccactagtgggagatgagagtattaagacaagagtaaggacaaggaaagacttaaaggttgcatattgaaaagtttggaattcctaatttgggagcactgatttcttggtgaagaagtaagtatgactacgttgccagtaattttttaaaaacatagacccagaaatagcaaatcgatttcaccctcataccttagtctacaaggccttgctcttgagaaggttttccatgatattgcttaatttcatctgcacaagatgagacacaaacataaaaattccctgctcattttaataccataaaaggctgaggttatttctctgtcataaaattgtaaatagcattttttaagtcaaaattacatttaaaacagtggattgttctacaaatatatatgtgtatatatacatatgcttctgaaataaggatatattatatgagtttttatttgatttgtggtctttagtcataggtaatcaaaaataaagagatttgaatgcaaaactttatacattaatgtacatttctaatgatggtacaaattgccactttataataaaaaagaaacaggtgggaataataatcaaagcacgtgttccttcagtactttggtgatttttaatcccccttgtgatgcacaggaaattattttttagttacaaaaagttatcttagaaatctatacttcccaatacagatttcatgttaagtcatatcaaattgagaatttgtggtgaaagaataggaaaaggatgctagatgctgatctttctttttcaggatttttcctggagcccaagttaaaaattcaatacttaaatctaagttaagtgaaaattaataatgttcagaatgatgtattgagctttagtaacagacggaagcaaaaaaaaataagaatatttaacattatgataatagccttaaaataatgtaataaaaattgcatcattaaatgttctattagttggaaagaatgagctgatgtttctttgtctttgctccaagtacaatttaaagacagtgacattcattttacttaaaattgttcaaaaagtccaaaacatactcccatggctagaattggtattagctccaatacaaggttaaatgttacaatcttaagaaattattgacactgaaatgtttagtaaacatgttgtatgagaaactaaacaaattaatgtttcatttttccattaaagcacagattattcaaatcattgttttctgagctcagatttgtaaaacgtttatacatcattaccctcctggaattaaaaacaattaaaatcctgagatgctcatgcacgtagacgaaatactggcacttttttttaaacattaaacttctttgagaagtctacctttttttttttagtgtgtttatcctatattgctgaaaaagcgctgtgtctttttaagaaaaagatcaaaaattgatttacagatgggaaagatgtctaattttgtagaagagttgaaagaaaagtaaatgtttctttgtaattacgtagctacttgtctcaacctgacatcttgctttcaaggattaagaactaaagtacgttcatttattcttttattcataacataccaactagaggctcagttgagtttaggcatcatacactgaattgcaatctcaaaacaacaacaacaaaggcagacacataaataaataatgcaatacctaaaagtatgtgctatgataaatgcaaaaaagattttatataccactgaggaggcaacaaaggcatcatcagggattagaggcaagacagcgattgaaaaagaacagatatttgctgagtgataaagggggacgacaaaggcctctcaagtagaggaaatcatttgaatgaaagatggatacttggaaaacagggcttggttgggaagaatgttcagaaaaggaggtggaagaaaaactgagttgagatcaataaaaacgaaaagttactcaaaggttttcaatacagcctttgtatttgtttgaacatctgtatctgctaggatgcttctggttgctcagacagaatccccaaaccaaactggcgcttcatctcgaatatctaggtacacagcatcaccatcgaggcttactttgtagttctctcagctctgtccacctccatgtataacttctcccttagaggcagaatttcctttagtagtttcagaacctgcatgcttatatcatctattctctattagaatcccccagacgacatcttacatttcgttggcctgatttagatcatctgtccacacttcagtgactgaccatggccagagacttgagatatgttgactagtgtaagtcaaccaagacctggaggttggattgtcccccaagatacaagtctgcatggttgaggagtaaatatttgaatgcaattcagatcccttttatcaagaggaaatgtaaatgaagagcaaaaagtagcaaatctccattactaatgaatagatgtattttctatcacaagtcattggctattctaaaaatccgcagagaaatgcaaatattgattaattaaagctactgccataaaccataagaacaaacaaaaacattgacaattcaattccctaagcattattaagtgactgctatgaagaaggcactgtgcaggtcactgatgaagagataaacagctgcaattttaaagaaaagtggtacatttgacaataactcgatatatctgatatgttcaatgcttttagatgactctcatggagggggttagaaaatgcagcttgcttattctagatcagaggttcatatcatacctacttttattcatacccatgcaagcactgctaggattaggccattagaaaatgctgcacttcaaaatcacctgcaacaaccgtgcatgtct

SEQ ID NO: 2361 - DNA, 8109 bp, Homo sapiens
taactgctgattctttcaattcttatcatggttattagtctgttcttttctctgagggttctaatcctccttttaaaaagtcttattcagatttatctattttctctatttcgtggatatggattatcctgtttgttggatctggttgctttatgtcccattgctgagctttttcatgtgctttaggattcttatttgaggtgtcattttctttggagattgctctctagtagtgcagggagttctgcagtttttaaattctgggacctacacgatgcacagctccaaaccaggtctcatgatagcatctcaggatgagttctgccgtttctgggtagtcaaatttcaggtcctgcatctgtgtaccacgcagaccctgtgtaccagcagaaaaccagcagaagccgaatttctgcttctgccctcagagtggcacatttctggccacagacctaggagagtgggaagaactcttctctttgaaggtaggcagtgcaatctcagcttctgcatttatttggagagcctatctcagactctcctactaggcaggagtcatatttgtcccccattgaatattcccattaagaatcctgacccaatgtttatattccttcccagttccccgtagaatagtagttttgtctccgcttatagctgtgggttgccgctctggttccacgatgaagaaattttttcattcttagagtatgcagttttcaattttatataacttattttgttgcatcttttagttacttattctaccgttttttttttcggagttcagagtggaagatggaatttttggtatgtgcttaatctgccatttctacccatttatccattttagtaaagtactaacatttattaaaccaattctccattcttggacatttaaggtgtttttagtttctggttattacaaacatcacaacgatgaacatctttatagctaaccatttgcatgtatacattattatatccctagattacattttcagaagtaaaactaatgataatttttaccttttcattatgtgtgtctgataacatttttcttccagcttaaaacccctccttggcttttcatttccttcaggataaagcactaacaacataacatgatgttcaaaatgtgtcaatatctcactctttctgacctctcgcctcctgttatacccgtcttctctaccacacttgccattctgccattctgcagatactctatgctgtttcactcctctgtgtctttcactgtgcctgcccctctatcagggatacttcccctcactccgtctctttgcatagtaatctcctacttttttttttttttttttttttttttacggagtctcgctctgtcgcccaggctggagtgcagtggcagcgatctcggctcagtgcaacctccgcctcctgggttctagtgatgctcctgccgcagccttccgggtagctgagactacaggtacacgccaccaagcctggctaagttttttttttgtatttttggtagagacagggtttcaccatattgaccagcctggtctccaattcctgacttcaagtgatccacccgctttggcctcccaaactgctgggattacaggtgtgagcaaccacacccagcctctactcatcctttaaaactctgctcatgtgggttttttcctgtgaagccctctgtgacctttccagaagcttttctcccttctatgctattatatagatcctctattaaagcattcactacagttgttttacaagattatctccaccactaggttgggaaattctcaaaaaattgttatctgaatcccagcacttagcagagtgcattatacacagtaggtactcactcaatgcctaatcaatgaatgaatgatattatatgactttgtgaattgtatcatgttgaatcatgatttttttccttttgcttccacataataaacttgttttgggtgaagattatattatgatgttctttatgtctatctatctatctatctatctatctatctatctatctatcatctatctatccaactatccatccatctaaactattgtattctttaatctctaatgtagtgtcaatcatattgttggcacactaaacatttactctttgattgactattaagcaaaattacagtattggtgagattgaagtgagcttattatgaagttctgctgcaggtcattacactgtaggctgtcaggacatttgcattgaatatgcactttggatgagcctctttccctttcttagtttcctcagacataaacaaaggctttggacttgaagacctccatggtaatttccagttctaatagttgatcttcttactcataattacagtcctatgtccaacagccagactatggtccctgttctataaaaaataggtgagccctgtgtttcatagtggcacttgtttatagtatatttgtattttgtggagtgctaaaatagaagtcacagcacttgtatttatgttttaacttacatctggaaaaatgattgtataaagtcctgggaagaaagcttgtaaatccttctggaaatgttttgactacaaatgagcatccatccatatttctagtgaatttgaaagtgatagcaaaaaatgataaactgtttgctgctttgtagagaaagttcatagactgaaaataaattcttaaattaagcaaagctatataaaactgagttgaaaacagatatgaaactcaagaaagcatccttaattgattatgaaaaagaaaggtatttaaaattaaatgactttttaatgtttattttattgttatcaaattgagagctattgttatcaaattgagagctattgttttggggtatgttcatttccaaaaatctttctctcttctacttcataggtaagttatattggttttgttttaactgcataagtactaaggattatttcttagtggtattaaaatttgatgtatgtactcagtcataacaaacaaacaaaactactagaaactttgagaatcaattcaatttcaccattactgattgtgtcttcttcatgaaaggtcttcttccataactaattgaattgaatatcctgaattcggttttgagtgctggtcccacatgtgagaccttagataaggcatattctttttttaaaaattttactttaagttctgggatacatgtgcagaacatgcaggtttgttatatgtgccatgtggtttgtatacatgtgccatggttgtttgctgtacctatcaacccatcatctaggttttaagccctgcatgcattaggtatttgtcctaatgctctccctccccttgccccccacccccaaaaggcccccgtgtgtgacgttcccctccctgtgtccctgtgttctcattgtttaactcctacttatgagaacatgcggtatttggttttctgtccttgtgttagcttgctgagaatgaaggttttcaacttcatccatgtccctgcaaaggatatgaactcattcttttttatggctgcatagtattccatggggtatatgaaggcacatcctttattgatttcaggtttatcacttatggtaatggcatagcaatctgttctctcgcttcgacttatctgtagttcaatcttcatttccttaccttttcctataattgttccatgaaccatgatgaagttgatttttttcatatttaggtaaaagtctataaagagcaactgtgtctaatttatttttttattctctacccactctcctgccccatcctattactaatgtgtaacatgcatttaagaaatattttgtaactacctgtatttcaataaaaagctcaatctctctaatacagaaatcttatttctcattacccttagataaaccatggtcctgattttgctggattttcaggattaatgcactaaaaatcttactgaacgccagatgaggtttctggataatttgtttttcttctttgcgcttttctgtgttttctagttcttctctactggattcatttggttgacacaaaatgaaatattaaggtatattacaacgaggaccacattgcttaacttcataattccaaccacttcctcttccacgtatcttgagaaaggtaggagcatttttactcttcacatccatacactcacaatcagctttatcacttactagtggtaggattggagaagcttatgtgtactatgtccttcaggggcttcttatctaacatggggatactattacctgcctgtctgtctaatgggattatataatgcatgtgaaaatgctagactaattgcaaacacagaacaaacggatgttgtcaccattattgtcagatctctatgtatgtgcaaaagtgaaatccttggagacaagctgggagattttttttttttctttagcatctcttctgccaaaaatatatattgattgcagctggaaggaaaccgttctgagagagaaaataatgttgaatagaaatcagagcctgtttgatatttgacagcttggacatgtttcttcatgtttaatgataataataatttgacttttaagtgacttctctgacatgagagccccctaaatcaggaaagctataaactgatgcaaagctacccccagagagatgacatggaagggtaaatgggattgaccagtgtgtttggctgagggtactcatctgcctaagattttatgggcttcacaggaggcctgttctgtggcatgtgaatgacctgagaacaagtcacccaccagccttggaccccatttattgagattctactatgtgctaccctctggagtaggtgctttgacaaagttattacatttgaccttcagaacaattctgcgaagagagtactattgtaccattaatgtctgtaggaaaattgatactcaaatattccctagactacaattatcatcagatcttctaattctaaatctggtactcttttcattttatagacaactgcctgacaaccacataaaactgtattagtaactacgcatttacaaagcacttctacacaaattaccttacttgattgttactttttctgtctgcaagttttccaagtcatgctagtgtgttatttctgtctcagttctggtggcctacctaaaaagaacattgcatgatcatgaaccagaattctggtattgtctccttcaccagttagctttgttacttaaagccctaaaagagaagggaattgcctctactgtagctatttggtagaagaatccagaggagaacccaggcttcttgagaaccaggtctcccaacgatctttggagataaacagtactaaacatacaagtatttgtgcatttgttgcgatcattatttaattatttaaaaagtataattatgatctattccttctggtaatcaataagactctgactcaaaatgaaataagggaaaatgttggtagaaaaagacttagcataaaggctgggtccttattgatagtgaaaatgatacttagaggagaagaagctgtttaaagcttgcattagttgtagaaaccccagcttgaggcactgaatctgtaaaaactggagacagagtttgggctgtatttaaaagagtctatcaagggctcctctttgtagaggatccaagtcagacctcctagcctatggaaatcagcttgtcagagcaaatgaatgtattggagactgaccctgacctaggtagctttcaagtcatccctgagaaagagcattttagaggttgaattgatgagatggctaatatggttattgaagttattggaggctatttatttggattttgcaatgattcagatttatgaaaatgaatctgtaatgaaaatgaatggtggaaataagctaatacaggaagtgttcagctaccaaagcaaacctgccttttcaataagacaaggatattacctctggaggatgaataacatatcatttgagatattttattaaaagttaactgtgactctcttttgaaggcagtcgctattactccagggagaatgaccttgaggctacttccttctttctcttacctttccttttcttttctttcaccatttcttttggacatacgctggtgaatgaagactgtggaatatggagtgaggaataaggaagcccactcaggctgagtcagatgcagtaggagatcagtgaaagggatttttcattagggagtgggatgtgttgatgtgataaagcttcttgaagtagaattttatggcaagcgtgatattgtaacttgcccatatttatgcagcttttaagtagtaaagctacgatttgaactgggtctgtttgtcttgaatgcagaggccccagggaatttaccaggtctggctctcattggttttggatagcagaaggttgaaccttaacatgtcagtcattttatttgctagattgattacattttgtctggaacatggtaatctcagactctagtcagtcttcagcttaggaaatattttcttgattattatttctattccactacttaagatttgttcttaaggataaaaattacttgtaaagataaatctccagtatttactatttttattatcttccctttcatatctttcaccttttctgattcttgggagaatttcctctttacatcaatgatttaatttttactgagaccgagtctcactctgtcacccaggctggagtgcagtggtgagatctcagctcactgcaacctctgccacccagttcaagcaattctcctgcctcagtctcccaagtagctgggattatttttaatcccatgccaccatgcccagctaagttttgtatttttagtagagatggggtttcaccctgttggtcaggctggtctcaaactcctgacctcaagtgatccgcccgccttggcctcccaaagtgctggaattgcaggcgtgagccacagcgcccagcctatttaatttttttatagtgccagttttgttcttttccaattccagggtaggattaatttggctattttgttaccttgcttttctcagccaggtcccttaataattttagactatattgccataaattgtctttttatctcatcacttatcatcatccctaaccttaacaagcgtaccatttcatgtatttacttgagaacccagaacagacgttcccagtttttttcttaatattaaattattattttttttttaaagaactagggttttcttctgcactttcagaacaacttttccttatttcaattttatagcatgtgtccagcctgtgctttttttttgccccacccccacccccaaatgtttacttttccttgagcatgaatccaaccctggaatttccaaaagtgaggcttctctgttttcccttattccccaataatttccatgagagtgtaatagatttgtacaaagctcttcactaatttttaggaggtctattagtatggttctgcctaaataaggaagtatctcctgcttccaatgtagaagatacttctttggctctgaagaagataatttttcatcccttgtaagttgaaaattttctagttcttacttttccaaaaacagagtatacaatggtcagagctcttcctatcttcactagtgcccactcaacaactttacattacgtcctacttggaatttctttctttttttttttttttatactttaagttctagggtacatgtgcacaacgtgcaggtttgttacatatgtatacatgtgccgtgttggtgtgctgcacccattaactcatcatttaacatgaggtatatctcctaatgctatccctcccccctccccccaccccacaacaggccctggtgtgtgatgttccccttcttgtgtccgtgtgttctcattgttcaattcccacctatgagtgagaacatgaggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaag

SEQ ID NO: 2362 - DNA, 10105 bp, Homo sapiens
aggagacatacaatcaacactccactcagacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaaggtattgtaaataaagagaaagatcagaggcttattttaaacactaaatatgagctaggagctgtcctagacactatgtaaaagttttatttagttctcactgtaatgttggccttatgttagcatcccatttttcagactgaggaaattatggctcagagaggttaagagacttattgaaggtcacacagctccacaaactttggtgtagattgaacgtgtacatgggtctatgtgactttgaatcttgcattctttacattattggaatatttcacagaaggaaaatgacatattaacatggcaataagatttctggttccagtctggttactggtcttccaagagtgttataggatgtatagcctgagctctgaagctttgttctgaagcatgctatcaatatgaacaaattggtatggaaggaagccacaaattatatactaaaatctagttcatcagaggaaaatatagttaaatacatttacattcccagaactgttaatattgaagaataaaacacacagtgggaaagagacgaagagaaaatacgcctgtttttatgacttgttgatatctacagggtttttccttaagcctcacaacaatttacagcattgccagcagcattcagtacattcagaacaggataatttcacccgcagctgaactagggccatgcctgggacagacagagaatggccttccagcagacatgccaagaagcaagccagggtcagtgagtgaagaggagggcaggcccatttgaagcaacacagtttatgtaagtgtgatctaactgctttcactggaaatgggtcagactccagttgagagaaccaggggcctgaatgaccccagcaaaatcactgtggcaattctttcaatcacctctgagaatatggccctgtgacgacataatgacgtttggattaattccagtcggctgtgttttcccctcctttcttgcctccccgtagttgatttgccaaattttttttgtttgcttaaatacgcggaactaaacaggatacattatatgacagtctgtgataaatttaccactgggaatagggaaaaagtatgggataaagaaataggtatttttcgcctctcacagctgtgattcagttctgactcaaaaggaagtgtgccacctactgaatcacagaaaccacttcctgtggctgtttggtttattctggaggagcatcaggccaagtgctgccctgccctgaccctgactggctcttcagagccaaggcattcacagcttgaggtggtttggcctcagactcttgagaacattgcatattaaattacaagtgtttcgtttcctagcaaggagtctttagcaacatgaaaacgaacgtgtgttatttgcaaaccaagtatatcattactgaacctgaatatccttactttttcataaggtacgtattccggatgaccactcttaagatctgaatgtacactggttctgtttttcctgaggggaacttgggcagtctgcagggtggcatttaccagctgagggacttcaagagcaccctttaatcagtgtggcagcactcaacttgtattcactcactcagagtatttttgagcatgtacttattgccatgtgctgtgctaggtaggggtagagggtacagtggtgaacaagaccccacagctcctgacctcatggctcatgtgttctacaccataagggaatcaagctgtgtctcccggggcaggggccttcctctgttcaccatgcagccccagcatctagcacctggcgttgcataaaggaggctctaaatcaagcttgtccaacccaaggcccacgggccacatgtggcccaggatggctttgaatgcagccaaacacaaatttgtaaactttcttaaaacattataagatttgtgtgtatgtgttttagtccatcagctattgttagtgttcatgtattttatgtgtggcccaagacaattcttctatgtggcccaaggaaaccaaagattgaacactcctgctctaaatacttgtttgttgaatagatacatgaaaagaaagaaggagagaaggaagaaaggagggcggaaggaaaggaagaagggagagaagaagagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcgtgcctgtaatcccagctacctgggaggctgaggtaggagaatcgctggaacccgagaggcggaggctgcagtgagttgagatcatgtcactgcactccaggctgggcaacagagtgagactctgtctcagaaaaaaaaaaaaagaaagaaagaaagaaagaaagttaccattagttttttgttgtatttgcaagcaaagacaaaagcaccaaggtacttgtttccttctgtaattagagtttcaaatagactaaaagtttctgctcttaggtgggtctagagactctccagtacctcaggacctcaggacacatggggtctcttggttgttttcttttcattgttgttgtttattttatttttgtttttattttttaactttaaaacaattttttgtagatgaatatgcttacatatgtttgggggtttttttgagacagggtcttgctctgttgcccaggctggagagcggtggtttaaccacagctcactgcagcctcgacctcccaaggtagggactgcaggtgtgtacactggggtgcaccaccacacccagctaatttttaaatttttttttgtagatattgtctcactctgttggccagactggtcttgaaatcctgggctcgagcaattctcctgcctcggcctcgtaacgcgttaggattacaagcgtgaacaccgcacctggccagcatgtggtctcttaaccagaggaggcctcttctgaactaggtagaggtcctgagaattgattctgagagtaaaaggctctttgttctcctcagagtagattagaatccctaatgatagagcatctattattcctctagtggtccatgcccaacagattcatccaagaatagatgaagatctttgtaatgttgtgcaagtaatctaatcaccccacagaagagctgtgacttaaattatcccagagtcggcccacctgttttcataaagatcaatgtaacttgtaaatttcttcagttctcctcacctatcatcatttgactaacaaaacccagaaaactaggctagttatggtggcctatgcatataatcccaactctttgagaggccagggtgggtggattgcttgagtccaggaattcgagaccagcctgggcaacaaagggagaccctgcctatatcccagctatgcaggaggcgaggccagaggattgcctgagcctcagaggttgaggctgtagtgagccatgattgccccactacactccagcctggatgacagagtgagaccctgccttaaaaataataataatagtaataatatttcataaagatacaggaaactagattataattgacattttcaaagtgaaatactgtctagaatggtgcttggccaacagtaagctttttgtaagtggaagtcattactactactatttctttcattattattaccattactacttttttttacaaaaaaaaaaccctggacaacacactgaaaccattactacttctactactataacttaggttgcacctgatagagccagcaatttttccaaggtatgacaatggccatatgtttaatgatataattctatggctcagtgtatctcagcctttttaaaccctgctcttcttttgacaattgtaaaaatcttaaactgacctccagttgaaatcctctgtcaagaagatattgtcggccaggggcggtggctcacacctgtaatcccagcacttttggaggccgaggtgggaggatcacttgaggttaggagttcaagaccagcctggccaacatagtgaaaccccatctctactaaaaatacaaaaattaggcaggcatggtggtgtgtgcctgtaatcccagctactcaggaggctgaggtaggagaattgcttgaacctggcagggcagaggttgcagcaagccgagatcacgccactgctctccagcctgggtgagactgtctcaaaaaaaaaaaaaaaaaagaaagaaagtaagaaaaagaagaaatcccaatctcttcttttatgtggattcttcctcacttgaataatacttttcttccccagtattctccatattatcccagagtcagcccctctgtttttgtaaagatctacgtaacctcctctaagtttcccagttctcctcacctatcatatcatttggctcaacaaagggcaggaagctagattctaattgatattttgaggccgggagcagtggctcatgcctgtaatcacagcactttgggaggctgaggcgggcagatcactggaggtcaggagttcgagaccagcctggccaatatggtgaaacctcgtctctactaaaaatacaaaaaattagccaggcttggtggcttgtacctgtaatcccagctactcaggaggctgaggcaggagaatagcttaaacctgggaggaagaggttgcagtgagccgagattgctcaattgcaccccagcctgggtgacagagcaaaactccatctcaaaaacaaacaaacgaacaaacctgatattttcaaaattgaggcaattataacagctatttagccaagcattatgatagcaataatagcaagaaaataaattagttaacaaatgagtctcagaagcccaatgatttttattttatttttattttttgaacttttattttagaatcaggggatacatgtgcaggtttgttacccgggtatattgcatgatgctgagttttggagtatgcatgaatccaacctgtcatccaggtagtgagtatagtacccaacagatagtttttttaacatttacttcactcccttccccaatcttgtattcccctgtgtctactgttcccatttttatgactgtgccaacaataattttttttcttttttctttaaatagagatgggggtctctatttaaagagcctcccaaagtgctaggattacaggtgtgatccattgcacctggcccatgccaacaatatttgaaacccttatctgcgtgtacaagtttgctactggttttgttttgctcattaatacatcccaagcatctatacctggcttgtagtaccagcatgtagtaggtgcttaataaatatttattgaataaataaattagtttgacattagtttaacatctcaagtaaaacaaaataccattcaattaattctcttcttctacttttttcttttaagagagacaaatagtcacacatacatcagcaggagaggatacaatttcctgtgtttaagtttttatgagttactttagttcaaatgtcacagaaaattatattgaactcttgaccaatctatctattttttccattggagtattgacccaaataagaaatagcataaaggaaaaattattttttggcagaaaaatattctctctaaattcttgtgtgttttgttttgattttttccttagtgactggaggccagtttcaatccactgaagcacagattccaaattttcaatctggttttcttgagtagtgactgagtgccaaaaatgaagcaatgacacaacatcaccatcaagacactccccagcacgcacacacatgccagagtccaacaccaagatactccccagcacgcacacacacgccagagtccaggccatattcgggtggcttgcaagcttcttccccccaagtatttactctcaaaataatggtttttgttttgttttggtttggtttggtttgtttttttccaaatacatttcttccctatatctttaaccaattctcataaaattttgtctaatacactggtcagtgtattccagaccctaaaagataacataatgaaactatctatgactaaaaggtaatcaggatcttctacttatccttttttcctccctcttaaactttaattttgatacatttgggagtgaaatgatgacaataaatgcaaagtaattattgaagaaacagtaattttgtattagcttactgaaaaaaaaaaaaaagataaccaaatatattttggcagccccaaacgagtcacatgtgaaatgcagtgggagagcagtgtcctgaaggaaaaggtggcctgctggacagccaagagaacaaacatccactgcaagtaatatgagctctaagtttggactaggcctatgtctgctctgagacttggggcaattcacttaatcagagccttaatcagctacggactagcaatatccatacccgctacttattttgtaaatctcctttctaaagttaactctatttattgttccataatcccataaattctagaatcttttcctgttatagccaagttgtctatcattgacagagatattcacctggttgttttggcttctctaatcctcctggtgagaacacctccaagggagctttcagtggcatttaaggtcacttgtgctcttggtcctagaaactgccttgatagtggttttagctcacatgaggtaagtctttattatatgcccaacctctttatgcattacttcatttaattgtatactaatcctttgtcataggttatcagagtgtttgattataagttacaggaagaaaaaaaaaaacaaactccaattgactaaaacaatggggcattttttgactcacataacagagagtctagagagaaggcaccttcaggtttggctgatgaatcctgtatctctgccttgtctccaggcccccaggttctgcctctgtcctgacatccagtgttggattcctcttcacatcaactcctctctgtaggttgggccatcagaccctacctccttatttatgttgagcaaaggagagagaatgcctctacaaacaatgaaaaaagtgaaaaaaaaaatctttctcctccttataactttagttagcttaactttagtcagttgcttagctactaaacagtagctattgggaggtgggaaggaatactattgtgtaatcaactaaggctcatacagaggattagggttatctgaattgatttgaattaattagaatttactctcagagctgtggcaattccttgaaccacactgattgctataaagtggaagaggaatagattgaattttggggagtcaactacaatgtgtactacaggaacaaaacccatcagaagatgtcagaagataaggatttttgtcctgatgctacacttaccagctgtccctcagtgttctacttcttaaaaaaagagagatggataaacagaggcaacccgaggataaaggccttgctcagtgtcacacatttcagtcactaaataagacacaatggatgccagtattctcatcccctcacaaataaagagccttcaagctcttgcagtcaacaagaacttttggaatgatttcactgcctgaaaaggcagatacataggtgacacccacaaataggaagaaaatcaacctgaacctgagtgtgtgggctcactgactctaagcagtagagacagaagaaaaagttttagcaaagaagggttctgaaagaaaataaatatagctcgttatcaagtgctgtttttacacagtaaaacatgggcaaaattactcttctttaagtagtaattcttatctcttgattaagtcacctactcattcatttaataaatacatactgattgttttctatgtgttgagcactcatctctgtattggaaatataataatgaccaaagttgacaatagtaataacaataatagctaatatagcaggcactaataattatttgttgagtaatatgtcaaaattcagtgtgaacagcattctatttggggctgcatccactgactataacacagctaatctatctgaaatgttccagctttgggcctctctaacagaagaagctgttgttgggcctgcctctagttggcgatgcatccaccaatgagaatgaatttatgatcgaccactcttcctgtaaaggccgctggaactgacagcattgtgattttcttttactgttagttttaaattactagaaccaactcaattactagaacgaactttacttctttgtttcctacttatcaaaacagtaaaaacaacaagtaaaagaaatgccatcttaatattgttttgatgacaaaacagtattccttttagttgtgcttcaaatggaataagatgcaaacaggcttggtatggtggctcacccctgtaatcccagccctttgggaggccaaggtggaaggattgcttgaggccatgagtttgagaccagcctgcgcaacatagcaagaccgtgtctctacaaaaaataaaaaattagctgagtgtagtggtgtgtgcttgtggtcccagctacttttgaggctgaggagggagaatctcttgagcccagaaggtcgaagttgcagtgagccgtgatcgtgccattgctctccagcttggacaacaaagcaagaccctatgtcaaaaaataaataaataaaagacataaacatatctgagattaactttcagtggtaaatttgttccatatatgatttttaaggttaaatgctttggaagctttaaaaaccatttcagcccttttaaatgccaacttacactgatgatgctctcagatgttaggaaatcttttgagcagaaaatggaagtgggggtgttgaggcagggaggagagtgatgcaatattccttagtgtcatcctgtgatttcacaatttgtttttcaatctgtttggactttcaaaagggaagactctcatatgtcaacaagcccatgaactgaagcttaaaacactggaaacaacaactgtagagtttcaagtatatgtacatttatgtattcatgttccttgatgggaatgctggctggtgtgaatgttcaatctcctgagaaatgtaaatttttctctgacagatttattagcttgctgtatctgagcacatgagcaaaaacaatgcctaataagaaaactttctctctccttcaaagtcaaacttgggagaaatgaagggaaatcgagttttctttgcttgacagtgttcaacattcttgtagtcagtgtgctcatgaagattgcaaacttttttttttttttagagcagctaggactacaggcgcgcaccaccacacccagctaatttgtgtatttttagtagagatggggttttaactatgttggccaagcttgtctcaaactcctgacctcaagtgatccattcgacagc

SEQ ID NO: 2363 - DNA, 9271 bp, Homo sapiens
tggacacttacgttgagcctatacattggctattatgaattttgctcaaataaacatgggattgcaggtgtcttttcaatacactgactactattcttttggatatatagccagcagtgggactgctggaacatatggtagatttatttttagttttttgaagaacctccttactgtgttcatagtggctatactaattttcattcccaccaaaagtgtatagcagttccccttactccatgtccacatgagcatgttattttttatctttttgataataactattttaactggggtgagatgatatctcactctagttttgttttgcatataccttatgattagtgatgttgagcattttttttaatatgcttgttggccattcgttttcttttgagaaatctctcttcagataatttgcccatttttaaataagattacctcaaaatatagttttaaagtattatcagtaaaaataggtgttttcctcaattgggatgcctactgtaagaaatctattagtgcattaaatgtgtcagaacagacaggagatagtctgtctgaattctagggggaaaaaagccaggaagttggtttcccagaactaagggaaaagggagataaagaagaaaggcaggtttgtccaagtgaaaggctcagccaagaacaggcactatttttaattcatggatttattatttgttcaatttatttattaatttaatgaatgattcagcaaatattgattgagtttttttttatatggaggtttctggagagctaggtatattaaaagacaggagagaataaacttcggcacatactgtaatggagggacaaatgctcaatgaatgttagctatttttactgctaatattattgccaagtgccatgaagatgccataaactgggatagcagagagctgctaaggaactcattgaaccacttttttactgaaaagtcaagttggtgctggttgagcaaatgttgtgttctggtccccaagtttgaaagaaattctaggaaaagagtagagttgagacagatagtaagtatatccagtggctggatgacagtctgcagagatgcaatgtcattgtcacatttccagtagcaacaaagcaagaacaggtaagaaagagtcagaattttaaagaagcaggaaaacatgacttgtgtaactgtagagaacctagccagatccaccagacaatatgagtgcataagactcagatgttagtttgtgttatgataacacatatcatagaacaggggaagatgtatgaagttagcatctctaggctttttcccaagtaaacaatatctttagaatcccatgtcccctggagacagaaattttcctaaacctcttaaatgaaagaggctgctttgtttagctaatataaatacttcatttcagtttaatttttaaaaaattactgagaatctaatgctgccagcattttactgggcactggtgatacagaaataaataagacaaagtctttgctctcaaggatctcgcagattaataggagaagaaatcgtataaataaataagtaaataaataaatacaatgatccaattcccttaggaaggacaatcctatcattataatgactttatcaagtgattaatttgatgttatcattgatttgtaatttaattaatttgttatttcggcaaacatttattcaatacctattatatccttgtaagatattaccaatgtcatactatttctgtaatctaaatctatactcatgtaacagccttttgaacttttagctcccctttgggaagagaacatgctaaccacttggtactgggatctactttgcaataatatattttctgagtaaataattgtgttgccatgtaggggttttttttcacaactctttcaatttgattaatgtgaactaatcatctttagcttgagtactctagaagataaaacaaaatcaggttcccaaatgcacaaaactgaaaactagctggtaaagaaagtgtccctacgtcagtgttgatgctgtgtgtatcttagcccacgtcaatccacctaagctcttccttccatatttcatatgcaaacacttttattgcagtactgggcactgcattcacttgcagtttgatttaatccattcagtaaaatgaatttcttgtgaaataaaatgtttatactatctgatctgatatatattgcctttttcatttggacaactaaaattgattaattacccacactgaaatttgttttaaccagttgattgtggaggattagatttaatgtcacagttatttgtcctaagataagatttaaagtatattatgaggcatgtaaaaggaggtttaatgtgtgttagaaacagaaaaaacatctgagaaaatttcgaatcacatattactttgccctattaaaaaaaaaagttagtgaaatagatttctctaggaaacaaagaaaaccatccatgttttattctgactcaggatagatgaacattaaagaaattttgaattactatattttgaattactaaaaaatattgaactcaactgatgagagagacgctagagctactgtcttttcaaagtgcacttcttgagatttcagagcaatctgagaaggtcagtgcctatcattctcattgactgcaaagtaatagaagactgcctctaattgtgagattaaatgaacatatggccagtaactttagaggaaaaatagataatttttttagacagataatttttctcaaagatggtaacagaacagagaacaaaattgagaattacttttgatttttattcaggcaaattggtatgtaaacataatacatattgttaagtaattataattaggttatgtattatacaatatattataaaaatgattgtgttattccagtctcacactggactaatataaggacactatctgagactgggtaatttataaagaaaataagtttgattgtctcatagttctgcctggctgggaggcctcaggaaagttacaattgtggcagaaggtgaaggggaagcaaggcatgtcttacctggcagcaggcaagagacatttatcaaacaaccagatctcatgagaactccctcactatcatgagaacagcaagtgggcaactgcctccatgattcaatcacctcccaccaggtccctcccatgacatgtggggattacaattccagatgaaatttgggtggggacacagagccaaaccttatcagtgatctcaattatttagattttacttggacattagatgtgtcttcaaaatggattggaagatttaaaaaatcacttaaggagcctaccttttgctgtcattaatgttgttgttaaaaggtaagcatcaagggcatttttatcattttaatattcctagctctattgaaacctgtgacttaggtgccagattcagccctgagcctgaatttaactgattttcaggttttcaaaagtgccacagctcaaaagataatttctatgagaatcacctttgtaattttctcaataagagtagaatctttctaaagattaataattaggcatatgaaacactgcaaagaatggtaaattagttacataaacatttaagtgtacagtagataacaatacttattttgtaggtccacaattaaagcaaagaaatacgtctaaactccaactgagaatccaaatacacagagctgatagttcaaagatgatcttagcaagggggtttttctttgacctttctattgaaatgacagagagttgttttataaagaaaaagaagatccataactgcattacaaataggatgtgatgctgtcagtacaattgaaactgaaattatgaatgatttctggagaacataattttattgacagataatcaagattagaagacacaactggaagtcctacatagtcaaaggagatgccttacatatgttaggaaagttttaggtttagttagcaggcctctgggaaaggggttgtgaaacagcagtcaggatagttatttaaaagtctgtctgcaggctaacaggaccaatgtgaccctctggaaactccgcacagagtaagtgacatcagtggcatttattccctagattaagccagataacttcttttgaaaggaactaagtagagtgtaggatggggtagcatgttcagtatgacatttgtcacctgagacagaagcagagctcacttctgaatgcatgaaagctctacaaccatacagaagaaatttaaaagaaaaccttttgatatggtttggctgtgtctccatccaaatctcatcttgaattgtagctcccataattcccacatgttgtgagagggacctggtgagagataattgaatcatgagggtggtttcccctatactgttctcgtggtagtgaataagtctcacaagatctgatggttttataagggaaaatccattttgcttggttctcgttcttctcttgtctgccaccatgaaaaacatgccgtttgccttcctccatgattctgaggccaccccagtcacatggcactgtgagtccattaaacctctttttctttataaattaccaagtctcaagtatgtttttatcagcagcatgagaatagactaatttagtaaattggtaccagtagaatggggtgccgctgtaaagattcccaaaaatgtggaagtgacttggaagtgggtaacaggaagaggttggaacagtttggagacaggaacagacgaagatggaacagatggaacagatgaagacaggaaaatgtaggaaagtttggaacttcctagagacttgttgaatggttttgaccaaaatgctgataatgatatggacaatgaaatccaggctgaggtagtctcagatggagatgaggaacttgttggaaagtggagtaaagatgatccttgctatgttttagaaaagagactggtggcattttgcccctgccctagagatatgtggaattttgaacttgagagagatgatttagggtatctttggaggaaatttctaaacagcaaagtattcgagaggtgacctgagaggtgctgttaaaagcattcagttttgaaagggaaacagagcataaaagtttggaaaatttgtagcctgataatgcaatagaaaacagaaacccattttcggaggagaaattcaagcaggtgcagaaatttgcataagtaacaagtcaaatattaatctctgaatcaatggagaaaatgtctccagggtgtgtcagagaccttggcagcagccactcttatcataggcccagaggcataggaaggaaaaatggtttcttgggccaggtccagggtccccctgctcagtgcagcctagggacttggtgccctgtgtcccagccactctagccatgactaaaaggggccaaggtacagctcgggctgttgcaccagagggttcaagccccaagctttggaagcttacacatggttttgagtctgtgggtacacagaagtcaagaattgaggtttgggaaccactgcctggattccaaaagatgtatgtaaattcatgggtgttgaggcagaagtttgctctagggttggggccctcatggagaacctctgctagggcagtgaggaagggaaatgtgtggttggagccccacacagagtccccactggagcattgcctagtggagctgtgagaatagggccactgtcctccagactccagagctgtagatccactgacagcttgcactttgtgcctagaaagctgcagacactcaatgccagcccattaaagcagcttggagggagactgtaccctgcaaagccacaggggcagagctgcccaagaccatgggaactcacctcttgcattagcatgtcctggatgtgagacatgaagtcaaaggagatcattttggagctttaagatttggctgctccactcaatttcagacttgcacggggcctgtagcccctttgttttggccaatttctcctatttggactgggtgtatttacccaatgcctgtacccccattgtatccagcaagtaactaacttgcttttgattttacaggcttataggtggaagaaacttgccttgtctcagatgagactttggactgtggacttttgagttaatgctgaaatgagttaagactttgggggactcttggaaaggcatgattgattttgaaatgtgaggacatgagatttgggaggggccaggggtagaatgatatggtttggctgtgtctccatcaaaatctcatcttgtattgtagctcccataattcccatgtgttgtgggaggaacccagtgggagataatttaatcattggggcagtttttcccatactgtttttatggtagtgactaagtctcatgagagctgatggttttataagggaaaccccttttcacttggctctcattattttcttgtctgaggcctccccagccacatggaactgtgagtccattaaacctgattttcttcataaattcccatcttggatatgtctttatcagcaacatgagaacagatgaataaaaattctcagactgggagaaaaatatgctaaagtgcttcattcccagaataatattcttgttattttgtcatatgggcagcctacctgcttacctcctgtccacacatcctaatatgatgccaaccagttagtatgtcctcacttacttgctgacatggattctttgcttggccaaattttagtcacgtcttctgaacattcttctaggcccatctgtgcacttccttgtaaaatactgttttaactaagtcagtttagcaacaatccccaatctcagtgtctgatcacccttggtagctgatcatattacttatcctcccttatcccccaggtgatttctgatctttctggtctgtttttagcaagatcctgttaggttggtttagccagaattccccttacccctgatgtttctgcttagtaattttccatcctctgactacctcatctgcttcttggctacagattctcacttgcccctgctgtattcggagttgagttcaatctccctagcctattgttaagacttagttgtagtcattcctgtagctactgcaatgatcctaaatgaagtcttttttactgtgctttaacaagtatcattgaatattttttttctttaacattacacaaaaaggaaaacagcctgttcatttcatggaaggacgttttggaaaaatagatccagacctacatagaaaggtttcccacttcatgctaaaaagtggtaacattgcatgtcagactgaagaaagacacctgagtctatgttgagttgtgtttggccccttgcaaggttgtcataaatgattcattgttttggcttaaggggctttcagctggatgacaaagcataaggacaaaaaatatgaaatttgtcattaaatgtcttcatcatttagcctgtttaattgtgctaagatcttttaagaaacaatgaatacagagatttccagattatacttccatgaaagcctaaatcttctcaggtattcacagtttaaaaaaattgaagtataccaaatgatatccaagtttactgtgaaagcaaatggcccataaaattttgcatttacatttgaattttaatctagagagaaggagaccacataagtaaaacacaatctatctcataggctgaagcgtcaggtattacaaatgtatgtggttagcttctctttatttagttctcattgatttaggtactaattctacccattctttgctttaatcatttagtattaagaaatattgactttcatcagagcttaatatacaactggctccaaatctagaaaatcaatttaaattctttatagtagtatgtaattggttaattcagtcatttttaaaacaatatatttgtttaaaaatatttattttgctaaccagctaccagacattgttctaggtaattcttacagaagtgcgtaagacagatagtgtggcttcccacatagggcatatagattacaaagagaagacatagctaaagaattaaaccaataataaaaacatcaaattctctgaaaaaaagagctgctgccagtatcagtgaatacttctttcatgtaacacaaactgacacttaaagaaaaaaaaaaaaacactcagccatgcaaagatgtaagtaaagagaattctgggtggaaagaataggataagtgaaatatttcaagcatggaagatctaggaatctttcaggaactgaaaggaggccagtatgattggaatagagaaaataggtaggccaggaggtcagatgatgtaggcattgaaggacaagataggagtttgcatgctggtcaacaattttaaatcagagggagggagagggagaggaaaagggagagaggcagagagtgagagagaggtagagagaaagagagagagggagtgagaaagagagatcaaatttacttattttgccaatagaactgttgtgtgaaaaatgaactgaaaggaagtaaggggagaaaaacagcaaagagcacatttaggaagtgaagataatgagagtccactcaatgataaaggtttggacttggacagtttagtagagaagtacacaagaacggttgtgaaatatatcttagaagtataatttgtggagttttgctgattgattaaatatgaggcatgagaagaaggagagaaaggaatgaaatatgtctaccaggaatatgggttgaaccattgagtagatggtggtgcaggtgcaatttactgaagatctgggatgaacaggttttggagtgaagatccaagtccacttttttatgtattaaatttaagatacattttagacattaggagacatttgtggccactatgacatataaggctttagcttatttgagaggttcagactggaaatatctatttgagtagttagtattttatgtgcaagccatataattgaatgatattacatagagaaaaagtgtagagtgagaaaaggagaggatcaaagactaagcactatagaatgcctacatttttattgtaattattattattattattcttattctgagacagagtttcactcctgtcgcccaggctggagtgcaatggcacgatctctgctcactgcaacctttgcctcccgggttcaagcgattctctgcctcagcctcccaagtagcttggattacaggcacgtgacaccacgcctggctaatttttttgtatttttagtagaaacggg

SEQ ID NO: 2364 - DNA, 2637 bp, Homo sapiens
gtaacatgacataaagaaccttttattaacacaacaatgatattttaaaaaggaagaataataatttccaagaaaaagtacaggaatttattttatgtctttttgaatttagacagagaattatttcatagacatcatttagacaaagttagactggcctgaatttaactgcaggtcctgagacttattattaaggtcatatttgccaatgtctggtgagaaatagactgggaagatgaaaagcatcaaaagatttctaagggctaccaagattattgaggggatactgaagaacatgttttttatttaaatatttcctaggactgaccttcactcttttttcagtgaatctaccattaaaaaggaagaatctgtggccatcctggaaataaacagagtgacatggtgacaattgtggatcctctcctttgggataatgcactgtgtatcccattgcaagtgcttctcagacatcagtgcaacgacctcttcagtaatctgacctaaaatgtaagagacttgagagcaaagatcatgttttgttcattattttactcctagtacctaggacagtccccaccagcaaatgcctgttcagtgatggatatgctaaaatctcctttattatagatgcatttatttcatggaaaaatagaaaggttacgctactgagggctcaacagctttatgaattaatatagggcttctcagaaacagtaaatatttctagcactaatctcctaagaataaaaggagtgggttgtcccaaatagtgcataggtgatgaatctggatggctttagataagagcagaggaaattgtctatttatcactgaccctaaaatgaaattcaaattgaatttatgtctactttatagatggtgactaggaacaagaaaattgagacaattgaaaccactagaatagattattacctggagatataattaatagtccaaattacatgatgtcatgttactctttgtgcaaacttctgtagatgttgatatatgtatgtggcttttaggtatgagttttactgtaccataaaataatacaacatatttttccccatttaataattgattcattatttaccctacaaacaatcatgcataaacacacttgaccctccaccacacacatacaaacctttcttattattgtcactaggtcctttatatattggggtcttgacatctttcttttattattaatacaattttagcattattagagttgcattaagatagcattaaaatctgattaactgtgtgagttcaatttttttaaaagcagtttttttttttaaatttgataaggagttttgctattttgctgactggtctcaaatttctgggctgaaacgatcctccagcctcagcctctggagtggctgagactacaggtgcaagccccatgctaaaaacagcaatttttggaggggaaaacacctcaaatacattactttccaaaagtctttgatcattaacttttataaaaatgagaacaccttaatctaaaatacaagttgaagaagttattaaaaaaataaatttaaaaagagaagaaccatgtcaaatatagaaaaactaatgcaagcaagagtggggaagggcagttagagactgctagggaatctaatataatacacacacaaaatcactcttatagtttaagactctaagtatgttgaattatgttgataaagttgaaagaaacaatagagtctgaagccagaaatatattactaagaatattaaaacatagaggcatgtctggcaaaccaatggtaattcctgtgccactattttaaaattattttactggacatgaatggaatatatgccatattatcatgaggttgttccctagtatcaattaggtaaagtaaaaaaagtgttgaaagaatacaaagttctctttgatttgactctgaccaaccaacattctcagactcaacacctaagcagatcaaactgtacactttttcttattctctctatagcaaactatcacctaatccaaaaccatccggctcattcctcatccacatgctccaccttcagtgtcaaaatctctggggaatcctcttatgaccccctcagttagctgaatacctctcagttttctcttctggactgtaagtcatatggcatcatgggttattttttcttctactcacttggcacaagatgaagagagaaaaatgtatccttccctgctaatttgtactttgtttcttccatgttcctgtattgggacccatctccttccaagatgaatattcatcctcatagacatacaataccgcttagtgttacttcgttggcatagcatagaatacacagaataaatgattatttgatatataaatgaattaaagcatttctatccttattttacttaaagaaaaattaagttatggaaaaaatgattagaattctgaagaacattttaaaatcgaggttatatgatttctaacctataatagggtagaaattaactgtgaattaagcaaataaattaatcaaataaaaattattggtgttttagaaatatgaagtgtagttgaatctatttgttgtcatttgcttctcattagctatttttaccaaattgtctaacaaatatgt

SEQ ID NO: 2365 - DNA, 233 bp, Homo sapiens
gttggttaactgaagtcagagaggctaggtgacttaaataaggccacacagcaaaatctgggttttaagcccagattttttgaccccaaggtcagtatgccttatgccttctattgtctttgctttactccccaagaaaggtgaccctgtgaacgtgttaggcttccaacacgtgttggctatgaatgcattaggctagaaacccacctctttcccctgcatcaggtcctgcc

SEQ ID NO: 2366 - DNA, 3164 bp, Homo sapiens
acaccggcttcagcgcccgagcgtgcgcgcgggtctccgctcgtcgcccggctcggcgtcgggagtgcactctgtgtggccgctgctgcagtgttgttgtggttgtgagaaggcggcggcggcggcggagtagcagccggaccagacgccctagtagctcagtcgctgccctgcgccgggcctggcagggagcctggtgagatggtggaggaggaggctgtgccgtggcgggccttgccatgtcctgctgcctgtcatcaagagttcatataactagacctgtcttggagcaatttttatcttttgcaaaataccttgatggtttatctcatggagtacctttgctgaagcagctttgtgatcatattttgtttattaacccagccatctggatacatacacctgcaaaggttcaactttccctatatacatatttgtctgctgaatttattggaactgctaccatctacaccaccatatgcagaataggaacagttattaaagataatgcacaccttaaaatattactactgggttattaatcctgctgacagtagtggcattacacctaaaggattaggaccttgacatttttgaagaatacagaccagttattttttcgaatacccttaaatttgaattttctatttgttcatgatgatgcaggtttttcatttttacaagaaataacacagaagtcatattgtctgtctccttgtattatgtcaaggagacacatgatgttgagttgtgcttttacaagtgatgtcaactttaaacatttgattaaggtattatcttccaggtttcttcattataaaaatcacttctttctctttggtagttaagaagtatttgatggagaaatacattgaaactatataaatatcctgttcctcaacaaagtttcacctgcctgttttagtgtgctgatgattcttactaaaaattatctttattatgatgactgacaaatgatgttttctaagacattgattaagttggcatatctactgtaaggaagaacttgttttactactccactctatctgtctatctatatctatctatcgatctgtctgtttattgatctatctgtctatcatcttttatatcagtatggactcatgtattcaatgtgttatatcaacagttggcatactttctttgcaaagggccaggtagtgttttaggcttacggagccataaggtctctgttgcacatagtcagctctgacattgtattgcagaaataaccacagactgtatgtaaatgaataggtgtggcttgttctagtgaaacgtacaaaaacaagtggcctgattggtttagtcctagggctgtggtttatctgtctcctgggttgtatcattattttgatgctcgagatttggccagtaggacccttcacatggattatgggacaaatgcccataagtttataatactttcttactttctgaaacaagatgtttttgacttttcttacactttccttatcccagccctgaaattagccatttttccaagaagccctggtttgcttggtggatatggtttttagaaaccaagatctggatgtgaggtgtgcttcttggtttttgaatgtcattgcttctacattctcttagtggacagatctaggaaatgatgtttgaatctatgtatataggtacatctcaactgatttatctatattaaaaccatgagttcacagcagtaccttcaattccagtcacatggctcgacctagcctcaaacttcttaaatgtgtagctttcttcttcaatagtgagaagtcttgctcctattgtctttaatatatttatatgttttcttattctactttacaaaaccaatattttgatacacatgccataaccttctcagctttaacattgctagtcatctctaatcataccctcagatttgactctgaatggtccttgttgtctcttcagccccagttgtttctttggcactggccatcctcctgacctctactgtctccttggccctcaccctgaaagtccttccagactcacttgcctctggctctataagatcctgggtatcaccagggcctctgctccctccatagaacccgtgtccctgaggcctcactggctctagctacatcaaagagagggaaaggaagagaaccagtagtacatatattttaagtgaaagtgacaggaaagtggaatgagcacttatttttctttatcatttaaattattactttaacattttaatactttgaaattaattttgttatatagtagaatgtaaggttctgacttgaagtgtatcattttctaaatgacagcatttttcaataccattttaaacaaatgctttcttttaaggacactctaaagataatgtgcactacactagttttcgtagaactgttcatgtgtaggcactcaccttgagaagtaggattttttttttacttaacgcttttgtctcaaattattattatatatagttaactgtaaaaacattgagatatattaaaaatattataggacaggtaatacatattcatggtagcaagtgaaataatacaaaggtttatgaataaaaagttactactctcctaggtagccaatgttaccagtcttgcatatccttctgctgctttttctctgctcatacaaacatgaacttactcatgcatacacataggtgtttcaaagttttattctgaatacatcacgaacacaaagtggtataattacatatatcaatgtaatatataaacatgttataaatatgaatataaatgtaaaatgaaccctatttaaacatcagtaagcctaagacacagaacattaccaatgagcctgaatattctcatgcgtggccacatctcttttctattccccgtcatagaaatcactccatcccaaattttacgttatttcttttctttacttgggtgcttattattttttactatgctttactcttttgctatttatgtatgtattattaatttattgtttagcttctatattttacataaatagtattattttgggatttgttttttcattgagtttcatatttgttagataaatcggtttgtattttattttgcagaaatggatttatatcatacacaaagcacacaaatatatatatttctttgcaa

SEQ ID NO: 2367 - DNA, 798 bp, Homo sapiens
ggtcattttagaacaagccaccacaagccaggtaagtgcctctgctttacttctagtatcatcataaaacaggagtccttgatgtcccaattaggatctcattctagatgacaagtatatagtattgaataaagaaagactcaagaacattaacaaggaagaatgagcataaaggagagaaaactcccattcacaaggagttgaaaattaaaatttcaaaacataagaagaaaatgaaaattcttttttaggaatgctgcttaaaaagcaagtggaagatgaattcttccaggtgaaatgaaaacatcagagcaatttgaaaacatcaaagcagttttaaaatgtctctaaaatgcatatattttggacttacaaagagatgaagaagaaagcataatttctcatgagaaatcatgaagccagaaggaagcagcacaacggtcttcaagtactgaacaaaatgaactatcaactgtagaattcaatattcagtaaaatcatcctttaggaatgaaagagaaataaagtttttctttatccaccattagacaaaggaaaccaagagaatttgccagtagcagatataccctcactagcagatataccctaaatgaatggcaaaggaagtcctctataaccagaagaaaaaggattgaaaaaaggagtcttagaacaccaggaagaaaagaagaataatggaaaaagcaaaaatggcaagttgagcagtgaagtggcagcctgctgtgttggggtgatggcctcacttttgtcatattaatgtgagatacataagcaggt

SEQ ID NO: 2368 - DNA, 1047 bp, Homo sapiens
aaataagatagattttgctatgattaggaaggaaagatatcagtgcctagattatcccatataaaggagttcactcacttttaagatgcaatctatttttgccttaaatgtcttctgcaaacagccttgccacttcagtgcttgtgagttgatgtatgtgtcaagagaactgagccaggtcccggctgtgccgcaaatcattcacgtggtgcagatggacacacgttctgttagtcaaataagcatattagattcaatgactatgaaactctccttccaggtcaaatagcctgttatttgtgcattccagtatgatcattgccatttatttaaagtatttctacctatacagatattagttactagcgactcaagtacacgttagaattaattgtttaaaagagcaaataaacctctcaccgcaatggcaattaaagacacccagtcctgctgtgtgcttcctccatttgcttctagtggcagtttcgtgtgcatttttggtgatgatgctccacggaacatctgcagatgtgctgtcaatttggacagctctgactaccgagtgaatgggaagtactaacgagaactgtctgcttgggaactccatgaagttcgtggcttttgtgattgaaatagcatcaataaaaggttgacactgtggaacaacacaagcctgcatggacctggttatctctgacctcgcaccactcatgagaccatacctgagccctactccactttggcagaactgttgcatggcctctcttcatataatacctctccgtacaccgtacaccgcagctcaaagaaaggatatatgctccctgtgaagactaatggaactgtccctcctgatcctcctacagacttcctctggcctaatgggtgcaccattgcattatatctgccatctatacacacatatacctttcaaccctgcactctctgagatgactggactcatgcctaaataactgatgctgtccctagtgtaaggaagctgcctgacgaggagctgtacggaaataagagtaattcagtgatggg

SEQ ID NO: 2369 - DNA, 2236 bp, Homo sapiens
ctggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagcctccaggcatcttttgaaatgtgcaacaaaataaaaacctctgaacctgttttgacactgcaaactcagtggatgacatgccagcccattggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaagtggcttagggagagaatgaaatcaaggaaaatgtcaacgcatttgcttgtttaataccactcaaagctgtgaactgtcatcctgccatccctcaaatatgcatgttactcacgaagcggaggaaaagtggtgttgcataattgagctgagccgttttatatcaattttctctctttaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggtaaggccagttcttctgctgttctaaagaacggaaaagattttggtatgtttaaaaatgatttcatattgaatggaaacttgagagttgtttttgactcctgtttccagcctgactctcagacatttctagaccagtatcaccgtttctgtgtgcatgactaccctgccattctcactgtccccacgtggcagcctgttcttactttcacacctgagctaaccattgcatctcctttctgtggggtgatcttccctgtcactcagggtccttgttagatcctgcttcagctcccagacaacaaattgttttttcttgccttactcatctgcccttgggtgcatggagtgacagcagtgtgaggcctgtggcccggtgctgcccatccttgccacagaggctgaggatcactgcccctggtcccccgaaagaaaaaatgtaggtcctttttggttttgagatgcttggaaatctgttatctgttagattgtgttttagataagacaccatttcttatgtatcttgagtccttcctgatgctttgtgtattttaggagttcagtaaatggttgttggatggataagtgactttacttcttgattgagttttaaatggacgttactttgcatgtatttaatgtctagaattcagggcaggcccaccaactaacacctgtgtgctctgtagctctttgattagcccaaaacaataaacagaagctgtagctttaatatctacacacagaccccactgcaccccaggcccactgtgggcatggtggcatcgaggagggtggtagctggttgggtatagagaggagctagacaggaatgctgggcaggaatgccagggtctgctcaggggcatgaacaaaactgccccgaaaagtgggttgctgactgccctcaggccttcctcttgcctcaatccatgagagaattttctgaggtcagatcttcgactttttatgtggaaaacaaat

SEQ ID NO: 2370 - DNA, 4997 bp, Homo sapiens
ctcccgtgcggcctcgggctgagcgtgcgcgccaccggctacgtgcccagcgctcgcgtccggtgcggggcgctggcgacggttttgctgcccggggcctagtctctgaaggagacacgcacttgcacgacgtgggcctctgtgcagctctactttgtccttctctgactcaacgttatcgcagtttgactctggagccactcaggtttttcctaagctcaactctagccagctaggttcctggtgctttggggagaccgtcaattggcctagcacttggccatcctgcccccaaattcttgtcccagttccgtgccagctgcatgatgccttttgatagtatccttccctcaagcatagtagggtttcagaccacaagttttctgaagcttttcgcatgcagcttgatgcgttattagtaggggctgctcgtgggaaaacgcttgtaattacacttcctcaagaagttaatgaaaatgtgtgagaagagagatttccaacaggtgatgaatatgccagccagttattcccttcttccttcaaatatccagcctagactgatttctggataggtattgtagaaataaaaatttcagacaaaacaaacttagattttgaatcggacaacagcaaactgctctagctgcccaggcatcaaactttataggctgaacacgaaagtaaagagattggctttgccttatttgggtatggtcacatgggaggtccctaattatataaccacttggctggttgtctgtttgtgattggttgaaactccattcaaaatcaggtacaaggggccgggcgcggtggctcacacctgtaatcccagcactttgggaggctgaggcaggcggatcccctgaggttaggagttcgagaccagcctagccaacatggcgaagcaccgtctccactaaaaatacaaaaattagccggacgtggtggtaagtgcctgtaatcccagctactcgggaggctgaggcacgagaatgacttgaacccgggaagtggagattgcagtgagcagagatctcgccactgcactccagcctggatgagagaacgagactccatctcaaaaaaacaaaacaaacaaaaggtgcaaggaatacctctaaattttgggttgctttctgggtacaaaaacaactccaaactaatggcctgctacttattttgcattaacagtatcaagtatcaagactccagcaaaagtggcagacagcatgggaatgctaaagagcatacaatatcaatacaggatagtactccagaaaatacgttaccctgcatgtggcgttccctcaatagatgtctcccctccccccaattttttttagctctgtgctttagtggatacaaaaattacttgctttcccaaagcctccttttgaagatagagctagcattaggttgattgctaaattttcagggattttatgagccaggtcataagcacaaccattattagaaatcaaattatataagctacaattaaattatcttaaaaataaaagtaataggccaggcatgttgagtcacatttgtaatcccagtgctttgggaggctaaggcgggaagatggcttgaggctagaagtttgatgttgcagtgagctatgatcacaccactgcactccagcctgggcaacagagtgagaccctatttctaaaaaaaaatttttaaatataataaatattaaaaactcatcactttgtagtttttttcttcattttactaataattctgctcttgaggttatttgtccattgtattccctgtggaaatactacatatgttgtatgcatctcttcccaactctattcagaaatgtcacattggtagcacgaaattggctgtaaggggagtatttacaccatggaaatgggcaaatgcagcaagtcagggcgtgatttattgttttgttgatttttctagaccatatgttagcaaaccttttgtgtaaacagccaaatagtaaatattttaggctttgtgggacttatagtctctgtcacagctactcagctctcactgtagtgccaaatgtgccaaagtagccatagacaatacttaaagaatgggcatgggccaggtgcagtggctcacacctgtaatcccagcactttgggaggcccaggcagggatcacttgaggccaggagttagagactagcctggccaacatggcaaaaccctgtctttacaaacaaataaaataaacagacaaaaaagctgggtgtggtggtgtgtgcctgtaatcccagttacctgggagtgtgaagtgggaggatgccttgagcccaggagttggagattgtaatgagccgagatcacaccactgcactccagcctgggcgacagaacaagaccctgtctcaaacaaaaaactcataggcctttatctgatagtgaagggaacaatagagttgaaagggaaaaatggagtagatacaggcaaatgtttacatacatgatacggtgcaacaagaatagcagaacatactgcaaaagaaattatgtcaacatatttaagaatcttggaagagaatggcaaatatgcactataattgatgagacatctacatattggaagaaaattacctagagatttatctccagtacacagttgaataagcttctgtactggtaaagatatttgttgctttaaaagaattggtgtcagctgggcacggtggctcacgcctataatcccagcactttgggaggctgaggtgggcagatcacaagtgggcggatcacgaggtcagaagttcgagaccagcctggacaacatggtgaaatcccatctctactaaaaatacaaaaattagccaggtgtagtagtgtgcgcctgtagtcccagctactcaggaggctgaggcaggagaatcgcttgaactccagagacacaggttgcagtgagcagagatcacaccattgcactccagcctgggcaacagagcgagactccatctccaaaaaaaaaaaaaaaagtaattggtgtctgccacacagattatatttctactacattattgtctattttactttttttcttttgaggcagagttgtgctctgtccctcaggctggagtgcactggcacgatcttggctcactgcaacctctgccccctgggttcaagtgattctcctgtctcaaccaagtagctgggattacaggcgtgcaccaccaagcccagctaatttttgtatttttagtagagacagggtttcaccatgttggccaggccggtctcaaactcttgacctctagtgatcgaccagccttggcctcccaaagtgctgggattacaggcgtgaaccgccgcgcccagccgatattgtctactttaaatgtggcttcagtaatgaatatttgaaatttaataatgaatagttgaaagtaagctgcattttgttttaatggtgctttcacaataatgggaaagaagactggagtggccacagatttgtcagaaaaatttcctaatgtcatcatttggttctgttaccaattataattcagtatctgaaataaaacaagtcaatcatttaaaaatattctggatagtctgggcacggtggctcatgcctgtaattccagcactttagaaggccgaggcaggcggataacttgaggtcaggaattcagaactggcttggctaacatggtgaaagcctgtctctactaaaaatacaaaaattcactgggcgtggtggtgcacgccagtagtcacagctactcgggaggctgaggcaggagaatcacttgaacccaggaggcggaagttgcagtggactgagattgtgccactgcaccccagcctgagacagagtgagactccgtctcaagaaaaaataacaatattatggataaaatttattctgtttaccaccaacccaaaaaaaggaaacagttggaaattatagctaaataacttgaaactgaaattattaaaattagccaagtacttaggttgagatgggtggacatgtactttaccaaccgctaatgctgcatggcacacatatcctacattataaatgcatttttctcattctttttattctggcctagcaacaagatcagctaatattaatttcttgtaataccttactttaatgattgatattcttaaataattttcattactttcagttgcactgcagttaagatcaaccaacattcagaaaattaaaaaattaatagaatgcactataaaagctttggaaaaattaaaaattggcattagaaagcatgactctcaagttgaatatttggttaagtcatcagtttgaagtcattccatttaataattttttttttgaggcagggtctcactctgttgcccaggttggagtgctgtggcacaatcatagctcattacaacctcacactcctgaactcaagtgattctcgtgcctctgcctctcaagtagctgggacgacaggcacatgccactacacctggctaatttttaaaaacttttggtagagatggggtgtcacatgttgcctaggctggtcttgaactcttggcctcaagcaatcttctcatcttggactcccaaagcactgggcttacaggcatgaactgccacacctagtcaaaaatagatttaaacctctgcctaagaatgtgttactaaaaagtaatgaatacatgtcttttattagaaacatcattttaagttgtttttatttgttaaaatcaccttcttggacttcttcactgtggaaaataatatcatttaagtgaaattttaaaacatgtattttgaattattttttctttttttttgatatggagtctcgctctgtcacccaggctagagtgcagtggcgtgatctcagctcacagcaacctccacctcccaggttcaaacgattctcctgcctcagcctcccaagtagctgggattacaggcgcctgccaccacgcccagcaattttttgtatttttagtagagacagggtttcatcatgt

SEQ ID NO: 2371 - DNA, 5813 bp, Homo sapiens
gggggaatatgaacaggtgagtggccacagtggggctgagacccgtagacagtgggaccagcgggggcttcccaaatcctgggccctcagactgcaggatcagaagagggaaaaaaccccataggaccggctcagcttcccgaggctggagggtgaggctgccccctagtggctgaagttcacgaccggacggacgttcaaggagtcccgggcgttccaatgctttctcccaggaagtgggctctgcaggctggagttgccctagtgtcagggtgaaggctgggagccaacgtctaatcatcaaggtgatggaactctgagggctgaagggatgttaaggcactgagggccagagcacttgttctcatcagcatcatcatcagcctcagcatcattgtcaccgtaatcagcatcattggcatcagcatcatcagcatcaccaccctcatcatcatcagtagcatcaatatcactatcatcagcattagcatcagcatcatcagcagcatcagcaccatcagcatcatcgtcatcaggatcatcagcatcatcagcagcatcaccaccattatcagcatcaggatcaccatctaacattttttgagggcttcaaatgcacaaggcactgggctgatttctttacatgcattgtctcacttgtttccaacaatgacagcccccaaagttaagtattattattgttaatatcctcatttacagatatataaactgaaacttagagagattaagcaacttgcttagggccacagagctatgttaagtgtaattttcaaaaatgtaaatcacaattctcaggaaaatataaaatgataccatgtcaaagattttatttaactcaataaccaatgagagaaccaataagaagtttaaacttattcaaagagcattagagaatttagatatatgcaggcaatttaacaacaaaaaaataaggcgagtatgataggctaaataatgttccctctggaaaaaaatcaatcctgatccctggaatttctgaatatgttacttatgttactttataaatagaaaggactttacagatgtgattaaattatgggttttgagatggggagattattctggattatctgggtaggtccaatgtaatcacatgcattcttataggagggagacaggagtgtcagctgagagagaagacataagaacgaaagcggaggttggagtgatgtgctttgaagacggaggaagaggccataagccaaggaatgaacctcaccagcaccacaggacccaccaccaccatcacaagccttatcatcacccctgccttctctatccctgcagcagtccggggatagacacagggagaggacagccatcttaccagccgaggaaggaagcctcagagaaaccaacactgccaacactcggatctctggcctccaggattgtgaccgcacccaccacagttatcacaggggcagctataatggcagcagctgcagcagcagtgagccccatgccaatagagagacataggcagtcacacccattgtagaactgatcacttaggccaagttattaattttgtactggaggaaactgaagtccagagaggtcaactgacttattcaagcctatggagctcttaaatagaaaactaagtccaaagatcctattttttggcctcacattttctttctttctactggtccacatgacttcatcccagcccatcagccctggaggctgggctaaggacagccccactatttgagcctgctcttccttcctatcaggagcaaaccatcatgaaaatcagccccattaaactctgattgtctgtgtctgggccatgtgtttcccttgtcaaggggttgaaatgctttgatttaagggtaggcaggatacttcttttaatgtttttagttaggacttggtcagcaaacaggaacaaacctgatcaaatgtggcataagcaaactgcaaactcggctcatgtaacaagaccaaggcagccctggctgcaggcatagcaagattcagggctcacatgatgcaatcacgtgtctctcctttctgcttgctttgcaatctgttgactccagtctcagactccatttggtagcgagatggcagcttcagtttgtgaattctctggtgcagcaggaaagaggtagcctgtttctcaataacataaacgaaagtcatggaattaattaatgcaaaaatatttattgaggtcctagtatgcaccagacattcttctacatgctcgggatactgaagtggacagagagaagaggttcctgtcatcatggagcttacttgagtcttcttgggctctgacatgactgtttttggccatgtgtaatctgtgagccaatcactgtagccacgagtacgcgatgtgctgggtcatgtgccccacttaaagaatgcaagcctcaggccaggcgtggtggctcacgcctgtaatcccagcattttgggaagccgaggtaggcggattgcctgaggtcaggagtttgagaccagactggccaacatggtgaaaccctgtctctactaaaaatacaaacattagccaggcatggtgctgggtgcctgtgatcccagctactcaggaggctgaggcagaagaatcgcttgaatccaggaggcggatgttgcagtgaaccaagacgatgccactgcgcttcagcctgggcattctttcaaaaacagaatgcaggtctctttttgagtgccaggactatgtcatagttatgtttgtgatgtgtccacaaagcataacccaagggctgtccataataagcacatgagaagtgacatcaaacgagtgaacaactgagtaaataaaccacagagagagaaagttcatgaaaggcaaatgtgtaaaaacacacgaaaaggggacaaatccaagtaaatcgaacaacgaaatgctagctctcagttgccaatccaaaaagagacataatattcactatagatgtcttgctaaaaatatttgcccagtgtgtttcatatcaggccaagaaaatcctgctcattattcagagaaacattagacacaaaatctgaagttgcagttcatttcagagttgtccctggggggtgtcaacaaaccggggtcactctggacctcacactttgaggagcaagtgaaagaagaaatgaagacagctcacagctggcagctaaaatatgtcgatgtcattatgtaaatatctgccacccacagccctccatggtctctcttgcagcctgctgtgggcacctgggaaacacttctccctgttgtctggtgttcttggacatagcctcttagttcctttgatgttctgcccttgatgttcattttatgcagctttcaactggtaaaaaagtttaaggcaaggaaaaagtctggaagaaaatttatagctcctaaattgttaacatgtaaaagagccattcgttggtcctaaatcctaaaagcgtggctctgtatatcttgtataaaacctatgtgggttggcacttggagggatgtatgcaattttagtcattacactgcttaaggaaggacctataaaggacacgtagaaagaggcaaactaaattattaagaggaacctacatttgagcatgagctcaaaggaggtggactccagcatggagagaccaaagctctaagaagaaataagtacatgctatgaattcatgaagggcatagaaaagatgcctgtaaacaaacttattcaccaaatttcaatagaatcaaataagaggggcaaccatggggtttcaaaagggtcaaaattgtacaaatattaagtgtaagtggctttaaacgatggtggcaaacatgaaatttaaactaatttttatgttttagagacacagtcttggacttaataaaaagagctttaaaaggtatattggggacaattggtaaaatttacaggtaagtcacatattaaatggcaccatttaaccgaataaatgttagctttcttaggtatgatggtggtgtgcttatttaggagaatgtccatattcattcaagatgcacggtgaaatgttgggggaaacatggctggattttgcagctgactttcaaatgaattagaaaaaacatctataaatatatgagagaatgacagagcaattgtagcacaatacagtcatgtgctgcataatgacatttcagttaacaatggattgcctatctcgacggtggtctcataagattataatggagcagaaaagtttctattgtccagtattatgctatgctatgctatgctatgctatgctatgctatgctatgctatgctataccataccatactatactatactatactttatttatttatttattttttggagacaaaatttcgctcttgttgcccaggcacgattctggctcactgcaaccttcaactccccggttcaagcgattcttctgcctcagcttccagagtagctgagattataggcgtgcaccaccacacccagctaatttttgtgtttttagtagagacggggtttcaccatgttggccaggcttgtctcgtttatctatttatttttgagacagggtctttctctgttgcccagtctggagtgcagtggcatgatcgtgactcactgtaacctcaaactcctgggctcaaggaatcctcccgtctcagcctcccaagtagctgggacttcaggtgtgtaccatcacacttggctaattaaaatgattttttttttgtacagacaggggtcttactatgttgctaggctcatcttgaactccaggcctcaaataatcctcccacctcagcttctcagagtcctagaattagcactctgagtacctagcatggaatttattacctttagaagtagcactgtttgaaaatataaagtcctttaagaatttggatatgttcatgagtgatgggtcaagagtgatgggtcagatatgttcgtgagtgatgggtcagagacttgaagatgcttttgatactgccctacccacagagaacaatcacacccacccttgacgcatctattggagaccgagtgttagacaagagtccagatggctcacaggcaggtctaggacaggtctcagcaatgttttgagaataaaacaaggaagatctgctgaatgtttaagttttttttttttgagagggatagcctttaatatcataaatggataattaagggaataaatgaaggaatgagtagatgataatgagtaggaggcttttggtaactttttttttttttttttttgagacggagtctcgctctgtcgccaggctggagtgcagtggcgtgatctcggctcactgcaacctccacctcccgggttcaagcgattctcctgcctcagcctcctgagtagctgggactacaggcacgtgccaccacacccagctaatttttgtatttttggtagaaacggggtttcaccatgttggcccggatggtctctatctcttgaccttgtgatctgcccatcttggcctcccaaagtgctgggattacaggcgtgagccactgcgtccggctgtaactttttatttttaaatagttatagactcacagaaagaggccataagtacagggtcacatataccctcccctcagcctccccgagcagtgacatcttataaagctgtggtaaaatagcaaaaccagggagttggcactggtagtgttgaactatactgcagattttattctgttctcagcattttttaagcttgcatttgtgtgtatgtaatgttatcccatgtatagattcatgtaaccaccatcccaatcaagataca

SEQ ID NO: 2372 - DNA, 3135 bp, Homo sapiens
gctgaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaaggccttcgcatccccatcagtaaaacgggcctaagaacacctgagagaggacagaaagcattgcgggcaaagtgtatgttgatttgtttgtttatttatttatcaaaaaaaattcatcggccgggcgcagtggctcatgcctgtcatcctagcactttgggaggctgaggcgggtggatcacgaggtcaggagatcgagaccagcctgccagcatggtgaaaacccatctctactaaaaatacaaaaaaaaattagccgggcatggtggtgcgtgcctgtagccccagcttttcgggaggctgaggcaggagaatcgcttgaacctgggaggcggaggttgcagtgagccgagattgtgccacagcactccagcctgggtgacagagcgaaactccttctcaaaataataataataataaatattcaccaaggtcctactctgtactaggcactgggaatacagtaataagcaaacagccaaggtctgctggcctcacagaatttatagtctagctggagtgatagataagtaaataatcataagactctataattatgaaggataataagagctttgaggaagtacagggaccttggcctcctccagttcgttagtgcctggtctggtttcttcaagatgcctaagcgttaaccaggtgaaacaggggtgggagagagaaagaagagtccctccaaaaagaacagcatgccgggcacagtggttcacatctgtagtcccagcactttgggaggctgaagcaggaggattgcttgagcccaggagctcaagattagcctaggcaacatagtgaaaccccatctctaccaaaaaaaaaaaaaatcaaaaaattagcaaggtgtgctggcatgaacctgtagtcccagctactcaggaggctgaggtgggaagatcacttgagcctaggaggtcaagggtgcactgagccgtgatcgtgccactgcactccagcctgagtgacagagcaagaacttgaagaaaaaaaagaaaagaaaaagaaaaccaaaacaaaacaacaacaacaaaaaaaaaaaaacagcagggacaaagatccagagattagaaagattttggagttttcaaagaatagcaagaatgagccagaatagctggagctgagagaccggtataagctggaactgagagggtcaggcaggggccaggccacaggagctattgaaggatttgagtgtttatcctaatgatggcagcaaatactcacatgccagacactgctctaaatgccttccatatgttatcgcatgtaatccttccagcaacactaaggtagggacgatttttatccccattttacagatgagaaaactgaggcacaggaagtcttagaaatataccaggatcatgtaattaataagcaatagaaccagaatttaaacctaggcagtctagttccaacatccacactcatccatcacaccacactgcctttcagagcaataatgtgccattgaagtgctgcgatggagatggggtagcagaatcagatttgaattgtgaaaagattgctgtggctatgggttcttatcactctaatcactgcttgcaccatccttggggagggcactggggagttaacagtctccatctggtggtgtgctggtgctggcttgcaaaaactaattgtgcacatctcttcccaactccccgatcaatgatgtcacatcaataggctgaaatcagctacagtgagagcacttacaccgcggaaaggcacacactacaaaccagggtctgcttttctctgccaagctggctgataaacggttaccagcacatcactatctctgtgtcacccccgtagcctctcgaagtctccgtccccatccttccatttccagcccccatatcttgaagggtgagacaggaaggtgaggcctctgagtctaggagtacaaaggcctagattatagcccagctctgctaggcagaggcgtcgttcctggcccattctcttccaccccaggtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagtgaggaggggcccccaccttggtcccctccctttggattctggggtagggcatgggtaggatgctgggcatgcctctgggagggagaagggagc

SEQ ID NO: 2373 - DNA, 8220 bp, Homo sapiens
cgccctgcgcggagggagatccactacaggctgcgcctctgcccctgcgaggggcacccctgggtctctgggaaacggaatggagggtcttatggaagagaaggtttggaaccaccgctggagggaaggggagaagaaagcaagcaggagtggcgcgaacaggaagggactagggatagaagccgggcttggacacagtgaggcacgaaccccgacagacacagagacagacaaggggtgctgatctcctcactgggcggggtgggcaggaaaaggaacaggagctggagctagagcgagggctgcgagcggcgagtggatacccggcctcagggaggagcttccaggagggcaggggtctcctttggagcagcaccggggacgtttgctcggcaagggctttttgtgcgaagtaaccgaagccagtcaggctaatggcggcagagagaaggatttattcttgcacccagggtgtgcggaggagcccaagggcatttggacctgtgttgacgtccggaagggcccggaacccaggaagctctgcccgcagagggtattcctctccctctgaagaccacctcaaagctcaactttatcacctccacgcatgagaccgccggcggctgaactaaaatctcaccatcccaattccagtttctgggaattgtcacctccattcgctctcattagaaatccagcttttttcacgaggtgaataacagggcagttgacagttcccaagttttctgtgtccaatcttcagccctggagggactcttctgctccaagtccagcgatcccgggagggggcccactggtccagtacggctcagtacccagccctggatccaccagctgacgctggaaggagtgggtcatgaagaactcagcacgaacgcagctgggtacgaattcccagagatgtcctgtccctccacggtaccaaggacccctcctttaagaaactgcttcactgaaggcgcagatggagggagggatcggcaacagagttcagaggggttccgggggcacatggctcagccggaggaagcaggctgaggcaggagagtcgcttgaacccaggaggcagaggttgtggtgagccgagatcacgccattgcactccagcctgggcaacaagagcaaaactccatctcaaaaaaaaaaaaaaaaaaggctttgggactaaagcccgtatgcagccgcccctgggcacatatacgtggttttatgactttggtactgactcagcctaactggaccccagatacaggagaaactgagaaggacggagaacataagcactgtccccggtgcactgtgtcccatgtcatcctcacatcaatcctgtgtcatagggtccctgcacagtttgcctgcacagggctgggcccgcaaagcctcgctccccaacgcacttgtttcatcacttcaattgagcctgcatcctgctcctgtggctgactggggaggggccagctgcatccccatctaggggccctgctcccccatcctctcatgcctgcagaaaccttcaccctggctcttgggtttgggcaggtccagcctgcagaggggagcggatctcctcctgggccctggcctgccctccctggctggcatgtggactaggggcctgggggctcactggatggtgcccgcccagactcacggcagctcctcctgcgtgcactctggcctgtgcagctgtgtaagggtcctgcggttacatgatgggaaaagcaagagggagcatctggggccctgaagtcccaagtcacacccaaaccaaaccacccagccaggaagatagcaggaagcaaattggaggcgttctgggttgaactgtatccccagcaacaacaacaaaaagatatattgacatccccagtacctcctaatgagacagaatcattacagaggtaatcagactaaaatgaagtcaataggctgggctttcatccaaggtgactatacaaaggggaaatgtggacacgggcacacacagagggagacaccacgcggacatcctggaggaatgtcaaagcctgctggcaaagcaccagaagctggggacaaggcctagaacagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagaggaccctatccagctgctgccccatctccaagagcctcgccctgctggaagtgcactgctagtctggttcatcagccactctgcacaggacccctgcccaggacccagggtctgcattttaggccatccttgctggataggcccagagcccagggtccccacctgcctgtagaagggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccagatgctgcagctgctccaagcaggcccctagttgctggtggctctggcccagctcttctgagtctcttgttcacctggggagatccccaccccaccgagttgtggctcagcctccaccagggttgtggagctccagcctttacccatgcagcccctcctcagaggccccgaactccacttcctctgggtctcagcccttccaggaggcctctctgaccaccccagcccgcagaggcttctctacactccaggctacgactctggaccagtgcctggctgcacactagcaggggggccagttatgtgaagatgaggatggtgctctctggagtgtcactgtgtggacgccctgctagaatctctctctcctggtcattctcctttcctctgtgcccctagagccccttgccctacattggaatcccccaggaatggggcccaggctcccttgcctctgccccctggtacagatgggcatggcctggatcagctaatgcccagattccctttcctgtggggctgcccctgccagctgtcttgaccaacctcagtgagtatcagcaactgctcctgcagacggactgtgtcctgagcctgggcaggggtctcagctgctggcatggagactctgggtcccgaagctcctgggccctgcctccatcccagctctgctcttggatctgcaggcctggcaccagcatctcctgtagatacacttggtccagaatcctggggtctccttccagcttccagaccacactggggtggtcttggcagaccgttgatgcctcagggcatgttgtggcagggtcctggccccaactcaagttatgactctgaacaagctctcctctgctctctggtctcagttttcccatctgaaccaggagggaagtcactgaatgatcccagggtattcccaaatgttggaagaggatccctctcttggctggactaagcccctgcgctgccttccttctctagataatgcttcaataatgaggaccagagaataaagtgtggggcagagtcaaaggtacagcagggccagtgcgcagggcctgccatgcacccacttgggggatccccaggctgggctctgggccaacaggctgttgggtcatttggtccaaatgccgctaggccttttccacttctgtctgcagcagcaggatcctgtgggtagaagggatggtctgcctgttccctgccaccccacccctcccccacagcccagccccactcacttgtcttctatgttctggtctggcctcctccactcagcctgtccctgggatccctgcatctggtgcctctcctgctccaggcaggccagggagcactccacctgctaggaggaggctgagtgggagggctgaaggcagcacagagcctcagataggtagggctagcttccctgcctcccaccaggcagggcagtgtctgcagcctttgataacgcaggcggactggcagccagcagcccagctgacagcccaacatggacccatgccctggcttatatacaagggactgtgccctggggccctgaggggctgcttttggctgttatctatcacgacaggctccagctgtgcatctctacctccagctgggcccgagatacaccgcctctccagctgctctccagctgctgacagcttcagggtggaggccagcaggactgctgtggcatgctaaagggcaggcagacatgaggttgtcaactgggtcccaagggtcccccaggcctggtagggagcagtggctccaggtgggccagctgtgagctaagacacagagtcactgaaggcttgcgtaactgggccatcacacggtgtccctttcctaccctcacatgaggcagagatcctggtaaccttcccaagaaccctcagcttgcacagccatctccccctctctggggctcgcctgtttcactcggggagattgggcttctaaggaagctcttcagtctatggagctaaaaccagcccctccctccctcagattctccctggggggccacagggaccctggcccttccttcacctccagcagtgtccctagccacccccagcatatgcctctcaggcaacaccctgcacccttccaggggcaccattcagagacatctctgttcaacaccgcagccttgctggggactccatttccctttctcctctgggtgccccagaccccggaaagcctccctgagaatatggcaccagatgtggacaccagctctgggcattctggagcttcagcctgctaaggggatcttgctagctcaggggacctcctttcagctacagaaagcccaggaagaaggaatgggggaggacagggcctcactttctgctttagggaccagccaagtcccagcttgtgctcccgcctctgcagcaccagggcttgctccgacagggcctccggcactgcccgaagacggcttgccagctcggccctctgctgcctgctttctgccagctgctcccacaggtccttctctgcccgcctccagtcccgctcgggggccctgttggagcacatgccagggaaagaggagccagacttcagcccaggccccagggggctgccatgcccaactttcctatgctcacctgcacccttcagtggggcttggtgggcagacacggtccaatgccccgaggaaataggagttccagagacagcgggcagggctgggcatcaagtccatgggctctgcctcagtgggacctgagaacaggacagatcctggagctggggtagtcttggcttcccaaagcaccaggctctgaggcctcttctcagactcagaattgaggccctttggctgagcacgcactaaaacccttcaaccctgatcctctggcccgaaagtctcctggtgattggaacttcactaaacaccagcctcaactccactaaacagttctcagttcccagtggtttccatgagctgtgggtgctgccaggggtggccacttgctgaacacaaaccccattatcctcacagcagctggtctggggaggcgcagcaggcactcctgaggggaaattggtgcccaagtccggcagggagtcccgtgaggagctgcaatccccacccaacactgtctgcaccagagccacgttcccccttccagtgtggaagtctggaaatggcaggggagcatttgggggccaccacagtttagctatgatgtgggggtcagagcccttaagtcaagtcactgctcaggtacctctctggcttccatagcttcagctgtaatatggaggccctgacggacctctcacccaccagcttggtgaggaaggtcagagggtagacaggggctattctgccagtgttgccatccctacacccctcaccatcaccctcctcacctctagggtctgggcccaagtccactgcctcccaactcccaaccctgggcacgaggcaccctgccctggctctgaaagggcacaggagttgtcttcacctaagcagtggttacacctagcacctctaccacccccaccctgacctccccactcctcacattcccaggccttctccactcaggatggcaccatcgcccaccaggccttctccccactggacagcttgactctcctctccccttactccaggcccaggctcctgcagccccctccaaaattgtctcccctccaaaatgtcactgccacacaaggcttctctaagacagaccatgaggactggccgctgcccccacctcccatactgggtacagctcccacaatgccactctacctgggtgctctgtcttgccagttagaagtgacaggctttccatggcagccccctgcccttagtgagaagctgagctgtgcccagcttggtccgggaggggctcatggtccacagaatggagtgcacatgcaggccagattgtcctgagcaggggggcaggccagggcagccccaggaaggctttccagggaggtgaccctggggccaaggctcagaggtgaattaactgcctccagagaaggcaaagtcagatgaggcagacagaggagacagtaaggacaatagaacaaggagggcatcagagcagctgggcctggcgggcagtgaactgagccctaagcttggtggaagtggaggtggggggcaaaagggagaccaaaaggggtgagaggagctgtggggtttgggaggatgcagggcagcggcacctccccagtgcccttgagatatgctacagacctcaactccacagaggctgaggacccagacaggagcttgggcctgaggggcagtggaggtggagcaagcctcctctgaggtggggatgggagtggaggagttacccaaacctcacctgggggcagatctttctccaagtttctgaaaggtgtgaaagtcacaaaagaatgaagctctaagggtagaatctcaggcaggatggcctccaggctgcaaagtgtggagagggagacagctgggagatggcttctgttccacctcagaaaaagagagttgcttcgtggctgggaggtagggactcctggattctcagtggtgggcagttttgtgggaaggtgactaacttaccccatcagagcctatagctcagggcagggctggggacagaagcttctctgagaacatccatcccggggacagaagcttctctgagaacatccatccctcagggctagtatcctggagccatggaaactcaggcaacactaagtggtgggaggaggagacaccagagaggcctcctactccacctcatctgagctgatgaaaccccgagatggaacctggctagtgtggtcgaggccatgggtaccaggcaggaatggcatctcagatggcctgggatttttcaaaatcttcagcttttgagataggaccttagggggcaggacctcagcagccaatctgggtcacccactgtacactgaagcggctcctaactttcttttttgagacggagttttgctctcttgcgcaggctgcagtgaagtggcgcgatctcggctcactgcaatctctgcctcccgggtttaagtgattctcccacctcagcctcccgagcatctgggactacaggcgcgtgccaccacgtctagctaatttttgtatttttagtagagacggggtttcgccatgttggccagactggtctcgaattcctgacctcaggtgatcatccacctcagcctcccaaagtactgggattagaggggtgaaccaccgcgcttggccgattttttgtttattttttgagacagggtctccttctgtcgaccaggctggagtgcagtggtgtgatcatagctcactgcaatctcaacctcctgggatcaagcgatcctcctgcctcagtcccctgcaaggagctggaactacaggcatgcgccacccagtccggctaatttttgtaattttttggaaggggacccagttttgaattagcttctgttgtttacttcggatagccatggtggagctggcagagatttaggggatactaaacacccctacaaatcacgccttgaaaccccccgtttcagggagagccgctggcgaaggacttgatgcgcagccgcagctcggaagcggggggctcccctgcgacacctccccgcttcaggggcgggcccagac

SEQ ID NO: 2374 - DNA, 13719 bp, Homo sapiens
gtgaaatatcacctgaaactttaaaatttacttttacatttattattcttcaataaagtgaataaggtatggacttttgcagtgataaaaagaatacttctgccagcctttctacttcacagctgaacataatcacttaaatgaaccatcatgcacttagactgcaaacatactccccttacttttgtagtacaaccatttgtgcccattgaattgtaagttccaaaaaaatctgactctggcttactcattaataaatgttcagtacccacatttttgtgggtactgtgttttgctgacagtagatgctcagtatatttttaataattgaattgattaaattgtttattttaaggtctcttcaatagataatcagaacttgaaagagaagtgtaaataatagcagcatcttctttgtactttgaaactacatctagaaagaatgactgtaacgatgtattcctaatttgtatatccaaagacatttcaggtctgctttagtacgatgtcatagtagggtcacatgtacaattagacatagactttcagagttgaaaggatcctgaaatgtcattattccagctttccatccaatgcttgagttccttctgtagcagttgttctcaacttttgctgtatattagaatgagttggcaagttttaaaaatctcagtgctcaggtcccacctcagcccaattatatgagaatttccaggggtgagacctaagcattgatatttttttagaaccccataggtgattccagtgtgcattcaaggtagagagctgttgttctacaagatctctacaaaatgtttttccaatctaattgaactcctctgaagatgagcacctcactaccaaagtttgacttgtgtttattccatttattcaaataataagtataagagtgtttaaattataagctggtgaagtgaaataacacaaatcaagctcaccaattttaatactcagctgttgataaacaacactgaagagtgacatttaaatttgaattatcttctttgaagtagcattgcagcacttttgaatgacttccaaaaggctgatcataaaaatcacttcaatcattttcaaattttactttagcagcaatgaagttatttggtatgactcagatgaaccttctgctctgtcttggagttattatggtcatttcattttctgcaacctggggaaacagagaagggatgagcagacttgtttttacatgtaccttacatatttaccttacagtgtttatagttaaaagttaggcactttcagaaatgtgctagcttcacaggaaggtaatttaccatgtagaaaatttcaaatatactgaaaaaattgagtggaatagtgaaggcttggattttgtaaagctctttgattttagagaagaattttcagaggaagcgccatgtgaccacacacacaaacacgcaagcctgtattcttgcttaggaacttatctgtcctgagaccatccacctgtatgacagctcttttgagtacctttacatttttggttctttagtaggacctgggtacgaaaagtcaatatataacatcactgataaatatttaagtagttctaaggtcttaagagctgtgtttgagtttcacctcccttcctactcatggtgtagccttgggtaaattattattttcagccttagtttccctatttttacagtagaaagaatgccatatatcttgtaggaatgttatgaagatttatagtagtaatgcatataaagcttcacagtagcccctgcgttgtagaaagggctcgtggacttaaattttgtgatacattggaataccagcattgctgggcagactacaatgacgatacattttcttgtttttcctgacagtggtaggaaaaagtcctgagactagttctgtagagaacatcatctgtatgctcctttataaaaaaaaaactattctgagacatgatcttagattgttcctttaccaaaatgagtttcctgttggaagtcctaatgccacagcacatgggtaaacatgggtctctttaagaatatagaggataggggatggttgacgcccttagattttctctggggaaccaggaaagctagcctttctagtggcatacgtcaaccaagactttcctggcatgtcttcatcgctagtcttctcgtctgctgctttgtagagttgccagataaaggacagccatttaaatttgaatttcggatgaataactagatttctgttagtataaataggcctcagatgttgcaagggacttttatatttattcattatttacctgaaattaaaatttaactgagcatcctgtaggtttcttattttttctaaatctgacaacccctacctacgtgctatgtaggaattttggggttagatgttgggcaggttttatcctagactaatacattactatttttgaatgaagtagagagaaatacttcttagtaagtgaaaagactaaattatagcattaaaatggattcattggttaaaatactacaaatatgattgttacaaattaatatcaataaagaaaagtagacgatgatccagatagaagaacatcttcctacttatctgatcccaagaacttcagggaatcttgaacctaagcatcttccaactacatacttaaggcatattaaagagaatgtgtgatagtataagtatatcctttttaaagaaagtctgaaattaaacagggttgaagtttgattattctttgtttaaagcttgttatgtacattttatttacatatattttacatatatgttagtgtagcaattcctaattactccataacacactgaattctcctttctgtaaacttgtaaagcatttactttgttattcatttattcatattaagtaagcatcttatttaatattcttggcacatcgatcttctatgtgccaagaattgtgcttagtgctaagggtataaaaataagagcaaatctctgtccatgtggagctcatcatacagctctggaaacagatacaatattgacattataatgcaacgtgacaagagctataacaatgaaatgaattgcttctgagatccagaaaaagtagtctgatggaggtttcactggagaagggacatttagactggattttctaggatgaatagaagtttgctggctaagaagggaataaggctattttaggcagaggagagagagagataatgagtaaaaaagaataaaaaaaccctcaaacccagcaccccatcctgtgaaataacctgttgtgacttggaaccagtgagaagatggcatggggaggggcatcctggaaacagggtagaatgtacagagttggtgattcgatttaaagacaggcaagaggagcccatgaagaacattttgtatcaggttataaattttgtttttattgtatagtcaacagggttttaaataagactgaggccttaagtcggtaagacctaattgtttgtttcaggaatatacctggaatatgaaataacacgtggccagaaattattgcaatagttcatgggatacatgaggacaataggaatagtgtagttgcactagaagtggagagatcttgaatgcaagacatttctaagttagaattattaggatttgaacaatttttctgttggttttttttttttttggtatgcggaagaaggtatgaggataaaaaatagggatagttcatgtatgtgaactatgtgtgttatttccttaaggccttaaggtcattagaggcagggtttctctcctaacaaacagtactcaatacattcttgttcaatttaagaagaaacacaaaatgtttaagatgggtgcatttgtgtgtctgtacttcattattattttgacaaatctagtcggtattataagaataacaggatgcacattggcaaacccattttttatctcacttagttaaataaaataatccagttgtctgacacataatgattttatcaaaattaacctttgtctttgataacttctgccctgtgattgttatcatttactttaaaatataatcatggccaggtgtggtggtgtatgcatataatcccagctactcaggaggccgaggtgggaggatcaagaccaacctggcaacatagtgagaccccatctcataacaaacaaacaaaaatatttgtatcaaaacatcacatgtaccccataaatatatgtatgtatctattatgtacccataatcactaaaaatttaaaaaataaaaatataataatgtatagttcttttcattttttaatgtgtcaatagaattgttctttgatgccaggcatggtggcccacaattgtaatcccagcactttgggaggccaaggcagggatcacttgaggccaggagttcaagagcagccttagcaacatagtgaaaccctgtctctacaaaaaatttaaaaaattagctgggcatggtggcatatgcctgtcattccagctactcaggaggctgaggtaggagcattatttgagcctgggtagttgagggtgcagtgagttgtggttgcaacactgcactccagcttaggcaacaaagcaagaccttgtctcaaaaaaaaaaaagatttattctatttgatagttaaagaattcaatgctgggtaattctgaggcagaccaaattgtggactttgaattcgtagttttagctttgtcgctcagcattaaaatcataaaacctgagacaaagaagcaacaagcagtaatgctttatatgtaaggactttcttgttccaagaaatgtatcaccttatatacaacacaatgtactatttaaatgtaacataaattatatattcctatgcattatttttctgttcatgtatatttttatattcacaaatgctatttgtgagtcgagttttacatgggtgtattaagggaggcacaccagttgatgaggtcttgtgtgaggtctttaaacacacccagactctaaggcagcaatggataaccttgaacaggtaaggagcaggtggccttagggtagggagaaagtgcgacattgtaacatccctttggataatgtctgcagccagatcctgtgtcaccatgactcagcatcgaacagacattgattgcacagcataaggagcacacaggaggcaaagctggtctgtcacatggcaattagtttgagacaccacacctgtattcccacagcacatctcattcccccatatctttggctaccacagaggaaagcagaatggatctgggcaatttattgtcttacttttgttgaggagagggagagcagcagaatgcatgctgttccactttttctgtgctgcagtgggcatattggtcattgctgggagcccttcaatgaaggacagtgacagaacaccaaaaagtgtcaggagcttccatgtggctgaaaaaccacattcaaaggacatcagccagtgttctagtgttaggctgtgacttgggcatgtaaatgggccaatgattccagttttgcatggaaaagacacatgattagtttttcagtgaggaagtagacaagttttactaatctgttgactgagaggttataatatactcatgatgaaatctctctggagcaagtcctgtgaaacagtgtaatgacttggcacaggatggctggattcgctttaaaaaattattattattcatgtttatttaggtccaaaggatccattatacttcagctttatatgctattaaatttagagatgacacaagtcaggacacatcttacatagttcctttcatgggacaaaagacctgatagaataaggtggcatttatgggcctttaatatcaacattacaaaagaaggggaattgcattttctttatatgtaagaaaataatgactaatttagagtaattctgaaatgaaatcatggcattattgtcaggattggtaaatcttttaagctattatcatttctgtcatgcagctgcattcaatgtcttaagtaggcaatgtgatattttcacaggaattatcaaataaactcagtatgttagcttctcagggactctggagctttgaatatagaggaggagaaggtccgatgaggggaaaaagaccttctgaaccccccgtggtcataattccagggaaagaaggagaagaaacttaaatatttattaactccttactggctgttaagatttttaatgtatttcattccctttaattttgaaagcaattctgtgagttgaatattatttcgatttttttgctaatgagaaaacaagctcagacaaggtgaacagaaactgacatattaaaacccctatcatgtaggtactgtgtaggaagttaagatgtattttctcatttaattatcaaaataagtattattttatgtacgtgaattaaaataggctagattatactttgttaacaaatagaccccgaatctcagtggcctagtaatataaaggtttatttttcgctcacacaaagtttactctgatgccaggggacttcccaagccagttcctcctgtggttccttggcagtcgaggccaagggaagggaattagcaccacgatgcggtcacactccctggaatgaggactccttgcttgttgccgcagggaaaagtaacaggagaagagtgcatgggttcttaaggcctcagcccggaacttaggcacgtcctcttccctcttagtccatcgtccggggtctagtcacatgggctcaccgcaccgtgggcaggctgggaattgcgagagagaagatggatagcagtgaccccaactgggtctgccatggcactgtcacccccattttaaaaatgagaagactgaagttcagagaggttagatcatgtatccttgatcacttccttggtgatctgtagacttagttcttgaaactagatctctctcagtccaaagaatctgtttttttgccctctactccatcttacccgacacacactccgagtaatttggtggtttggagttaggtgtggatctgtggtcgccagccttcaagatggctcctgtcatccttgcctcttggggttcatgcccttgttgttccctctgtcagtgaatagagctgacctgtgtaaccagtgtggtattgcagaagggacaaagtgtgacttctgggactaggtcataaaagacagtggtgttttcatgtgtcagtgctctctgttggatcacttgctctggggaaagccagctgccatcaggtggggacactagaggagccccagggagctcccatatggcaaggaactgagacctgctgccaacacccaggaccaatttgccatccatgagagtgggccgtctcgaaagtgggtgagtcaacccaggtcagccttcagatggctgagcccaggccaacatcttaacagcaaactcatgagagaccctgggccagaaccactccactaagctgctcccaaataattcttgacccacagaaattgtgtgaaatgataaatgcttactgccattttaagaagctaagttttggggtaatttattatgtggtaatagataacagtacaaacctttttggattatttcctttctctgtgtttttccctcaactctgggacaattcctgcttttaacggtgagtttttaagttagctaaatgagaaagtaattgccacacaatgttattaaattttagttaaatacatcttattatttactttaatcttgtagttctaggcaagctctgtatgaaggtctatactaaaaaatgatatactctgctagttcagaagagagaagttttgaaatttactttccatcagatgtgtatttttctgttttaagatattacctgcttgagattattttatagtttaaattacattgtgaagttttgagaaagaacaagccaagtacatttttattaagagtttactgtcaggaggaagacagaatctagaagtaaccgcttttttttttttttttttttttttgcaaggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatctgtgaagataagctatcaatttacattgccaaggtgaaatccaactgaactcctttaagataaagatcttgagtcccaaaaggaatttcctagtgggcaaattgtgagggagatttcaggtttctacttctacatctccagccctgaatactcatggaatatcgctgtacctatgacaggttgcatgatttttccccctctgtgcactcaatttgtgtattattgtatcatatgacattctgaatcaagtgctgctagtaccaagctgctatcatcagctgatgccaaaaatattcgttataacacttctcagcatgcaagtgagagcacttcaaatcacacagacagaatttccagccattgttcttttcttctttgcttattatacagcaacaagaatcaaaacaaaaggggatttattagaaaataatgcttcagtaaaatgttataaaacatgaggtttattgtttgtgaagatagagtgaaattcagtaccacattatagataccacctcagaggcctattttccccttcttttctcttttctcaaatgtttttcaagtggcatctttttttcagtctttgattacattaaggtgcaaactatttatccatctggaaataagcaatactgtcaacagagaaccaggaaatgaaaagtgcagccggccatatgccttctctacggcctctttatgttactgtgctgatcaggacaaatgcagtacctatggtagcaatagggagagtgaaaatatgtattctccaagggaagacaattaaaagacaaattccatcaggaagatttgtcattttttgagagtgctgatcctgcatctatcagcaaatttcacataaattaattcattttacagagtgaatgctgaaacttggaagccaactgacaagatgccagggatggcatggcaaggaagagagagccttcatggcaattttgaatacctgatctcttgctttcatcatcttgtctaggggaagaaacacggagcctggtagttgggaggtgagaggcaggaatggataccagagatggacagacagtggggtggtgagaagggagctgcaatttgctaatccttgtagtactacctgtcaatcatcttgctttccttaatcatcgatcctggagagactttgaggaaagggctggtggagttgcgcagatgtgatcttcatttcagccttatgaatacataccaaggtctctttaaatctgtggttcctgcacaaagtgctgtgacttcaggctaatagagaggtccagatgtcacatgtgccaattagaaagaaatgaggaccatggctatggcccactgtgttcagaagacacgcccaagccacccattgtcattcattgtgtctaatacttgacctgtcctgctgtttattatgtggggtggctccatattttaaaaactgtattcataaaaagatatttctcatcctgctgagtctcaggcccattgttgtaggtgaggtggtttcttttgtttgatatataacgttttgctgactttcgacttgggaattgcaaaggcttacccaaaaccctgaaggaaaagctaagaattcatacttattaagcacttggtaggtgtctgacactgtagtagatatatgcgagagcccagaacaagctgatgtccatgtacatatctttaaaaaatataatgatctagtcttatctgtggaaactgcttcagatactgatcttactctttcctgttacatcagaaattctggaaggtaatatcctgaaagatttatcctcaagaataacaatacattaaaatcttctgctttgaaaatgctttgaaattgtcagtttttttttttttttttttttttttttgctatagagtataaggtaggaaatatttggcaggtaaaatgagacatcctctcaactctgtcagtttttgtcaatttctgggatgatgaaagatatgagaactagaaggctggtttagtactgactcctggtttatgttaaataatgaaatgcaagccagaaaaacaaattggcgggggctccggccagccagccattctgcaagcgcttgggattgggcaaagtgagagtccaggtcacagacaaggccggctctaatccagataactgtggagtcagcattaatgtgctgactcactgcagcgactctcaagcatttctcttaccctttaaatgcttccaagttttatactttaagtccaagtaggcaccacaggcaccatgtggacaagcaggagggtcggcctggggtcctacaataagtgataccacctcccttttgaggtggtaaaaaccagagcattggaggagtcagggcagaggtgcagacaccttcctgggacctgttgaatcctttcaggtgtacgtagctgctgggctctgagctctgtatttttttcccagccttattcttagggtctgattttattccaatcaagtctttaacattctttccttggtttcttcagtatagcacaccccacagtatggtattgtgtggggactctcagcttgatggatgctgatttttctggttctaaaaaatgttatttattgatctatctattttaatttacacctatgcagttatttatttactctggtgaatagagaacacattcttgacacggggaaggaatacactcctttaagcttctcctagcaccactgtgaaaacttctagactttttttcctcccaaatcctatgaacatgttagcgagttcctctctgccttctactcagaactcaaaatacagtttctctaatctgaaggtaggaccaaaccccatatataaaattaccagagtaatatttgtaaagacagtttcaaaagaagaaaaggcttaattgtaacttgtaaatgatggttcatgaaggaatgtagataatttataagactggtttgatttcgttggtagaaatattttcaacagcgtgtggctgaaaagttagaaaatttctatcagtcatgctttttagcaaagcatctttttactgcttttagagtcatgcacaagaaaacatgcagcttactagctataaaatactattgctccattttaactctctctttgttttgattttttctttttatttttcaaaatattattggttatagaatttgtacttggtttctgcaacatcttatgctcccctaaagaacaattcaaactatataggtttgcatagatccacagagtaggtctcacaaagacagagttatcctttgctgctggtatgtcattttgtaggcatggtagctgtggcaagggctggtgacaactgcgtagggtgaaaatgactatatgattttaaggattgtggagggacgcagcaataaatctgctctggtaggagtgacagtagccctggacctagctcggggctgtaccctatcacttactccagaataaagctgaagaccacagccaagtcttgcatatgcagaaggacacaatactacattggtgctgggctcaggcacagcactagaatttaatggaaaagttggtagttggcaccagaacaaagtagatcgggtccagagagccaaagatatgtttctctcaatcttaggagactgttaactgttgcactcaggctgctccaggaaggtagcagtgacaattttgatgatgtgctgtgtggcttattaccatttgtcttagtctgctcaggctgctataaaacataccctaagatgggtagcttataagctaaacagaagtttattgtccagttctggaagctgggatgtccaatatccaggcactgtcagggtaggtgtctggtgagggctcatactctggctcttagacagtgccttttccttgcttcctcaggtggtagaagggacaagagagctgtctgtttcctttataaaggcactaatcccatttgtgagggcttcagtcttatgacctaagcacctcccaaaaatctcacttcgtaatcccattaccttggggattagactgtcaacatgtgaattttgaagggacataatcattcagttcattgtaccatttgagttactcaactgagctcttctttgaaaactaagtctctttctaaatatcctgaacttaatagaaataacttaccttttaaagtaagaattaccctttaagaatagaataaccctctcaggctaccacgttctgacttcactagaatcttagaaagaaagagagagagaaaggcagagagagagagagggagggaaagagagagagagagagaccaaaaaaatcattcacacacgaacaaggtaaccatggtattaagagaaccataaattatttagcagtgattcatcctctaagcatgtgttgagcatgtacaatgtatagagcattgtctaaggcctgtacctatgttggcaaattaagatatgacacagaatctcttcttatgggtctgaaagtctaatgcaggggtcagcaaactacgatctgcaagctgaacctacctcctactggttttcgtacaaccctcaagctaagactgaaaaacactaaaagaagactagtattttgtgtcatgtaaacaattatgtgaatttaatttaggggtacagacactgaaataaaattttatcataacatagccatccttattcttttacatattgcctatgatgtttttcatgttataatgtccaacttgagtagttacatcaaataacttttggtgcacaaagcctaaaatatttaattttagctctttaccaaaagagtttcaatgggttttctaatggtctagaaagccattaatcagattatcacaccattaaaagtaagcatgtgggaaatgctgggaatgaatggtgtatcaatgtatgaatgtgtacaatgagatctagaaatatagtgatggcaagcagacccatggtggaattaaaaccttcatcactttttgtttaattctttacagggctcacaagagaccacactcaaggagtgatgaacaaattttaattggtaacataattctagtaatactaagtgttgaggagtttctgactgaatccctacttctctgatgttgaaggtgttgtaaggcaaagggtcaataaatcaatttagtgacatcctataatgcccaggctttcattggctaaccttggcatttattggtactccaattgaaaaaaaaaaagaaacctgacaaattcacagaatatagagaaaaatgttgaaggatacaagcttttaaaaatgagaaaagagggtgaggagtggtggctcatgcctgtaatcccagcatgttgggaggccaaggcaggcggatcacttgaggttaggagtttgagaccagcctggccaacatggtgaaaccccatctctactaaaaatataaaacttagctgtacattgtggcaggcgcctgtaacctcagctacttgggaggctgaggcagaagaattgcttgaatccaggaggtagaggttgcagtgagctgagatcttgccactgtactccagcctgggtgacagagtgagacgccat

SEQ ID NO: 2375 - DNA, 11189 bp, Homo sapiens
aggagacatacaatcaacactccactcagacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacaggtaaggtttggctaaaggatgaataagaacccctccttgtcttcaggagtttgtctagcagaggagtctgtcatgtaatcaggaaactccagtacacaacgtgatagctctaagacaggtatatacaagatgatgttctggaccttaactgtttggggagtactactgcctttgtctaaaagccatcaccctttttatatgccatttgggaggaactggggggacgtgggaggcttcaaagggttatgggaggatggacattttaaaagggcttttcttttctttttttttttttgagacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggtaattttttgcatttttagtagagacggggtttcaccgtgttagccaggatggtctcgttctcctgacctcatgattcacccgccttggccttccaaaatgctgggattacaggcgtgagccactgtgccctgccaaaggccttttcaaatctaacgatgtactcacatttccacctgtctgccagcccttgtccagtttgacctgggcactcactgctgctctggtggtgagtactgctgatggttcttttccctgcccatccttgaggtgctcgcttcaatatgtcaaatgaggactctcattacatttggctgtcatacatcagccacaactgtcctgcccagaagagctggccttggctttaaagcctacatcctggctgaccttctttactgctttattaaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaagatacatgaaaagaaagaaggagagaaggaagaaaggagggcggaaggaaaggaagaagggagagaagaagagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcgtgcctgtaatcccagctacctgggaggctgaggtaggagaatcgctggaacccgagaggcggaggctgcagtgagttgagatcatgtcactgcactccaggctgggcaacagagtgagactctgtctcagaaaaaaaaaaaaagaaagaaagaaagaaagaaagttaccattagttttttgttgtatttgcaagcaaagacaaaagcaccaaggtacttgtttccttctgtaattagagtttcaaatagactaaaagtttctgctcttaggtgggtctagagactctccagtacctcaggacctcaggacacatggggtctcttggttgttttcttttcattgttgttgtttattttatttttgtttttattttttaactttaaaacaattttttgtagatgaatatgcttacatatgtttgggggtttttttgagacagggtcttgctctgttgcccaggctggagagcggtggtttaaccacagctcactgcagcctcgacctcccaaggtagggactgcaggtgtgtacactggggtgcaccaccacacccagctaatttttaaatttttttttgtagatattgtctcactctgttggccagactggtcttgaaatcctgggctcgagcaattctcctgcctcggcctcgtaacgcgttaggattacaagcgtgaacaccgcacctggccagcatgtggtctcttaaccagaggaggcctcttctgaactaggtagaggtcctgagaattgattctgagagtaaaaggctctttgttctcctcagagtagattagaatccctaatgatagagcatctattattcctctagtggtccatgcccaacagattcatccaagaatagatgaagatctttgtaatgttgtgcaagtaatctaatcaccccacagaagagctgtgacttaaattatcccagagtcggcccacctgttttcataaagatcaatgtaacttgtaaatttcttcagttctcctcacctatcatcatttgactaacaaaacccagaaaactaggctagttatggtggcctatgcatataatcccaactctttgagaggccagggtgggtggattgcttgagtccaggaattcgagaccagcctgggcaacaaagggagaccctgcctatatcccagctatgcaggaggcgaggccagaggattgcctgagcctcagaggttgaggctgtagtgagccatgattgccccactacactccagcctggatgacagagtgagaccctgccttaaaaataataataatagtaataatatttcataaagatacaggaaactagattataattgacattttcaaagtgaaatactgtctagaatggtgcttggccaacagtaagctttttgtaagtggaagtcattactactactatttctttcattattattaccattactacttttttttacaaaaaaaaaaccctggacaacacactgaaaccattactacttctactactataacttaggttgcacctgatagagccagcaatttttccaaggtatgacaatggccatatgtttaatgatataattctatggctcagtgtatctcagcctttttaaaccctgctcttcttttgacaattgtaaaaatcttaaactgacctccagttgaaatcctctgtcaagaagatattgtcggccaggggcggtggctcacacctgtaatcccagcacttttggaggccgaggtgggaggatcacttgaggttaggagttcaagaccagcctggccaacatagtgaaaccccatctctactaaaaatacaaaaattaggcaggcatggtggtgtgtgcctgtaatcccagctactcaggaggctgaggtaggagaattgcttgaacctggcagggcagaggttgcagcaagccgagatcacgccactgctctccagcctgggtgagactgtctcaaaaaaaaaaaaaaaaaagaaagaaagtaagaaaaagaagaaatcccaatctcttcttttatgtggattcttcctcacttgaataatacttttcttccccagtattctccatattatcccagagtcagcccctctgtttttgtaaagatctacgtaacctcctctaagtttcccagttctcctcacctatcatatcatttggctcaacaaagggcaggaagctagattctaattgatattttgaggccgggagcagtggctcatgcctgtaatcacagcactttgggaggctgaggcgggcagatcactggaggtcaggagttcgagaccagcctggccaatatggtgaaacctcgtctctactaaaaatacaaaaaattagccaggcttggtggcttgtacctgtaatcccagctactcaggaggctgaggcaggagaatagcttaaacctgggaggaagaggttgcagtgagccgagattgctcaattgcaccccagcctgggtgacagagcaaaactccatctcaaaaacaaacaaacgaacaaacctgatattttcaaaattgaggcaattataacagctatttagccaagcattatgatagcaataatagcaagaaaataaattagttaacaaatgagtctcagaagcccaatgatttttattttatttttattttttgaacttttattttagaatcaggggatacatgtgcaggtttgttacccgggtatattgcatgatgctgagttttggagtatgcatgaatccaacctgtcatccaggtagtgagtatagtacccaacagatagtttttttaacatttacttcactcccttccccaatcttgtattcccctgtgtctactgttcccatttttatgactgtgccaacaataattttttttcttttttctttaaatagagatgggggtctctatttaaagagcctcccaaagtgctaggattacaggtgtgatccattgcacctggcccatgccaacaatatttgaaacccttatctgcgtgtacaagtttgctactggttttgttttgctcattaatacatcccaagcatctatacctggcttgtagtaccagcatgtagtaggtgcttaataaatatttattgaataaataaattagtttgacattagtttaacatctcaagtaaaacaaaataccattcaattaattctcttcttctacttttttcttttaagagagacaaatagtcacacatacatcagcaggagaggatacaatttcctgtgtttaagtttttatgagttactttagttcaaatgtcacagaaaattatattgaactcttgaccaatctatctattttttccattggagtattgacccaaataagaaatagcataaaggaaaaattattttttggcagaaaaatattctctctaaattcttgtgtgttttgttttgattttttccttagtgactggaggccagtttcaatccactgaagcacagattccaaattttcaatctggttttcttgagtagtgactgagtgccaaaaatgaagcaatgacacaacatcaccatcaagacactccccagcacgcacacacatgccagagtccaacaccaagatactccccagcacgcacacacacgccagagtccaggccatattcgggtggcttgcaagcttcttccccccaagtatttactctcaaaataatggtttttgttttgttttggtttggtttggtttgtttttttccaaatacatttcttccctatatctttaaccaattctcataaaattttgtctaatacactggtcagtgtattccagaccctaaaagataacataatgaaactatctatgactaaaaggtaatcaggatcttctacttatccttttttcctccctcttaaactttaattttgatacatttgggagtgaaatgatgacaataaatgcaaagtaattattgaagaaacagtaattttgtattagcttactgaaaaaaaaaaaaaagataaccaaatatattttggcagccccaaacgagtcacatgtgaaatgcagtgggagagcagtgtcctgaaggaaaaggtggcctgctggacagccaagagaacaaacatccactgcaagtaatatgagctctaagtttggactaggcctatgtctgctctgagacttggggcaattcacttaatcagagccttaatcagctacggactagcaatatccatacccgctacttattttgtaaatctcctttctaaagttaactctatttattgttccataatcccataaattctagaatcttttcctgttatagccaagttgtctatcattgacagagatattcacctggttgttttggcttctctaatcctcctggtgagaacacctccaagggagctttcagtggcatttaaggtcacttgtgctcttggtcctagaaactgccttgatagtggttttagctcacatgaggtaagtctttattatatgcccaacctctttatgcattacttcatttaattgtatactaatcctttgtcataggttatcagagtgtttgattataagttacaggaagaaaaaaaaaaacaaactccaattgactaaaacaatggggcattttttgactcacataacagagagtctagagagaaggcaccttcaggtttggctgatgaatcctgtatctctgccttgtctccaggcccccaggttctgcctctgtcctgacatccagtgttggattcctcttcacatcaactcctctctgtaggttgggccatcagaccctacctccttatttatgttgagcaaaggagagagaatgcctctacaaacaatgaaaaaagtgaaaaaaaaaatctttctcctccttataactttagttagcttaactttagtcagttgcttagctactaaacagtagctattgggaggtgggaaggaatactattgtgtaatcaactaaggctcatacagaggattagggttatctgaattgatttgaattaattagaatttactctcagagctgtggcaattccttgaaccacactgattgctataaagtggaagaggaatagattgaattttggggagtcaactacaatgtgtactacaggtaaatactatgaatttccaattcacagatgagaaaactgaggcatgtggtgggagggaggttatgtaatttgcccagtgtcacagttgaacctaggcaaaggcctatctccaggtctaaacaattcagtggcctcctgtgtacatttctgtctctccttttttatccactgtgtcaccgaggctggattgcagtggctcgatcatggagatcatggctttctgtagccttgaactcctgggctcaagtgatcctcctgcctcagcttcctgagtggctgggactacaggcttgacaacacacccggctatcccgtgtatatttcttgagggcttatgatatataagagaaactccaaaataagaggacggtgtgctaaggggaagaccaaagcactatcaagaggtagattcaatcgtaccccttctatttactagttgtgtgactcttttgaaaatgagaataataggccaggctcggtggctcctgcctgtaatcccagcactttgggaggctgaggcaggtagatcacctgaggttagaagttcaagaccagcctagccaacatggcaaaaccccatctctattaaaaatacaaaaattagccgggaatggcagcatgtgcctgtagttccggctactcaggaggctgaggcaggagaatcacttgaacccaggaggcagaggttgcagtgagccgagattgcgctactgcacttcagcctgggtgacagcgagactccatctcaaaaaaaaaaaaaaaggaagaaaagaaaagaaaatgggaataataaaacttacttactggagcagtagcaaagattaaaatttagaccatgcagaagaatgtttttcaaaatgacatgacctggtaataggatagaaatgcaaattcctgttactgcaccagacccaccaaataagaaactctggggatgggacccaggactaagtactttaataagcactccaggtgattctaatgattgttaaagtttgagaaccactggtctaacacattgcctggtacataagctcttattttgttgttattgttctaaggacaatgtgtgtattgacttctatttccaggagttcatgacttggagaactagggaaaggaagacaaaaattctttaatgcagaacgatactgattgataaatacctgaatataatacaggttaaatgtgctttgaagatttataaaaggttgaatttatttccagcaagatgactctcagaagcctttatagattagagaagaaatggaaaggggtaaaaataattaggaactataaagcagggcagacaagttttcaatggttactgccaatgtgtatacagaaagttagcttggccaggcaaagtggctcatgcttgtaatatcagcactttgggaggccaaggcgggcaggtcacctgagatcaggagtttgagaccagcctgaccaacatggtgaaactctatctctactaaaaatacacaattagcccagcatggtagagcatgcctgtaatcccagctactcaggaggctgaggcaggagaatcgcttgtacttgggaggcaaaggctgcagtgagctgagatcgtgccattgcactccatcctgggaaacaagggtgaaactccgtctccagaaaaaaaaaagttaccttgaaatatatcaatacaaacaaataaattagatatttcatattgtacaggaacaaaacccatcagaagatgtcagaagataaggatttttgtcctgatgctacacttaccagctgtccctcagtgttctacttcttaaaaaaagagaggttggtcctgatccctggttcttaaccaggggaaaatgaagtggggccagggcatgtgcagacttaaaaattacacaggggaatgtaggcacgatctgtttaagaaatactggactaaatggtctctaatctgtgattgtagattaaagaataatctacaatctacaccgtgttggccaggcacggtggctcacacctgtaattccagcactttgggaggctgaggtgtgtggatcacatgaggtcaggagttcgagaccagcctcaccaatgtggcaaaaccccctctctactaaaaatacggaaaattagctgggtgtggtggtgcatgtctgtagtcccagctactcgggaggctaaggcatgagaattgcttgaacctgggaggtggaggttgcagtgagccaaaatcacgccactgcactccagcctgggtgacagagtgagactctgtctcaaaaaaaaagaaaaaataaataatcaaatgtaaagttagcacataaaggaggcatgtacatattattaaaatctatatgactacctctcctttttcatttttggctcaatatctgtatctgaacacctaattaatgaaaggaaaacatttgtaatatgtagcaactaaaatgtcaccttctctgtggggatcacaaagtccttggcaatcacttccataccagacaagtgagtattgtccttctccttttccagatggataaacagaggcaacccgaggataaaggccttgctcagtgtcacacatttcagtcactaaataagacacaatggatgccagtattctcatcccctcacaaataaagagccttcaagctcttgcagtcaacaagaacttttggaatgatttcactgcctgaaaaggcagatacataggtgacacccacaaataggaagaaaatcaacctgaacctgagtgtgtgggctcactgactctaagcagtagagacagaagaaaaagttttagcaaagaagggttctgaaagaaaataaatatagctcgttatcaagtgctgtttttacacagtaaaacatgggcaaaattactcttctttaagtagtaattcttatctcttgattaagtcacctactcattcatttaataaatacatactgattgttttctatgtgttgagcactcatctctgtattggaaatataataatgaccaaagttgacaatagtaataacaataatagctaatatagcaggcactaataattatttgttgagtaatatgtcaaaattcagtgtgaacagcattctatttggggctgcatccactgactataacacagctaatctatctgaaatgttccagctttgggcctctctaacagaagaagctgttgttgggcctgcctctagttggcgatgcatccaccaatgagaatgaatttatgatcgaccactcttcctgtaaaggccgctggaactgacagcattgtgattttcttttactgttagttttaaattactagaaccaactcaattactagaacgaactttacttctttgtttcctacttatcaaaacagtaaaaacaacaagtaaaagaaatgccatcttaatattgttttgatgacaaaacagtattccttttagttgtgcttcaaatggaataagatgcaaacaggcttggtatggtggctcacccctgtaatcccagccctttgggaggccaaggtggaaggattgcttgaggccatgagtttgagaccagcctgcgcaacatagcaagaccgtgtctctacaaaaaataaaaaattagctgagtgtagtggtgtgtgcttgtggtcccagctacttttgaggctgaggagggagaatctcttgagcccagaaggtcgaagttgcagtgagccgtgatcgtgccattgctctccagcttggacaacaaagcaagaccctatgtcaaaaaataaataaataaaagacataaacatatctgagattaactttcagtggtaaatttgttccatatatgatttttaaggttaaatgctttggaagctttaaaaaccatttcagcccttttaaatgccaacttacactgatgatgctctcagatgttaggaaatcttttgagcagaaaatggaagtgggggtgttgaggcagggaggagagtgatgcaatattccttagtgtcatcctgtgatttcacaatttgtttttcaatctgtttggactttcaaaagggaagactctcatatgtcaacaagcccatgaactgaagcttaaaacactggaaacaacaactgtagagtttcaagtatatgtacatttatgtattcatgttccttgatgggaatgctggctggtgtgaatgttcaatctcctgagaaatgtaaatttttctctgacagatttattagcttgctgtatctgagcacatgagcaaaaacaatgcctaataagaaaactttctctctccttcaaagtcaaacttgggagaaatgaagggaaatcgagttttctttgcttgacagtgttcaacattcttgtagtcagtgtgctcatgaagattgcaaacttttttttttttttagagcagctaggactacaggcgcgcaccaccacacccagctaatttgtgtatttttagtagagatggggttttaactatgttggccaagcttgtctcaaactcctgacctcaagtgatccattcgacagc

SEQ ID NO: 2376 - DNA, 1181 bp, Homo sapiens
gccggctcctcggttcctgcgagctgttgtcatgggggtgggcgggctttcttcacagccccagaacctgggctttggcagaggtccggacactgtttgtcagcggcctccctgtggacattaaacccagagaactctacttgctcttccggccgttcaaggggtatgaagggtccctgatcaagctcactgcaagacagagcctgttggttttgtgatctttgacagccgtgcaggagcagaagcggccaagaatgcgctgaacggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctatgacctgatgggggctgctctgatccctgcatccccagaggcctgggccccctaccctttgtacaccacagagctgaccccagccatctcccatgctgcgttcacctacccaactgccactgccgctgccgccgccctccacgctcaggtaagccctttaaggttggggagggcgaagaacaagggctcttagctggccagactttgcatgtgcctggccacttggccgctgctgtcccagagctgcagcagaactcttgtcttccttgatggtttgaaagcccagaccccagggacctatttgtcctccccttgggtttaggatttgacagggagggagaagataacccacgagttcccatggaggatgccaggcagcccagctgtggttccccagccccaagcacccctgcccaggcaccgactatgttctcccatggtgatgggactatgattccagtcctaacctgggtatggtctctggagtcagaccatctgcctctgccccttcctgtccctttcatcaagctcttacagattgctgtgcctcgattttttttttttagtcatctgaaaaatgggaatgatcagataatctgccttagggttgttgtgaaagttagatgtcaagacgaagtgactactgagtgctaggatgtaacctagagcgccctgagtgttggctctcgcttccatgaaggctggacgctgtccactgtgaacctgtgccgggcaggaaacagggagtgaatgcttctggggag

SEQ ID NO: 2377 - DNA, 30044 bp, Homo sapiens
atttttttgaacgaagcatgagagtgataaaaagtgaatgaaagctcaagctcagatgtaaggcatctggattttaatttcgattctatcatttactagctaggacaacttcataacttccctgagtctcagtgttctcatttgaaaagcactaattacgctaaaagaataaatacaatacctgctttatattaatagaactgttatgaagatgaaaatagaaaatgtatgttaagtcctcagcacggtgccccccaatagagtgagttacttttcatattgtccatcatcactgggaaggaaaaaatgcccgagtgagagctctgtggccccttggtcagtgctggtaccgcctgctcctccctcctcccccatcactgtgaaaaactctgaaacagatgaaatcagtttttggttcctcccttgagcctctgtagccctcccctacttattctatttatctctgttccactgtaagatccctcatttcaacggctcatttctgcggagttgccaagtgtccttcaaggggtaacagcacagttgaggagagatttgcacattaaaatggattcagcacatggggatcctcacaccggaggttcctacctgggtttacttcccaactctctgccctatcacctccttcttcccccacctcaaacagcatcaccctggggcacctctcaacagaggacatgaatgaagacttggtaccagcttggccaaccctagcactttatgaattaccctaaatggatccatgcaggaaagttggccagtggtcttgctcatggatttttttattgcattcttggtcccacgatgccaacacccttggttcccttggttgtgtacagctgccttgattttggaattccccatttttgctttaataagatgtttcttattccactttggacactggtctaggtctacacctctacatagtagaaagagcaaaccctggattcatttaccaggttgaggccttcgatccagaagacacaagccgaaacattcccctcagtgaagaaatgagccttgggaataccaggacgaatatatatagtctacagactctgaaacaaagctgttataaaattattggatacaacttaaagtaagggaatagtctgtttttattagaagatgatccttctgtgtaaaaaaaaaaaatcacccattcattcattaactcattcattcatgttaatatttgcatgaataaatgaatatgcaaacatttaatgggtgtctatgtgttaagagcaatactaggtgcttgaaatgcatacttcttaataacatacttctcatactagttaggaatgtgtttgtctgcaaataacaaaacttaaccatgggcgtgtacatgggaactttttttcttctctaataagtctagaggcaggcaggcagttcagcactggtgcatctgctaccatcaggagcctgggctcttcctatgcttctatttttctaaccagagcttgtttgttggcactgtcctctttttctcacctcatgattgccagatggctgctgcacctcccggatttacctcagagttccatgcaagaaaaagaaagaagcaaccagggagggatacaggatagagcaggcaggcccaatctgtccctttttttatcaggaaaacaaaaactctcttggaagccctacccagaggacttctgctatatctcactggccagaactgtgccctatggccacttttgcttactgatgaccagggattcttaatggagataaggtcagaaacccaaagtatagcacctcacttacatatttagttcatttcaacatttacaaagaactctctatgtgccaggcatcctattagatactttggaaacagagatgagtaggacacattgacctcaggaagcgtaaactgaatggcagacattcatgcgtaggggagaaggaacagcttttcctcacttgtcaaaaggtttacagctgacactcctataacaaagaagagattaacaagaagagtaaattaacaaatttatttaaccaaagttttacatgacgtgggagggcttcagaaatgaagacccaaagacccccagggaaaactgtatttttatgctgaagttcaatgaagaatgggcagtcgtgtagaatcgtaactggacaaaaaggggtatgacataaaggtaataaactggggaaacttagcaaggccctgtttgttcagattcttcttggtctctggttgtagggtctggaatcctctagaatcaggttcttatgacctacttttaggggtggtaggtcagagaattcctttatgatcatgcttcaggggagaaagttgggagaaagagtgggcttcctgcttctgagaaggttttcttcaattgccaagatgtcatattttggggtatcgtgttctgatttctgatacatgcatacactaattataatccaatatgacaattactataacgtttgtataagaaccagtgggggaaaagtggaaagaatttcagttgtgaagacaaacatatatttgtttttaaatctccactttaaatgtatctctccaaattatgcagacagaataaggtcatggcccctttaaaaacacctcctagatcaggtagctaccctttcagaggaaggaaagctgcccaggtaggaaacaactgcagcaggtgttgctcccttcagaaaaaaaaatgtagtgccatcaaaagcattctgagagcagctgcgggggcttgtggcttctgcagtgagttgaggagttgtttggggagggggtactcagagttgcagcagaaattgttaatgaaatatttaacacctgtgctggaactaacagctgtacagaaagtcaacagccagcctgcaggagcggtggacataatctggaagaaaactttctcagattaggaaaaggtaataacagtttaggacataacatattatggcctttgtacttagacgttttattctgggtgcttgggggtactaagtagaagcaaatgacatcgttaggttcgtaaaagtagaagggaggtgggttaatttgctactgaccaacctgtgcttctcaaccttggctgtaaattgaaaccactgggggagctttaaagaacacggatgtctgtgtcccaccctgtgaaagtctgatgtgattggacttggatatggcctgggcattaggactataaagcccccagggaatctaatgtatggccaggggtgagaactgctggtttgccacatcatctcccaaaatttccaagtcccactcctggagttttcgagtctgagtctgcatttctgcattgtctgagaacaattttgcatatttggcaaatatcttaggcaattattctggacgaaaaggctgggaacactggtttgtttatttttgagacagggtcttacctctatcacccaggctagagtacactggtgcaatcacagctcactgcagcctcaactttcctggctcaggtgatccttccacctcagccttccaagtagctgggactacaggtgcccgccatcacacccagctaatttttgtattttttatagatagggtttcgctatgttgcccaggctggtctcaaactcttggggtcaagccatccacctgccttggcctcccaaagtgctaggattacagacatgagccaccacacccagtggaaacaccggtttataagtgttttgcaggctttagaagtgtgttcaggcattagaacatacttaggctgattttaaaaatgcagattcctggacattgcctgagaatgctgagtttgaatacaaacctccccggtgattctgatgtaccatgtacttcaagaaccactggactgaacaaacaaggacagagtttaacaaaacactaaagcacatgcctgaagcgacctaggcttggtttgtgtctgtcatcttaacctggtggggtccacgagtcaccctgctggtggcagcaactagagaatgaataatggatttttaaaaatagctataggatgcattttgaaacctcaacccctttaaaatgacaaatcttacaactcttctccagcttaataaagtgaaactgtatcacagttaatgaaaaacaggtactaatctggaagccacttgtatttgctcccttctttttagtgaaacttaaaaagcatgtgctggtacattgtttggaccaacactgatcaatattggaccggctctgtccaataaagctatactgtgagccagaaatgagtcctgcacatgtaattttaaatgttctagtagccacattgaaagtaaaacaaaataaatgaaattaattttaatagcttatttaactcagtatactcaaaatatttcagcatagtcaacataaaatgattaatgagatattttgccttctttttccatactcggtgtccaaactcagtgtgcattttacacttacagatcatctccgtgcagaccagccacatttcaatgctcatagtcacacgtacgtgagggtagtggctactgcattggccaggcacaggcttagatctagcattggttcccccttcctgggcaccttctgtgttgtggtgggcatgcaggtagagccggggcttggcttggaggtatgcattaataatgggctcagaacatagagaaggatgatctgcatgtgaataattatttttactggcatttcttctttgggtacccacccccccacctcttctccactttctgaaggaggctctttgagaccaccctcctcccattcaactcccacactctctgcttccccctctgcttggaaatggccaccgtgactgcagaagagcctccttggagactcccaggatgttaatcaatctctcagctggaggcaaaatgatctagtacagcaatttctccattaaggggctttcttttggcctttccattgaggaagggcttttgcataaaatgaaatgtgctttgtcttcaccaaggcagacaaaggattaaattaagagagcaataacctagctactacctggacttttgggagcgcagcaggggccatccttctctttctgtctttatcttgctcatagctctaggaagtggcagccagttgtgagttttggttttcctgtgtataaagtggtcatcatatgccagacctggccctatcaagggtcccagctggatgggatctttcaggtccattgggcagtccttgatttctggatgagggagggaactgaggggtcaggtaactccagtgagaacccaggtctcctgacccacctcccttctactctgttctggcaagttctgccactggcttcctaccccttgcttttctgagtgacagcatccctgtccccaccatacacccccacctgccccagtcattcagctcccctggtgtctgcctgccaactcaggagtcaggagtcaccacctgaagtcttagcaaaaggcattcttcattctactccaggttcttgttcaaaggctcataaaaggaaaaagcaaaggtactggacaattcccactccaaatatgtggtcactgctggctgtttgcatgtggggtgggacactctcaaatagatggggatcattgttattaagattagcaaagcctgaatcttgcagcacagaacccaggccaattatggaaaaagaatgacagaatgtgagggcataggatctgcagctttatcggtgaaggattacattaataatagcattttgcatttgtcatcgtgtctcttcttaaaaacattcaagtacttgcctgtaacccacttagctcatcctcagaacaatgaaccacgagcaggagccacgttaaggacttgcagtgggtagttttttaacgatagttttttttcttctaggcactcttcctccttcctcctccacgtcccacctctgagctgagacgagggtggaataggggaaaacaaagagaggaattgaggcttttacaaaatattcagcttccattgaaaaatataggaatgtggcaacatatttgtaacttgccacagtcctgagtgctctggccctctggggtgggtttggggccatgtactcagtggcttgtggagccattgacactccctggatgtgggccgaataagggtctttccttctggaaactcagcctgcggtggcctggtagttgactgctctattctataaaagacaagaagctgaattcttgttgtttgtttctactgaaagcaactgatagctgcaaagtggcacaggttgaatcattggtcggtgactcctactgcagtggggaagcaagcctggaggtggcgttcccctcgtaccccagggagctgacatttctggaaactgggccagctccctctcaccttcctttctccctacaccaaggcacaatcaagggtgaatggggcaggaaggatgggcttcttgtcttccaaactaaagcttttgtgtctgagagcaaacctagctgcaaaggggcggcaaatagagaaacctggggtggtggtaaagaaatattcccagcaggaaaaccagagagcttgtctgacaagcatttgttaactgaattgatctgattactcaggacttttcttagccaggactgggggcagagaggggctgcagttgcttttcattctatttaatttctgttttccaagaatgaatatcaagggagcagctttgattaaacaagcctttaaaaagggggagaaaatgccaggttttacagagagccttgctgagtcgctggcaaatggccacatgacacaatatttttagtctttggatattatctcctctctaagtacaaaactgctattcccattaacacagctcttaggttcagagaaaaaagaaattagcctggtgttaaaaagaaaaaaaaaatcaagattccaggaaatcatcctcttcatagaaattaaaaagaaaattctcatgtgcctagttctacagttctccacatcctttttatctgctgctgtttttcttttttcctttctttcctttctgcataagttgttgagactgtgggcccaactggagaagattttaaagccaagtctagcattattacattcaaatatttttaaaaaatgttttacaggatggttttttgttgttgcttttttgttttaagattctctaaggtgggaatgttggtcttactaagatgggaaatgaacaagaagaaaaccccaatatttaacatcgaacaaatatttattgagcatctattatgtgctagtcactaaggatatagcagtgaataaaatgaagccctttccctcatggatcccttctaatgggacagcagtagttaacatttattgagggcttgccatgtaccaggcattgttctagcactttatatgataacccgtggggcatgccctagtattattactctttgcaggcactcacatggctacaaagtgatgaaccagggttcacatccaggtattctggctccagagtcaccaaacttaatttattaccctaatttgtgactcttgtattccagatgagtctaagagtccttcttctcagttcccgtcatatcctgtatgtatcccctttggagcacctccccaaacctttgttccctcggttgaccataagattttggagtgtagggcctgtctgcattctctgtatcccaaggccttacagtgcttgggaccaaccagaattggagatccagctcctagagcatttcaaaacacatgtggaaggacgccctgattcaggtacatacagtaaatctcctccccaacccatgagtctctaaaaccctgtcattctatcatatgtagcttaaggtgctgatttatggatatgcgaggattctctgcagggaaggctctgctcaaagacagaggactgctctgtgtgtgggcaacttcaggcctaggcaattgctgtcaggccgtgagctggagtgttaatggggggcttgggatttaaaccccacacctgggagtactgccaaggtgcttgcacaatctgtggggctgggagaagggtgctctgtggcatcacccaaatatttccccttaaaaatgagcagaaaacacctaaatgatcagcaagaaagatttagtaaaataaacccctgtggtaggatgctgtgccatcgttaactaaccaggctataaaataagacttaagaataggggtaaatgctcaagatataaacacaatgaacagatattataattttgatgataacatcattgctatttttggagggtatacgtttgcatagaaaagaacagaaggctaatcaccaaaatgagatttaataggtggcatatttcatttcttttttatacttttctgtcttcctcagttttgtataaaatatggtcaatacaactagaaaaacattattaaataataaacaaaaggaaactttaaaaatggcttaaaaacgttatattggcctcaaaggagacctttaatctattttctgtgcacactgtcttcttgtgctgggagctcagcagcgatcataacacagcaaatcgctgggttggaaaccttggcaggtgtttcctttgattctagacttcaggggctgtggctgtggttgcaaaacctccactgatgatctgatccagagatctaaggccttgaggatagaacatccctcatcctagcaggaaataatgaaaccttctaaccttaaagccctttggaagaaatgaatataaacatgtgagtctctagcgttgctgcgatccttcatattttacggcacgcattctcatttaatcctcaataacatgaaggagcaattggtcacatcagccctaagttataggcaagaaaggcacttgtcccagatcttgtggtgaggaccagagcttaagctagacgcagtggctcatgcctgtaatcccagcactcagggaggcagaggcaggtggatcacttgagctcaggagttcaagcccagcctgggcaacatggtgaaaccctgtctctacaaaaaaaaatataaaaaaaattagccaggtgtggtggcacacacctgtagtcccagccactcgtgaggatgagatgcaagtatcacttgagcccgggaggcggaggctgcagtgagccatgatagcaccactgcactgcagcctgggtgacagagccagactctgtctcacaaaaaaaaaaaaaaaaaaaaaaaaaaaagaagaagaagaacttggaccttgaaccaagctcttctgatccaggctcttcccctgttttcttgactccattgtggaagaaacagagcaatcctgatgggctgccatgggtggcacgggcatggtcttcctatgggctcaccctcagcgggctgtacacataaacctgtctcttcctatcagatcaaggagatctgggcagggtgtcatcaagagagctgggctggaagcctatgatgacaaagactctcaactacccaaagatgtaggaaggactttccttatgccacgtgccagggattagatttcaaaacagctcttctgaatccctaaactggcttccaacctggactgtaagccctgttatgtttcattctcagctcacccttgtcccttgttccttcaggcatttcaataactgatgctcatgcattttgcgccctgctatattgtaagttgtttttaagggtagtgaccagatcctactcactttggtatagtcctattacctagtgggtagtagctgtattaaataggtaataggtatagtcctattacctagtgggtagtagctgtattaaataggtatagtagctgtattaaataggtaataggtatagtcctattacctagtgggtagtagctgtattaaatacactgtatttaaatacagtgttggttaaagccaaggcatagaatcaaagccagaagttgtccaggagtgagaacacagtgatagggataagaagattggactcagaagcagagcctgccttgacaggggccttttatatgctttctgtagttagaacaagatccactcaccagcttttcagggtgtggtcaaccagggctcagaccaacagagccagaagtttctgtattcaagagcgattaaattggataactgctctttgaaccgcatcctgatgcatcgagaacgttccatgggctaagaacataaaataggaaatgagcacacacatcttctggggaagggtgggcaggtgggctgatttcatcaatttttttcccttgttttttagtatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacgaagtccctcgctttaccagcccgacacgagtgtacacagtcctggaggaactgagtccaggaaccatcgtggccaatatcacagcggaggatcctgatgatgaaggttttcccagccacctcctctacagcattaccacttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcaggtatgcacactttgaaagttgggctggacattctatctctttggtggccctctgcccttctgcttctctggtatattctcaggagaattataagcatttggagaaacagctcagtagaataaatcgatgtgaactgttcactgttgtccacaggtttccttgttatcgtccttttttcttccctctctttcattttccttcttcattatctcccttgttcactttcttactcttaagaattattttttattttgctcccttctatatctggctcatctctgttggtgaaaaggaccacagggacttgttaggccctccctggactgtgcctgttctttgtttattgccacgggtggcaagatggggctgttagttagcagttataatagacgtttgagacttaggatcagtgaataggaactcccaggaaaacataccaccagccagatgaataaatcaaaccaagtacttaggtaaaaccaaacaaagcatcgaattcaccttacacaacttaattgaatataaacaaaagacatccgaaagggaaaaaatgcagatacaagtgggatacaagtgatcttgtatattttgactcattctttgtcctacaatctatttgctattattttacaataaagtcccttgtgattctgggttaataagctttttgaaaacaatattgtctttctactattttgtcaaaaagccacatgattagtacttgcccatattagcctcgtctctgaggttttgttccagccagtctctggtctcctgagaggctgaagagggctctttgggaggaattggggttgtggggagcaactccacagcagcccttgctaagagacagccctgtatctggagcaaggctgaagatcagggtgagtctcagctccagatgtccccatggggagagtctcctgagtttatctttgagtggttttgtaagttttctccaggcgactctggacatagacccaatacatgcagaggacaaaggaccctagaccaggattgcctaggagaagcaggagaaatagaaattcctttattatactcatgaatgtctccctgttgtcccaaatggcatgcccagtataatgttaaaggatccatgtgacctcgagtctgatatcaaaacggttaaactctgttctggatgcacccctgacttatccctttagatccagtctccaccctgctctgtgctccaagacgctgacctggatggataccgtattagactgttttcatgctgctgataaagatatacctgtgactgggcgatttacaaaagaaagaggtttaattggacttacagttccacatggctggggaagcctcacaatcatggcagaaggcaaggaggagcaagtcacatcttacatggatggcagcaggcaaagagatagagcttgtgtagggaaactcctccttataaagccatcagatctcatgagacttagtcactatcacgagaacaactcaggaaagacttgcccccatgattccatttcctcctaccaggtccctcccacaacatgtaggaattcaaggtgagactttggtggagacacagccaaaccatatcatcctgccccagcccttcccaaatctcacgttctcacatttcaaaaccaatcatgccttcccaacagtcatccaaagtctttactcatttcagcattaactcaaaagtccacagtccaaagtctcatccgagacaaggcaaatcccttctgcctatgagcctgtaaaatcaaaagcaagttagttacttcctagatacaatgggggtataggcattgggtaaatacagctgttccaatgggataaattggccaaaatgcaggtgctacaggccccatgcaagtctgaaatccagcagggtagtcaaatcttaaaactccaaaatgatctcctttgactccatgtctcacatccaggtcacgctcatgcaagaggtgggttcccatgatcttgggcagctccattcctgtggctttgcagggtacagcttccatcctggatgctttcatgggctggcattgagtgcctgtggcttttccaggtgcatggtgctagctgtcagtggatttaccattctggggtctggaggacagtggccctcttctcacagctccactaggcagtgccctactagggacttcgtgtggggactccaatctcacatttcccttctgcactgccctagcagaggttctccatgaggggccacccctgcaacaaacttctgcctgggcatccaggcatttccatacatcctctcaaatctaagcggaggttctcaaacctcaattcttgacttctgtgcagccgcaggctcaacaccacatgaaagctggcaaggcttggggcttccactctctgaagcaatagcccgagctgtaccttggccccttttaatcaaagctagagcggctgggatgcagggcaccaagtccctaggctgcacacaagagagggacccagggcctggcccatgaagccgtttcttcctcctaaacctctgggcctgtgatgggagtggcttccacagaggtctctgacatgccctggtgacatttaccccattgtcttggtgattaacattcagctccttgttacttatgtaaatttctgcagctgtcttgaatttctcctcagaaaatgggattttcctttctatcgcattgtcaggctgcaaaatttccaaacttttaagctctgcttccctcataaaactgaatgcctttaacagcacccaagtcacatcttgaatgctttgctgcttaaaaatttcttctaccagatactctaaatcatctctctcaagttcaaagttctacaagtctctagggcaggggcaaaatgccaccagtctctttgctaaaacataacaagagtcacctttgctccagttcccaacaagttcctcatctccatctgagaccacctcagcctggatttaattgtccatatcatgaacagcattttggtcaaagccattcaacaagtctctagggagttccaaactttcccacattttcctgtcttcttttaagcccaccaaactgttccaacccctgcctgttacccagttccaaagttgcttccacattttcaggtatctacagcagagccccactctattggtaccaatttactggattagtccattttcatactgctaataaagacatacccgagactgggcaatttacaacagaaagaggtttaatgggcttacagttccacgtggctggggaagcctcacaatcatggcagaaggcaaggaggagcaagtcatgtcttacgtggatggcagcaggcaaagagagagcttgtgcagggaaactcccccttataaagccatcagatctcatgggacttagtcactatcacaagaacagcacaggaaagacttgccaccatgattcaatttcctcctactgggtccctctcacaacatgtgggagttcaagatgagatttgggtggggacacagccaaaccatatcagataccaaccaactcccttgccttccagcttctagttggccaatggggagtcctggaaagagaaggagaggagggtcaggctctctctttgtgagctgggtgcatcccttccctgcctgaagatctccattcccaaaagcagctctctgtcgcaggacctgcttcctccactggcttccctgggcctagtggtggtaagggtgcttcactctcacgagccctgagatattgcaccatctgatgagatttccatatactctgtgagcaccttcttcatagtccctttactgacccctcctagaatgatcctaattcaccagctgcttcctgctgacaccccaataacgtcagtcacaatcttaagcatgtagtaggttcctatcccaacctaagccctacaagtccattagatgggtggggacagctgcatgggtagttaggattgtgacttccacacctttacgtgcataaattgagagatgtctgggcccaggggatggagtggagacaatttgcagcatcacacttacactttctttgacattttaaatctgtgctagaactcttgggtggttccagtacatcctgggaagctcctgccctcttctgccctcctgctcttccttgttcctctgccctaagaggtagggggtgaaggttaagaagtgagaatgcctggagagggctgtgctgtctcaaatcttccttgtccattttctctcttcagtgcatatctgttaattgtatatttggcttcctgcagtccagagtcccctggagtatgggaggacagtttgcagactgtgttccatattagctggtgaaactgcaattcgaatatcctagactgtccaggcaagaccaaacagagtcctgcacttgataatcttccctccagattagccctgaaggccaatgtgaaatccgtagctggactaactgcatttattactgaagataatctaaccaaggctcaagttccctctttgggctcttctagcgggaggaactctcagccaccctatgaacgccaagatgtgaggaagggcaacgaaagggacccctcctctgcagttccaggggcggaggtcttcagcctaaagcccagcctcgcgtcccaaggctgcataagggcgggtgcggagagggctgagaagccctgacctgcagcacccgccatcctcccagccttataccttctccagtccaactatgtcaaagccaagcacgcaagcaggtcaaaacagaacaaagtgacaatggcatggttctgccacagtctctgacacttgctcttgaatgtttgttccttccttggaggctgtgggcgcggtctctgctgtggagttcttgagagcaggtggcagagcgggtgaggtcagcgcggctgctggaggcggtgtgctgtgctcccgcagggaggagggcggcgtggaggaggcgggcgccccctgctgcccgcgcgggctcctgcaggctcccagcctttcgtaccgtggcccctgaggctttcccaggctgatgatgaatgagcccagggcccgacggaggcatccgaggcacgtgacaacccccgctctggttgtaaattgtcaggcgattcagtgaaagcgctttgcaagctgtttgtgagcaagaggcggagcagtttggctgattcagaatgggctggacacagtcaactttgcatggggagagaaacatggtctgatggctgggagcgagggcagctcgcttttgaggcagggattgctgaatgaggggagtggctttccaagttaggcgtttaggggaagaataccaactgtcagggacgaatgagagaacaggccaagcagccctggagggccaagtgaggaggcctctgttggagtgcctgaaatgtctggcttcgggaccttggattctttaaatgatgcaatctcctggcttctgcagagttgaaatcaaggcttagatccccaaaccatctgtgagcctggatacttatgcatggaagttaaagtttacagtgactctaacactgcagaggatcaagtctggatacatccactttcctggacaggccttgaaaatgctcggaaccactctttcttcccctgtgcagtggggacaagaatacaaacctctctgagatgaggaaattagagatagtgtttttaaagtgcttggtatgatacagcatgcagttggtgtttaataagtggtgtctcttctaagtccctatgaatgaaaccatgacattgtgcaatcaaggcaggaatgttcagactccaatcctgctgaaatacagaggtgatctttgccaatgaggcatcgtggagactccattacacgctccagcaagcaaacctgttatcctcagtggcccatgaccattcttgctgtcagactttgctccgtatgcactgagcccagagctgattttatctgccatgaaaagaggatgtggaacaaagaagggaacagagtttggttgcagagagaagtgtatgctccaagaaccagatgctaagatgggattaaatgtgcaaggctattattaggggagatgcctgtggcagaaaatggggagagagatggacaaggctgggcaagtcatcagatcatgatgcaaggctgatctgagtgaaggaaagagggagaaaaggtagttggacatattctaggctgccatgcagttaaggagtgttcagctagggcattgggggtcctggagccagtgtcaactgacataggacaggaatgagccttagtatctttgccatgaccagttgttggtacgtggcctcaccacaaacacagtgatggatttcagagcccagcagctgaggccgatggtcagttatgctctcatggttaaaggtcttccaggcacattctcatgacagccacgatatatttttgtaagaaattctaccaaggcaaaatatgattaagataggtagccaaaacaaacaaaaaagaaagaaaagccgcaaattcctccctgcttgctctttatgcatgctcctttgcaatgtgattttgctattagctccatcaagagatgggtctccttgaatctgagcttgaccacgtgaattgctttgaccactggagcattcacaaacatggcacaacggaggcttgaaaaatgcatgtgccttgggacttgccctctcttgttacttttggaaccagagacctccatgcaatgagcctagactagcctcctagaagatgaggacaagaagaagcagaaatcaagcaccttcccaccaccaggcatgtgagtgaggccatcctagactgtccagccccagccaagctgtcagtgaccacagagaccagctaagccaaactaaaaccgaaaggactgtgggaaaacctatagtactgtgagaaaccataaatgcttgttgttttaattcactcagttttgggacagtgtgttatgtagtaaaaactaattgatatcatttatgtccattttatagatggaggaactgaaacctggagacatgagaaagcccctcaatgaatggaagtctcaaggtgttcattggtcttcctcagagcctcctacagcaagctgggcttgatcggaaggctctgagtttgggggtagctttactcatttgtgttatttgcctaaaccctggagtctactgagatcaagacccccgaatttgatcattaataaatctcttttggatgaataatataaaggtgttaggaggcccttctaggccattgaagccactagaacagaagtcaaggaattctcaatcttcaaagcatgggaaatgaggggtacagggattctccctagcccagttagaaactccttcaggcaggacgtaaaatttatatttctcttctattcttcttcactactgtgctagtcttataagtctattgttcattcattcaacaaatacttattgagtgtgccaagaaaaaagcaaagatctttgccctcatagagtttactttctaggagggaaatagaaaataagcagaataaataagagaaatatatggtgtaccagataatgatgtgtgctaggaattaaaaataaagaggggaataggagaggaagtaccgggcagggaacattgccattctagatagggtagcctcactgataaggtgacatttgattagatagatgaaagaaagtgaaagtgggagtcacgtgagtatttgtggggagaggattccacagctagtgcagggaagctgaggccagagcctcatgaagagctcagggagcaccagaaggccagagtggcaggaggagagtgaacaaggagaagagctagtgggagacgagttcagagaggaaaaggagggcacgtcatgaagcgtcctgcagatcaaaggtgggactttgagtgaaatgaggagccatttgggacttaggagcagaggagtgacgtgatctgacaacatgttagcaggatccctctggccgctgtgtttaaaatagcccaaaaggtagcaagggcagaatcagggagaccagttaggaggtgactgcaatgaccatggacttactttgaattgcagttaaagtagaggtgtctagcccagggcccatgtgagaaggaacagtcgattaccatttattgggggaaatactggattgtgtcttttcaccagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtggtcagttaatggtcattgcatcattaaaagggcatcgggaattggtccaacatgcatcatgcttttgctgccccatagagagaaatttccaaggtaaccccctctcagagcgactgtaactgacaggcttaatagtgagtctgtgttccccattcgctctttattttaccctggttccaggaatcatttgttacacatagttgtgcctgggctgctgaggactggattcttccttgcatagcatgcagtttgtgtgcctgcttagcgtgccttcacagacacgtcagtgccctctgtgctcaggcacttttgtttatttgaatgctcattcccggcccatagagctgtgaggtgagagaaagcagggccaggaccttgagtatgtctgggtaaattccacaccgtagaaccactggagaccagaggagagtgagacagtgaggatgtgtaggaagccccctccctggcaacttcaagggacaaaagctgcattggaagaaggatgggcatgaaaagtgggtcccaatgatttgagttagacctttccttacagagctactgctggaaggtggtggggaaggagaagagaaaaatgaaagggctgggaaagcagcagcctcagggagggaagccagcaacccgctacccttcccctcacccagctttcttctccacctcccatcccaagcccttcttcaatccccaagaacatctcacccagtttattcatagtaccatcttaaaaataatttctatttttttctgtttaggaaattaatacatgttctctgtagaaaatatagaaagcacagaaaagcatcaccattcactgataaccagtgttagtagtttggtacatgtccttcttttcttttttctatagatatattttatgtgtattttatacatatatgcataggtattttttatttttattatttttttaagagaccatgtctcgctctgtcacccaggctggagtgcagtggttcaatcatagctcaccacagccttgaactcctaggcccaagtgatcctcacatttcagcctccctagcagctgggactacaggagtgcgccactgtgcctggcttattttttagctttttctagagcttttctcaagctcctggtctcaggcaatcctcccacctccacctccccaagtgctgggattataggcatgagctactgtgcctagcctgcatatgaattttagatacagtagtgctcccttatccaccggggatatgttccaagacccctagtgaatgctcgaaaccacagatagtaccagaccctacatatgttatgttttttccttctatacatagatacctatggtaagtttaatttataaattaggtacggtaagtattgacaataatagtgaataataaaatagaaaaagtataacaaaatactataacaaaagttatgtgacactgggcatggtggtgcacacccatagtcccaactacttgaggctgagatgggaggatcatttgaggccacgagtttgaggctgcagtgagctatgattacacctgtgaatagccactgcacaccagcctgggcaacaaaggggacccctatctctaaaaaacaataaagaaaaccagttatgtgaatatggcttctctctctcaaaatatattatagtactgtactcactattttcagactgtggttgactccaagtaactgaaactgtcaaaagcaaaaccacagataataaggggggactactataatgaaacagccctgcatataagattcaattttgtgcttttcttcaacgaatctgaagttgtgatcctgtgctgttgagcaatagtgcttaatgaacatctttgtacatagattctgtctcctggtaaattatttccataagttcactagcagtgagcaaaggtatggtcataactttttaaagctcctaatttttatgggcaaagtgtttgccaaaagcgttttgccaatttatatatccactagcagtatatgaaaatgtctctcgcagcccaataaataggattgtttaatctgtataatctactatctctgttttaatctagctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccaggcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgtaagttgccagtgggctgggccctcttccccacctcctttaggacactgtttctggtgacatcaggagaaggaaaaatggagaatcaggatttctctacaaggcaggttgcctggagtgaaggcaggaaaaggagatacgggggaaggaatcccagctcccctcggtcctggtgcactttctttgtcacctgctaggccaggaaaccatccttttggctttccctggcaacctactctgtccttgaggctcttaataagactggggcatcaaccttctgatgaccttgccctggataaaatcttcagcaaagccctgttgtaaatagcgatagaatatgccgtgctcttatttgtagaatatttaaaggatagtatggaattaaggcaagcacacaaaaccaataagggaattaagcttttgtctccagtgactcagccgggtttttgtgtgaccaaataattcttggtgttttgcttgtggtctcagtctctcactcttaagggttgtaaacgcaggcctgttttctctttttccagttttcagctgcccactaatatgcctcttattgtgccaatctgtgatgtgtcttttactggctaaagtgaggtagtagagtgacgtgaagagagcaccaaagaatcacaaacttctcccagagccaagctccttgattctcagtagctcttacaacttacagcttagatggttctgagcctgagttttggagttagatgggcctgagctcaagtcttagctctaccattttcttggaatatggctttgagcaagtgaccacctctgtgaacttgaattttcttatttgtaaaattaatcaactaaatgaacaaatgtaaacaaggcacttaactgtattcctgatatagagtaaatgcttagtacactacccagccagtttttacaaatcttgtttcattattcttcacagatgagtcccaatgagttcaggattctagattccaagtttagctctatgcccaagtatcttgaggtgttggaacctctgagttctaggatctctcaatggcaaaaagagggggtgataagacatgtgtgccttttacgggtattttaaatattaaatattaactgtcaaataagaaaatctatggatgaaagactgtataaaagtacaaggcattagaataaagatgtgcgttgcattttgccatatttattgcggaagtttgttgctattggcaaccttgacttcaaggtaagaaatcctcgagcatctgctgaaattaaaaaaggcatttttgtttgaactctattcacaaattgatttttttaaaaaaaaacagctctaaaagagtaattgcttgtaaggatggtggtgtactgtactgggatttggatagaagttcttgaagaaacaaatccaatagacactgcaactctcatgtaatttatggctaaacgttaaatatgcaccttgaacctggttcttttaacttatgttgtaaatattaattgttttcaacatggttgacttaaaaaagaaaaactagctagaaaaccagactcagactcaacctctctggaaattagttataccatatgacagccaactttgtcaaatagcaaagaagaaaattagggttacagagctatagaatccaaggtgatcatgggaaatctcgtagggtctgagtccagctcttcatgtgacaggaaaccaaaatgtaactgccagctctcaaacctccctgttgtgagccaagccttctgctctgctggctcttggggagaaagggatagggcaagaagactcgctggacagtctgactagggcaggcatgtcctcaccaggttttctcatcagaaacaatgtattccctgaagtttataaggtgatacttttcaactcatcaaattcccagaacctccctagtccaaagccaatagtgatgaagctgctttgttcgaagcaggcgtggtgatctagttttctttctggcccctatccctggcacctctttcagtcaacccctgtatctcaaagggcatagttgcccaaagaaccccatggtgtcatgtgtgtgccagtgcagcatactttcaagtgaattaatagccattctttttccccccataggacaaagaaaggaggtatgtacagtacctgtttcccttgtctgttgttttttgcttgctctgttgtgctacgtaaaaaggttcctactcggcaaagaatcaggccgcgatcacatcttggagcattttcagctgcatcttctgtggctggaaggaagcggaggtcggttgcagctggagaatgggaagggtggggggacagtgccttggcctgcctggatatctcaatttggtcctgcctatgccctacctagagccctcgccaatcagctcagctgaacacctaggtctgtcccttgctgcatggcacaggaagaaagaactctccgtgtgttaaatgtagacaggacctgcttactgcagcccatggagggtgtcctgaggacagctaatgctttgtgctggacacaggcctcttttgaaagaacagataaggctgggcgcagtgactcacgcctgtaatcccagcactttgagaggacgaggtgggtggatcacaaggtcaggagtttgagaccagcctggccagcatggtgaaacccccgtctctactaaaaatacaaaaaattagccgggcatggtggcacgcacctgtagtcccagctactcgggaggctgaggcaggagaattgcttgaacccagcaggtggaggttgctgtcagccaagatcacgccactgcactccagactgggcgacatagtgagactctgtctcaaaaaaaaaaaaaagaacagataatatttgattcccagattctaatggatttgatcatttccacaaattatttaggttagactagtgagaagggggagatgagggtggtgagatgggctgagagctgactgacttcagagaagtgggtaaattgggaaggtccatctgagcagctccaggtctgaggaggtgtcctggcttggcctcaagtagactccagagtgtgggggagacaggacaaagaattggacagtgttttaattaaaaaaaaaaaaagtttgctttaatcactccatctacaggcatgtgtctgacatgcttaaggcatgtctcaacagggttagaaatttgattatagtggttattgatcatattgacagagatgattttaataaatgagattttcacaaactgtctctaatcccactttttaaaaaggggatgggggctgggcatggtggctcacacttataatcccagcactctgggaggccaaggctagaggatcacttgagcccagaagttcgagaccagcttgggcaagatagtgaaaccctgtctgtagaaaaaaaatttttaaattagctgggtgtggtagtgtacgcctgtagtcttagctactggggagatagctgagaggatcacttgagctcaagaggtcaaggctgcagcgagttgtgaccgcactctagcctggacgacaagagtgagaccctgtcttaaaataaaataaaataaaataaaataaaataaaataaaataaaataaaataaaataaaataaaagggcttgggaattaatgcacaaaacccacaccttatgaacagaggtatccaatcccatctttctttcttatcttaaaagccatgtaaaagccagttttctaggtccactgataataagctagaaaaagaataaaaaacaactaaattgttcgtatgttattgtgtgtgtgtgtatacatatgtgtacgtatttttttctgagaagatggaaagttgtcaagaaacatatctatagacagaacaattctttgctgtgtctgcaagactgagatcgaagcctatttaggggaaataccgttgtggaggtggaattttaaggtcaatttaccacccaagaagcttaacttctgcctgttctgttctctgcagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacactatgaactttcttgtacatgtcttttggtgaacataaacactcacttttttgctcatatatctaagagtgggattgctggagcaattgctggatctgccaaagagttccaaagtggtggctctgattcacattccagcagcaaacactgagagttgcaattgctctctatccttgccaacacttgggattgtcaatccttttaactttagccattctggttaaaattactattgaagtgaaatcactttttcctcaaagctgaaacaccatcagccttacaacctacctgccttgctccttcccacttcctatgattggaaggaactgcaggactctgagtggggacatactggaagccccatctagacataaaactcagacttccacctgtaggcatgagcaatgaactgggaataaatggtattatgatggaataggaaatgtaactttccaatgtgtgcctagcagagcctgagcaagcttcactcgagctctatgccctgctgcccagctgctgcgaccctagtccagtaaccctaagaaaggtccaggtgagtgttcattagggaagcactcccttcccaactggggagtcaggtgagagcctaccaggtccacaaggtcctgtgggagacagactggatccagcaaatgtagagcttcagagagagcagcagcttgtttactgtgtgcctagtgccagtgtcacttctcaagcaaaagaagcatttgcaaaatgcctgtcctggcctagattgagcgtgatttattaataagggttggttgccagggaactcccttgaatggatttaaactttgcaaaagaaggcagaactgttcatttatgcaggttaaagtgagtgaagtggctgattgcccatttaaggcattgcaaatctgtggggcccggagtcaaatgctttccttggaagctctcagcttcaatgcaagtaaaatgaggttctgagaaggctgaagggggacttaataactgcttataagcccattaagaatgattaaaagggccgggtgaggtggctcatgcctgtaatcccagcactctgggaggctgaggcaggtggatcacctgaggtcaggagtttgagaccagcctggccaacatggtgaaaccctgtctctactaaaaaatagaaaaattagctggacgtgttagcaggcacctgtaatcccagctactcaggaggctgaggcaagagaatcgcttgaacccaggaggcagaagttgcagtgggctgagattgcgccactgcactccagcctgggtgacaagggcaaaactctgtgtcaagaaaaaaaaaaaaaaaagaataattaaaaggagagagtggtgagcagctggtctttcttctccagtgatgacagggcaagagggaattgtgcttaatggccagagaagagatttaagtcaggcaccaagagggacttcctgaagcctggggcctctctgaagagctcagtgtcttctctggtgataggcaggaagagctgagtgtcttcctagtcgcaaggcaagcctcgagaaactcaagaaataggggcaagagtgcgccaggaggagagaacacctgctgccccgtttcttttgtatatccggctatttggttcggggaaatccagaagtcaaagtgtcaccggtggagggtcttgactgcaagttgtccaagttcttggagttttgaacaaagaatggaacaaaatgcccagcaaagcagagaaagaatgaggcaacgaaagaatgaaagcagggatttattgaaaaccaaagtacactccacagtgtgggaacgggcctgagcaagtgactcaagggcccagatacagtcttctcagtccaaataccccttggaggtttccccttggccacttcatgctcacctcatggaaatgaagtagtggaccacaattggtctgattggttgcaggaagcaaccaatcagagactgaagtggagttacaaaggtcacgctcctgtgcaaacatctgattggttgcaaaaagcaaccaatcagaggctaaggtgaagttacaacgttgcaacgaagactcggctggcaatcagtctgattggttacagacagccaatttcccagcgttgaccaggttttggggggaacaaaattatctgaataaaatgaagacagcaaccgtcgtggatttggtgaaagttttctcccatctccctctcaaggccttaaacaggtatgagttgattatagccaatgtttacttttctcattctgattcattataaaactggggtaaatacgttcaggaattagaccacgtaacaattataattgtcgaagactttgaaactgcatagtagattgtgacattggagctttttgttgtgctcattagaaagcagggtctgaaactcagcctgtgtagcaagcacgggtggctcacaagcagaactgggaaatgacacttctgctccccagagccccctttcacatctggggttctcattgtttgcctttttacttaatgtattttgtaatggctgtgaaaattaagctacaaaatgagtgaacattgaagacaatgattgctattgaaacttaggatttctcatttcaaacttagcgtgtgtttatccttcgtattcattcaataaatatctgtggagcaactaccatgtgccaagcgttgactcattaggaaacacagcagctcccatccctgcccttgagcagcctccattctgtttctacagctgaatgtggcctgctgataagctattcc

SEQ ID NO: 2378 - DNA, 3736 bp, Homo sapiens
cttttgtaaacaattctaaactaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtaaggctaatgaatcagggacaagatcctgggtgtgaggtctgggttaaattaattaaaaaacaacaagttaaatcagccacaaggttccagctacttgataagagaaatggtaaaaatgtaagatatattaaatctatatagagttgctattgtttaaataatacataatatatttgacacagtcatatagtgtgtgaaaacttttaacactgtagtcaacggggctcctcgggatactcctcaaaaaagccatattaggagattaaacctgcatctttaaaataaacacctttgttggagtgagccacctttatcttgagtcaacatatttcaaaatgacttgaagtattcagataaatgaaatttattttctgctccattctctgtctctttctttctcccttcctcttccctgcgtccccctcattctttctcccccgaccactttccttttttcctgaagtactctgaaaaatgtagcacatttgcatcaatttacttttactgacatttactttttagatcttaacccagcattaatcagtaaagagtgaagcaatatgcaaataataaatggtaggactatgaccaattaggtggcaaaaagggatccaaagtaaccaacaaggattttctaatgaagattaatattttttctaagaaggaaatcactcaggatttagtcaaatttccagctacaatatttggatgaaacgattgatattgcagggtgccttatgactttttgtatgtagactgttatacatctctctaatcttttcagggtttttaaatgtttttgcaaagtttgtttcccatttccttttaaatcaactgcttctgttatctgaagatgtatggcaagaccagatgtttcaaatatcctgagttttattcctattttcctattggctgtagaatagttattttgtgacaaaagctaacacagaaacatttaaaggatgttttttgcatgtatgaaattcagatctcattagtattaatttctcctggaagtttaaaaactctatattgtgatgctggatgtggggagaattttattaactagaatggactgcgaaaagccctggtctggagttgtcatggaagggagggtgtgaagagatggtggtccattttaccattactgtataccacttaatttatgtgattagatgcaactcatctgtgttttacatcagttcacatacaatgtggagcatcttgaaggagctataccttatttccacaatgcatggtagtgaaacgtgggctattccctcactgaacagagtgatgaaaggcttgactgaaggaagatgtgaagtggtgactgagtatgagggtgggggaggagaattacttccactgggagccattcttgttcccagacaggtgacaaaatgctatctcttttctctgtttcctgaagtttaagatcaaaaataagaggaccagacaacaaggatttggagcagttttaaaggcccagtttagaagtttcaaaccacatggggatgcagatattcagacacactttctccttcccttgcactcatacaacaagcaaaagtgccacctgttatgacagaaatattgcctcaaaatggcctttggtacacagtgggaactctggggaggaaattgtagggaactttgtaatgtgatgcttttggcaagtgaccaatacttagtacattgtgcactggatccgattacggagactgaagtgagagggtacttgggttagtgatagaggagagtggccagattggcaggaaaaaggttcgaaatggctcagaggacagacgtcactgatggagagtaactggaagacagacaccaggatgggtcaattagaacttcctcaggagcctggcatccagtgttccagcattatcaatacttagttgtgtccagatgatgattcagaatgttataagtcttccatgacaactgtgaacttctgctttcatcaggtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaacacacatctaggtattttgcccaatttgcagatgaggcaaaaatttggagatgaatttcaaagaagtcgaacagctagatgagtgcagagatggagatttaatcaaagggagtctgctgtaaaactcctccacatgtgcaaattggccaatatgaaagcaatgaatatttgaaaattgaagttttctgctacttcaccaattttctcaagggctttgattcagttttctatatcagaaggtaaaaggcgagaggcttccatggctgcctgtcaacagggtttgtggagagaaggggctgggaacctgggcaagcagcactttcagcaataaacagtatcctcaggggcccacagagggaagatggtttcagtgccaaaggcttgagtccccttaattttttcattccacttcactcatcacctgtctcctttctatgctagcaaaagaacaattattcatagatggtaaaattatttatagagccgatgtaattaaaaagaaaaaaaaagaaaagaaacacctgatgcaaaattcttccattgcaaggtgagaagatgaaaatccaagtagctaagtggctttctcaagctcacaaatctataattcagtctcttacatctatcagaaacatgttccgccttatcctggtctctgaaaacaaaacatagtgtctccaaagcattaaatggtttttgatgtttgatataaaaaaggacatgtcccagaaattattcccctgcataaaactttagaaaatgatgcttgaaggtcactagaagttgattacttaatgacagccagtaaggtacaaacatacacagagccaaattctgggagatgaaaaatggaaaaaaaaaatacagattcaaccagtgcttcttgtcaacacactactctgagatttttcttattttaatcttatggtctagagtagtatta

SEQ ID NO: 2379 - DNA, 2409 bp, Homo sapiens
aaggcctggtttcatgctgacttcatttctggttggatggcctccagggtaaggtgagttgaactctacgtcaggagtaatccagcccctccagggccagcaggagtaaggtgcgcccctccaaggatctccatgagctgcctctgtgagcctgacctcctacgggctagccagccttcacccaatcactcactggtccagcttcagggtccctacatggatgtgggttggaagacaggacaggcacacaaccatagatactgatggacatgggccatttacagaactgagggcaagagagcaattttggccactgaggcaagttcctgggttagctgcaccgaggagggtgctgacctctgcccctcgggtccacaggtctgggcccctgctgctgacatcccccacatgtcagtctgcctgctagtgggattgactaactcatcaacgtggagtttaatgcccaaccaagtgcagaccacgctcctgttttgcgtcaccctctgcgaagcttcctgcaaacttgactccctgcccagtgcccccagccccaaggtgggacatatcccctgggcaccccctctggtcctgctaaagcccagcccctctgcaggtcacaacccctcctctgtcctaccccttctgctgcctgcaatttcctgaactccttggtaggcagtctcctcaccctgtcctcccagtgtctccccaccctgtcttccctgcttgctctgagggtccctaggagggaggtattaacaccctggaggcagtacacaggtggggcgccctcccctgacacacaggttcttctggactgggtcctgaggctggtggtgcatagggggtcacgactgcccttcccccaggtctgagggttctgcccctctgcctcagctgctgcccacttttttgccttcccatgaagcccagctggccacacctggggatgagtgtttaccggtagcctgaggacgcacagtggaaacctggcaacctggggcctccctgtgtctggcagcctggcaactgtcacgcggcgcccagcgctggcttctggggcactgcagtccagggagggtgtggctatcttcccacagggctcttctcttccctcaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaaagcctcttagtcattcctggagcacacagggcctttgcgtggagccaccgtctctgtcacggtctctcttcctcacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacagattctttcattcctgaagttccgcacaaggaggaaccctgtcccagtgcttccatctttgaaagtttgcaggtaggagacaggatgaccagagagttgccactgagctgcagagctccccagggacagccacctggtgctgacatggacgggcaggtgtgaacaccgaagggcccagcgcagctactggcagtaacactcacttctctcagaaccatcttttcgtgcctcttgaaggtgattccagagactctgtgctctcgttaaaagctcaaaccaaagctcagactccatttcctcttttcaaggtgactttccagcatggcatttctttctttctattaaaaatgtttttttttgagacagagttttgctcttgtcgcccaggctggagtgcaatggagcgatctcggctcactgcaagctccgcctcccaggatggtcttgatttcctgacctcgtgatccacctgcctcggcctcccaaagtgctg

SEQ ID NO: 2380 - DNA, 4897 bp, Homo sapiens
ttataagataatcttaagggattgtatgtcatgtctaaaaacagtagaaaattatacaaaaagtcatctaaatcaataatgtacacagtatttacttactgtataagtttcctattgctgttataacaaaattaccagaaactcagcagcctaaaacaacacaaagtcactgccctgcagttttggagtcaaaacttggctccaaatgggtctcacttggctaaaatcaaattagcagcaagattgcattgcttttggaggccttagagcggaacctgtgttctcacctttttcatcttttagaggctgttttctgcattccttggctcatggccccttccatcttcaaagccagcaatgacaagttgagtctttctcaggtcgcactactgactcttctgcctccctcttccatatctgagacacaaccggataatttaggataacctccttattttaagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccggacacagtaattttagcagaatgctaataggacaaaactgaaaattacagatgacgggagaccacttactatgaaaagcagctactataaaaggtaagctctatgaagtgagtaattttttcactggtgtgaacaaacagtgactggcatacaatttgccctcgatacatatttgttgaattcatgagggagaaaggatgggaaaggcactagagcagagccctgaggaataaggagacagcttggaagtactgggatatggaaatagagggtactcaagaggcacagcaaagggagatgaaggaatgtttcagaaaaaaagaacaacttattttcataagttcgcctttactaataatccaaaagaattactatactgtgtggtagtcagtctccaccgtggcccccaataacctcacttctgaaaattgatgtactcctgtggcccgctgccactttgaatagggctagtctgtgtaaacaatagtatattccagaaatgatgatacgtctcttctgaggccaggtcataaaaggcattttggtttcggccttgctctctgctggataattcactcgagtggaagcactccagtgtcactgatgcaggacagacgagccccaaagtgggaccaagcctgccagaattcttggctccacccaggaaagaattcaagggcaagctgatggtggttagaagaaaacagctttattgaagcagcaattatagctccatgactgttcctgcagagcaggagcagcaggcagagagcagcagctcagggcagttctgcaattgtgttta

SEQ ID NO: 2381 - DNA, 12645 bp, Homo sapiens
ttctcactctgccacccaggctggagtgcaatggcacaatcacagctcactacatcctcaacttcccaggctaaggcaattctcccatgtcagactcctgagtaactaggactacaggcatgcaccatggcacccaactaatttttgtattttttgtaaagatgaagcctattccatatttcagagaatcatttaccagccattgtctgctctgtaggtccaacaaactttgtctcaggccattgtatgttccccaagtccattcattttcccctaaaaaacatttactatctttcgaactgccacttttcctgcatctcccttcccctatgaagaagggtatataaacatctgtacccaggggttattgggtaattattctcatagagtttccatgtgctatgcatattaaaataaattgtgtatgcttttctcctgttaacctgctttttgatggttgatttttagagaaccttcagatttaaagggaaaatttcttcttgcccctatgttataaaccataaagacaacaattcctgcctttataggctatataatttatgcatatttaaaaaattcacgaaaaaattacctactctctgtgaacataaataaatgtattaaaaaatttgaaatgacaggacttctataaagcaacttatggcttttgatatgtccacagagtattatttctatcaaataaaataaatattataaaatgattaaaaatttaaatcatttctgtatgtttatttaccataacactgtggtttttctgtttctttgaaatcttccagaaaagaaaacatgctgtgaagtgtaataggggatttttaagataaatttagccatttattacatattcttttaaattttaacagtctttcttttaggtctatgatctaaaacaaaataaagatgctatattttgaccacaatgacagatatttaatagctatcctcaaacactgttttgcagatgaaaataatgagtatttaggataataatattttcttattcatggactggttttcaaattcatgagggcaagattttgtctttcatgtttactaatgcacccctgatgcctagattactgtctatcacatattagacactcaatacatacttgtcaactacatgaatgaacgcatcttgggtatgaatgaaaatgttggaagtagcaacggagaactagtatgcaaatatgagagccccttcctattacctcttttattttttctgttgttatgaaaatacatatgacatgtgccacagaaaaaaatggtatttgtccaactactatttttctttttttctggaacataaagaaatattacattgcctcccttgttgctagtttggaaccatgtaattgagttcttgccaatgggaatgtgggaggtagtgaagtgatgtgctacttctagtttgaggcaagtaagaatgctatggtgtctctattttcctctctcttgtctttgaggtagaagaaaagaagtgtgaaattatggatgtataagatggacaagtagaacgcaactcagatcctgactcacttttagaacgatcaccaacaaagagccactcaattagcagactgtaatatgagagataaataaaacttttggaggtaaatccatggatattccaggatttaggtgttgcagaagtggagtcaagtgaagcacttgttcctgaagtgatgtcaaaagagagtgaccagccggataatgtataaagaagatatagtattttataaggccattatggctctagacactgtctttcatttgtgcaggttcaagctcagaggcaccaacaaaacatccatgcacaaacttataatgtaagatattgatttattagcttctaatgaaatatgtttttattaactaagagattgatacataaaacaaatcttgatactttaagcaagaaatttccttgtagtgaatagctttactagaaataaatttattattcaagatagtggtttgtgaacataggattgtaagtgagaagatgtcaattaagttagttgtctctattaattgactgtgctggtgttgcagtagtttttcagaattaacataactaattgaaagcaaaaacatctctccaaacatctctgagaaaatgatacattactgtctaattttccaccttcttttctatgtttcctccagtttatattattatttcagttaggtacaatacaactgattgatgtagaacttcttttgtactgtttataatcttctccttggaacataaactgctattgcttttatcagaagaagccttactcctacaagtaacacacaaaccacacacctaggtaattcttttatgtaaaaagttaatctgatgtattgaatgttctctttaaatttcaattccagacatctattttcctgatatattttaccaattttggggagtgtgctctatactaattgtttttaagtataatgatgatcagcataagagttattattaatatccgctagctgtgagatttgtcttggaaaataatacttctcatttgtagatcagtttttcccagaacacattatgttgcatattagataagaaaacagtgcctctgcagcaaattacaaaagtcagagcaagagagctaggggagttgagaatcagtacctcagaaagaaactttgctagaattgtaccttatttgtttgaagacctatttcttatgttggggatggggatgaggatgggaagcataaatagacaccgcttgacatcagtgtctgtaatctcaaaactgaaaaactaaagtatcagtgaaaaaatttcttcagttattcatggtgttagagtatttgaaaagcaatagaaataaaaatgttaaggtattggttttagatttgttgggaggtgattcttcctgaatagagaggcattgatatcctttgttctgaaccatcttttcgagaatatttgtgtagtacttactatacttttatttaaacattctctccactatgataataaagataatgtctccctcaagagcaaaggttgaaaaccaaaggagaaaaaaagaaatgtttattatgtatccttaaggttctgttttttatttttgtgtttattgttatcaggtttccatgtaacagagtattttcgagtgtgaggcttgacaatggctccatggatttaatgtatgcattctcctctgcctggctatcacacactagagagagggaacacaatgatatgctccctcagttttataagtttctaagcattgccacagcataattataaagtatatgctgatactctttaggggaaccatggtggtgtcatgaccatgtgaactccccatgcaggtattcagttccccttctttcaactcccagctttaacttaccctcctggctttagaaagcagaacttaaaaactgatgagtaggtaatgcaaaattacaatcattacattttagatttgaaagacatcatggagagcttctaatcttatcactccattttataaagagggagtaaattgatcagaattgctaagaagatgctagtcagttgtgaaatctcttctacccagaataggacaggagtctatgatttactctactttcttcctatgtaaaataactttacccagatcatctactttcgtactataatatagactccccaaaggcaataatgacgttttgttcaacatctaccaattccacagctccctggcatgtaactgaattcatagctaatacatttgattttacctacttgagcaaaatctccagggaataatggtgagtacctgagtaatggaggtaaatgtcatgagtaaaagtatagattcactagattcaaatactacattaatgtctactgtgtgacattaagtaaattatttaaattctctaaatcttcagttttattatttttaactttgaaatagtaatagctaaaaagtagatatgaccaacatgaaataattagggtaaaatgctgacttactaccaagtatggagcatagtaaatgctcagtgaattatagttatatttttccataaaaggtacaataacttacgaagttcttaaaaggcattatattttaaatctacttgaacatcttcttcctggattactgagcaaccagacataattcttttttccttttttgagtcagcctcttccgtttagttcttccaaaaacatcttccactcaaggctacctaaaataaacccttctgctggatctactgttaggttactcttcccatctcagttgctgtgttatatttttatacttgagggattatatttcctgcagttgagtctaatttacacccttaggttagatgaatagtttgtaatttgaagtttggaactgataagatggaagcacaactaatatacaatacaaagtaaaaccatttaaatcatcacatgcctcatacaagtatctattgactacttattatacaccaggcatctttctaacagtacagtaattaataagtctccaataatggtttatggtatttaactgcttgaaattattaacatttaaagtaataatcatagctaacatttattagatatttattaggtgccaagctttttccaagtgttttataaactgttaattcatttactccttgcaaaaaacccttgagataaatattattatctcctataaacaaaagtaaaagaagcaaaatgtgtctaagtaatttattgcacgtcaaacagttaggaaatggtaaaactgggccaaaaaactgaaatagtctggctccaaagcccttgctattaatcactatgtagaaagacaatagaggcatacaggcagtaaaatgcaatgaaaaagaaaactcaaagccacaagagatattgtattaaggttaggtttttatttgaagaattttgatctaggttagcttataatatagtactttctcaattatatcagctaattttttatgtgtcaaaatgctctacagagaccccaatggggatggggtgatgttagttttaccatcatcatcacttactattaactttctggctgttaagtttctcagctaaaataaggtgctcacttgtcttgtagataccatgcactatatattttctaagaaattccaaggttttagtaattgtgcttcatgaacatattatgttttatgtgtgtgagtgtgcatgtgtgtgtattcagtgaagttggagactatgttttaatttctgtgttttacatgcttccctaattctttctacctgacagatccataattagtatgtttttaaatgccacctgaataaatctcccaacttgataataatcctgttggttaacagactaaaagaaggaatttaaactcttttagggtgtgacctaagcccattactcataagttgttcgaaatcttttctatttgattctgtgatgctgtgattattcagaatggttaactaatcttggaaattactgaacctgatgataactttaatttcaagactttgaagtactctccttgatgcctcaccgcttttatggttgtcttcaaagttcacactgtctcatttgcagaaatttctatgtagatctattgcaaattgtatataatgtttcttgtgctcatcatatcctcatcaacatattttgaggttattaatagcatgataattttgaagtgttatgtaaaagaagaagccttttatgtaaaggagatcacattaatccaaactgaagtatatgcagtataggcttgagggaaaagaaatttgaatgcaaatcaaattggatttttttctggaaatgttctgtttaagtctgtgaggaagtcactgcagctgtgattaaaacttattttcttatatttgatcagaaataaaagtccctctccttttcaaaaggggtttgttatgaaggaactttacaacacttccaatcccatttagttattcattcaagagccattgcctttcaccagggcaatattagcagaattggaagtgtaacaaatacataaaataatcagtgggtcgaatgagagggagatcacagagacaatgagggaagacagctctttatacaagatttctagtaaagaaaaggaggatccaaatcatgagctgaagaatccctggcagcctcaatgggtgaagagaggttttaatgaagcatcaaagcaagggatggggcatcttttgccttttgaggaaaagggcatttaatattcatgtgtttctcagtgagcaggtctatgcaaacctacctccaaagtcagaggaagctgagaggcctaagaaagaggctgacaaatcccattttttagaatcaaacatttcgcagggatttaggaacagaagccatgtctgtgtctcaagcagtgttgagataagatactggatccccatgccattgtccctcagacctagggcttatataacatagggaagtggtgactcagaaggcatgtgtaggacaactgcagtacaataatatcaaggttaatttgacctaagggcaggatttatggtaagcacctgctcttacataagaaacaatagatgaactgaaaatcgtagcagcttcccagagcaggaattaatcagaagtcaacatgttgaattagcatccacagtggagctgccttggcctgcacatcatctttgcaagagagctattcttgtattgacttcatgatctcttgttttgccttcaagcttccttaaaatccatggtttttgtcatttaaaaaaacaagcagggtaaggagttatggaggaaaggtggagaaatgttattttagatagcagtcagaaaaagcttgtgcgaggggagatacttcagcagtaatcataatgaaatgagggaacaagacatgcagatgactaataagagcactccacctctgggcacagtagctcatgcctgtaataccagcactttgggagggcgaggtgggccaatcacctgaggtcaggagttcgaggccagccctaccaacatgctgaaaccctgtctctactaaaaatacaaaatttagctgagcatggtggcacatgcctgtaatcccaacgtctcgagaggctgaggccagataatctcttgaacctgagagacagaggttgcagtgagacaagatcatggcactgcactccagcctgggcagcacagtgagacttcatctcaaaaaaataataataaagataaataaaaataaaaataaaataagagcactccagattaattccagcaaaggcaatggaattaatgtcagaaagtttatgggaagtttgaaaagcagtaaaaaagttaataaaattcattatggtcaatgaagtagacaatggtaaaatgatgccataaagaacactacggacaagataacagggaaatttaacaccatgttgagaactttggatttcatctgtgtaggatgggatgccatctgagtgcactgaaaggggatgtttcatgataagaaatacattttaaaaggatcattctagccactggacattgaacagatttttagtaggtattgaataattgaggacctgaaagaccctggtaaggagtttgacatttaatataaatgtgactgaaagccatttgagtgatataaataaagtatgaaatgatcaagtgtatgactttcagggatgttttagttgctgtatagataataatttttaggagaaccaggaagataattaggagaccattttagtggtccaagtaaaacaaagtagtgatttggactaaacagttggtaggaaatggtaaaaagtagttggttttggatattgtaaaggttcagataaaggaacttgatgttagattgaatatgtgatttataagaaatgggagatggccgggcacggtggctcatgcctgtaatcccagcactttggaaggccgaggtgggtggatcacctgaggtctggagttcaagaccagcctggccaacatttagaaactctgtctctactaaaaatacaaacattagccaggtgtggtggtgtgtggctgtagtcccagctactcagaaggctgaggcaggagaatcgctttaacctgggagatggtggttgcagtgagccgagatcgcgccactgcactccagcctgggtgacagagagagactccacctcaagaaaaaaataagaaagtggagagtaaaaaacaacttcatgtttggtgcctgagcaaattagaagttacgaattaatttgctgagacagggaagcttggaggagaaatgcttgtacacatggggaatcaagtattctttggacatgctgagtttgagatgcgcttaagctttcaaattggaatgtggatttagaagttggatatatgaatgtggggttcagtagagggtatattctcaggattaaaagtatggagtcatcagaaagaaatagataatgtggtgtgagatttttcagtcctctgcttttcaggtatttgctaagatggcatttcttagctctctgtggttatgtggagccttgaaaatagctatgagaggaagctattttaggctggaccatttaacttcagttcagtatgagaacttcaagatatctttttgttgttgttcctgtggttgtctcctgacagttctccagatggtggctgctccatctgtctgggtcccagattaaggacaacttatagcataactcccagctgactcacaatgatatagcatgagtgagaaatcgaccttgccatcttggtttcctgaaatacgggagttatttgttattgcatcatagcctagcccatcctgaaaaataccagaaataaataacgctgtaggactgagtgagatcacccaaggagtgaatatggaaagaagaaagaagaattccaaggattgagccatggcatactctgacagtcactaatcagaaaatgaagaggatgaagattaggcaaagggacagattatgaatcatttatttattttctaaaacaccattattaccgttattatttattttttgtttcaaaattgataacaatttaataaaagcacttttccccggacagcggaagaaaacacttgtttaaaaaccaagtagaaccaattatagcacgcatttgtctgtataactaaaagagtatttctgtatcaaaataagtcgagtgtaaagcctatttactttcagtttatacagattcctctaaaacaattttgactactgaggctgatgtatccacaagatgaagcctaagtcataaaatctgcttaacttcatcatttcttcaatatatttgaagttgtggtaaaactttatggcaaattttagtatgtagcatagtctagtatatcatagtccagtaacatttaatagcatataccaggtttttgactgaatttcctattttactcattgcagggtcattttgatttccttaatttaattatatatctctgaacttcagttctacataaactgaatcatttggagcaacaggtatttgttgcccaggtgatagcctgaagaaagacaaattggccacacacacacacacacacacacacacacacgccccgtaactatttaaactctataatatacactgagcaatgtgcacacttggttaatataatttcattgtgtgatacatgataggcaaaaatgctggtcccatgtggattcatgacaaaatatagctgcctccgtggccgccttcccttgttaggttctgaaaagctttacaacaaatgtgaaaatgccatatttccatcagtgacaggtatcagcttcatttataaatgtatattttgaaactattttacagctcttcttcctatgcaagaaagtttatttcaaggctgtcataatttgatctttttgaagacaatttaatttacacatatgaatccaaattcctattaagaaattaactgcctgtcataatactaatgaaaataaccctcctaaggtggccactgatgaacacatgaacatctttaacaagggtaagcacacacagacagatggtgacaattgtgtcaagggtgtactccttcccagcaaggtgtaagttttctttggatgttgattttaaaaccaaccccaatttcaaaaacattgaaatatttttaatgaataaaacttttgattgtttgaatattccccatcatctctctcgtctcattgctaaaatggtttctggttttctttggtttccttttctctgaccccacccatatgggataaaccagctattgccagcttaatttggggggttttgtgatgctaagtcataaagagggaagggtcgaagagcaaagtgaaagggtggaaggagaggtgtacaaagcctagggacaagaactggtgtggttggagggggattggtaacagaagagtaatcagcaggtgtgagtaaaaactaggtgagatgaaagaagaatgactaaatgtcaggaattggatctcctttctagacttttagaagtacaagtgaaaaatggagttcattttgacctgtttggacattgtctctttaaagaaaactgaactaggctgtttattttttcaatcatttattcactcaacaattttttattgagctcctactatatgccaagcattttctttggttcaaggaatatggtagtaaacgaaacagcctggttttcaaggagcttatgtgtaggaaagcattaattaaacaaatgaattagtaaagcatatggtagaaagtgatacattggctaaaaaaaaaggcaaatcagaaaagacagatagggagtcttaagaaccttccagggagaaggtacaaggtgaaggtcttgaattagttgaaccctttcctgttccaggatgaacaaaggtctatgtggatgagttaagtgagatgggagggaattcaaaagagagattaaagcagcaacagggtccaggtcttccaggtcctcttgggtcattgagaagggcagcttttgctaagaatgagataagactttggaatgtttggaggtttgcatgtgaaagggtcaaagaaacattgttttatttacatcaagatgctgttcattgttctatgtgaggccaccaacttaaatgttagattccaaaatattttcaaattcagttgtaaattgaagtttgatagatagagccatttcattaaaaaacacagatatgatattgtttctgggaaattaccttcagaaactataaaatgctattaaagcaatagtttaataaaaataaatatctaggacactttgtaaagacaacttggttcttagcaggttcaaagtaaacgatacctattattgctatcatcaaagtttctcttgatgtgagagctgactcatagtactaagatatcaattacacaaaaatataagattaatgatgttttatgtgatgataatttcctttatgaaatactttttcttggtgagctttaaaggaagcatttgcactgttgtaataatatctcccctctatcataaattgttctttagcagacatacagcatgctggagggcaaaaacaagaattaaatggaaactattaagagtaatgtctaggacaaactgaaatagattgcattttccattaaactaggatttgtggtgagagagtaaaacactactcagaatttaatgttggaagttcagaaggataacctaagtctaacccagaaaagaaaaggataggggaaagtttgaaatgttaacaatctgaagggctgtaaatgttattgacaaaaatgtcattcttttcttttttgcttggaaactttggttccgactttccttcttccggctttcactctatgaagcaacagagagaaactcagccttggggaactaagccaaagcaccagcttggcaaaatggctacagataatcagaattaaataagaaagctactgaataatgttctctggaggccaataggtctagtcaatataaggcactgggatattgggcagaagacaaccatgtctttccaactataatatttacagtcgctgcagacttgtaaagaagatgctccaaatatagtacccaagtatgtgcttggtgtcatttcaaggtagataggataggaatggatatctatcttattcaagcaattttccaagaagctaggccaaagttgatagaaagttgttgcagaagaggagaattcttacaacatgtctgtacattactggctcctggtagaaagacgttgcattcagagtcttaaatagatctgaattccagtgaagtcacttattagaagtgtgaccttgtgccaaatctctgcctgctgtatttcatcagttaaagagagcaatacttatataatgggattaaatataataatacagtgtatggtatacagcatgtattcaatgtagtttaagtattgttagtctcggtgagttggcaatcaatgaaaattggatactcagaatatcttaatgttcacaactatcaacctttcatactcaaatcattgaaacattgtattaatgtcaacaataaatctataaatttcactctccccattccaggaaatatacaaattaaaccatcttttaagtaacaattcattttggtggcagcctttttttgggggaggtattaattttctctaccttggag

SEQ ID NO: 2382 - DNA, 2556 bp, Homo sapiens
gagtttgttgcagacataattagttaagatgaggtcatagtggaatagggtgtgtcctacttcggtatgactggtgttcttataaaaaggggaagtttggacatagagacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaagtaaatgacaaatatcctttattctatctcaagccattgcttcttcatcttttttgtgtcatgacaatcacagtgggcggtaatatttgtactgccctctggggaacacagaggagactgctggcacctgaggtgaactatgctgggggcttcagctgccccaggactcctccctaccttgaagcctgaggggatacatatctctctgcacatctctttgtggctcatcaatgggcctcaccatacacgttgaaaagttctagtttaagccatacttacctgttacttggctgaatgcacttctaagtaaaacttggactcaatgctgcttgtcaatggaaagtgatgagatttataagatatcatacattctctagcaacatatgaatatgcaaaaaatactgatcttagcccaaatcacatcatatgattctactgacagaactatttgctatttaactcgtgttctttcttgtcagtaatggggccacttcctgattaactacaggcacatttcatgagatccaaacatagaaatttttctttctttttttttctgagacagagtctcctcagtcgcccaggctggagtgcagtggcacgattttggctgatgcaacctctgcctccggggttcaagtgattctcctgcctcagcttcctgagtagctgggaatacaggcacttgccatcatgcccagccaatttttgtatttttctagagatggggttttcccatgttgactagactggtcttgaactcctgggctcaagtgatcctcctgcctcagccttccaaaatgctgggattacaggcatgagccaccttgcccggcctataggaatgtttcaaacgatgcatttgagagtacattcataatggttgaagaattatagattttagggaaaaaagtttcattttatctagaagttcatcttatgggtcaagttattatgttttttatatggtcttaggtttgggtacacaatgaccttggcaataattgatttttctatgagcctgacattaatgtttctaagcaagtcccttttgtcagctccactggtgcttaccgtagagggttgatgggtgcattaaataaaataatatctgtaaagctcttggctgactacattgcatacagtacacatcaaagacatagttcttaggattattataaacaaaaatgtaaaaagaatgtgcatgaattaatggtagtcataactcattggatacaaaatatcttccatatggatacagtaaaatactacataaatattactataaaagtgctataaaaatatgaagctctcaccactccccagaactcatgtaattattttaacccgaggccagctctcaggtgacccaccttcctgttttggcaaagaagtgccatgctctggttacatctgagagctgtgtattcttaaacaaaaatatccagttccccacttttccagagatcgcactgagagggctttatgtgggagtcccttgtttattaagaactgtttctatgtcacgggaggccaggaaatgaattttaaatctgtcttaaccacagaatgacacacgggacaaatgacaagagcaaactggggagctctgctctctctcacagtgcctgggctgatgagttcaacacatctgtttgcacttgaaaagtcagatgtactaattattgttacaaacacaaataaaagtgatcaatgtacatcttcctgaaattaaaccctttatgaagcaacattgtcacttttggaatgccttcttggttcagtcaagcatgggcatctcaaatgttgcatgtggataattatgaaacattttctgagcacttatgccaaggacaatgagcaatatgatcagggatgtgcagttttcaccctgtagcactcttcctttactgcaggcatcatacacagctccaggcaagtcatttttcctaactctgtctgcctaactcactttgtgtagatttttcattgaataccatttgctttctattgtgactatttatacaaatattatagtctctcaagggcaatgattttccatcttttccatcctttctag

SEQ ID NO: 2383 - DNA, 11964 bp, Homo sapiens
ggaacagctctggtctgcagctcccagcgagatcgatgcagaaggccagtgattctgcatttccaactcaggaaccatgtaagaagtctgactgccctgctggagaaatcaaatggagaggtcaagagacaacatggagagagaacgcacagcccagctgagcccagctttccagttatccccaccaatgcgccacacatatgacggaagtcattttggtccctccaaaacaacctagccagccagctggataccactgagtgacctcagtagatgccacgtgggacaggagaattctctagtgagctttgcccacattccttacccacacagtcatgagtataattaaatgattattgttttaagccccaagttttggggtggtttattacacagcagtatataactggaacattgggcactgaagtagtggaaaccatacatgcacgttatatttccgttaaacttggaaagggaaagatctgatggagtgggaggatcacataagatcaagggagaatttttatgaagatgacagagacttgggagtgtgcatatgctgatggggaagagttaggagaaagagaatgttgaagataggggagagaggagatggctgatgcatgaggtttatgagaaggtaagggaagggatgagatgcaaaattctgctggacagactgatcttgcttacaaggatagtgggatgcttcgccttgtaaaacaggaagtgtctgcccacctcctgttctttaaaaatgtcaagcatatccatgtactagagtcgagagaatatatgaaggttagttggacagtactggatctcctaagaattgtttgactgaagccctttctctggattgctgactcaacccaggctggagttaagtgattggaatccacaccctcggaccagaatccaagttaccttctgctaaagccatacatacacattaaaaccacacttccacagagtcagcttgtctgggctcaatgggctctcaaaataatacagggttccattacctctgacccagaggttctctccaagagaaagagctgttgatgttacaattctgcctgtcactgtccctgttatagcagggagtgcgtactggattagtactccccagaaggatgtatggtcagttggattggtggtggatggcagtttgtaccaaaacgtcacttgaacttcacctttgacagctgcagacttccgcgtgctgataaggaattaaagaaagtggaaatgcaatgcagtccaagataaactactttacaaaactttgtcttatggaaaatcacaaacatacacaaagttagactagtaaaatgaatccccatatacttatcatccagcttcaacaattacagtgtctgctcatcatttgaatggcacacacacacacacacacacacacacacacacatacatttgtgtggatatatatgtgtttgtagttttatatatataaataaaactacatatatatttatatatatagttgattcttatatatataaatgtagttatatatatatacatatataaaaagtttattattattattcacagatttcatatttgcaagttcacttacttcagacttatctataaccccaaatcgatacttgcagtgctttcaatagtcattcatagacctgcacagagtggcaaaacaatttagttgtcaggcactcagtgttcccagctgaggttagaaaaggcaatgttcttgtttctgctctcatactgtaagcaagtgttcttttcgtagtcgatctagtgccatatttttgtggcttttttggtgattttgctgtttaaaatgtcccccaatcatagtgctgaagtactgcctagtgtttctaagagccagaaggcagtgatgtgccctgtagaggaaaatacatgtgttagataggcttccatcaggcatgagttataacgctgtctgctgtgagttcaatgttaataaatcagcaacacagtacatccagaaaaaggaataggaaaggcttgccagtctatatgtgaagacgctctgtatggtgctaaaataacatctttagtgtgtgatgaaggtatggaataaatggaaaagcagcaaaatttgtggattcataactactgattagaaaaagcatagtggacagcatggttgtgaggcttttgaaaaccaaagaaatttatggttatgttaacccaggatcaggaaaatgttaaacccttcttggctaatgttttactataaaatactgcatataatttattattttaagaaatatatattaaagaaggtgtctttagacagaagcatacataaaacaaggttgtgtattgatcattttaaggaatgcaaccagaggctcccaggaatctaaacctgtatttccactaggagcagtggcttggtatttggtaattcattgcttgaggtgactttatagaatataactaccacaaataatgaatcaactatacatacatgggtgtgtgtgtgtgtgtgtgtacgtgtgtgtgtctgtgtctgtttatgtgtgtgtgtgttttggagtactttagtgcaaattgctgacatcttaacattttatctgaaaatgtttcattatgtctctctaacatattggttcttaaagtgtagtgtgaggagtcctggagacacctgagacagaccctttcaggtgactgggaaatcctttttccaactacatatctccatgaggttggatttgtcttcatatactttatccaaaacagcatgttacaacattaaatgcagaagcaaatatgggaatctagctgtcttgtactgaggcagacatttaagagattttcagaaacgtaaaacattcctaaattctttgtttctgaaaatgcaattattttaataaaattttatttacgataatcagtggatttattttaaatacattaatacaaattttaaaatttttcagttttgatttctaatataataaatattgatagatctgtaacctacattagcaaaagctctttagggtctaaaagtactaatattttcaccatctgtatataatttttatttgtaaatatattattaaaataactgtcactttagaaaacataataatgctttttacaaagaagcactgatacacttctttttagcactgtttgtaaaacttgtcaaaaggaggaggaatttttaaactaccccagctgtgcacggaagacagctaacacaggaaaaacaagtctagcaaagaaattcgccaaggctactttctgccaccctggaatcccacactagttttttttttgtttgtttttttgttttttttgagacagagtctagctctatcacccaggctggagtgcagtggcgtgatctcagctcactgcaatctccacctcaccagttcaagccattcttgagcctcagcctcctgagtagctgggattacaggcatgtgccaccatgccaagctaatttttgtatttttagtaaagactcggtttcaccatattggccaggctggtctcgaactcctgacctcaagttatctgcccaccttggcctcctaaagtgctgggattacaggcgtgagccaccacacccagccccacgctagttatttttaaaaattattttaaggtaattatagactcacaaggaagttgcaaaagtacagagtcccatgtacctgaaaccacgcttcctctaacggtggcaccttacgttattatagtacaatatcaaatccaggaaattattacaagattgttaactagaatatagacctaatttccaccattttacatgcatttttatgtgtgtgtgtttttctgtgtggtcttatcccatgtatagatttgtttaacaaccaccacagtcatgatataaaactgttcaataggacctcccttgtgcttccccttcataatcatacccaccctgccccatccttgctccctggcaatgattaatctgttctgtatctctaaaattttctaatttcgagaatgttacataaatagagtcctatacaatgtagtcttttgggattgacgttcttcaccaaatgtaatccttttgagtcatatctgggttgttgtgtgtatcagtaatttgttccaactgagtagtattcccttgggtggatagaccagaatttctttatccaattactagttgaaggacatttgggttgtttcctcgttttgcaattacagataaagttgctgtgaacatcagcatgcaggtttttgtgtgactataagttttcatttctctgggataaatgcccaggaatgcacttgcagggtcatatgataagtacatgtttagtctcataggaaattgccagaatgatttccagagccttaccattttatattcctaacatcattgtatgagagatccattttttctacatccttgtgaacatttggtattactgttttttattttagccattcttataggtgtacaatgatagcttagcttattgtggttttaatttgcatttccttagtgactaatgatgttgaacatgtttttcatgttctttgccatctgcgtattctttttggtgaaattctattcatgttcatgctcattttctaatggaatctattttttactttttttttggagacagggtctcactctgtcacccagattggagtgcagtggcacaatcatgtctcactgaagctttgatgtggactcaagtaatcctcctgcctcagcctcctgagtacccaggaccacagatgtgcaccaccatacctgactaatgttttaattttttttagagatggggtctcactatgttgcccaggcttatctcaaacccctggcctcaagtgatgctctcaccttagcctcccaaagtgctgggaatacaggtgtgagccactgtgccaggccttctaatggaatatttatgtcttttttactgttgaattttgagagtttcttttccttttctatctcctcctaacaagtgcttttgcccagactggagtgcagtgatgtgatcgtagctcactgcagcctcgaactcctgggctaaaacgatcctcccacctcagcctcccaagtagctaagactgcaggcatgtgccaccatacctggctaatttttaatttttttgtatagagactgggtcttgtaatgttacctaggctggtctcaaactcctggcctcaagtgatcctctcgcctcaacctcccaaagtgctgggattacaggcatgagccaccatgctgggccagcttgtgtgtatctatgaaaaatccctctgggattttgatagtaattatgttaaatccatagataactgtggggaaaattgacatctttattatattgagttttgcagtcactgagcactgcgtgtatctccatgttttcagatctttgctagctttctttcatcaagttttacggaaagggatggatgtacttacgaactctcagtggcttcatcctggcagagaacaggaatgctgcttgctctgtgaactctgcagcctcagtgtcctcatttgtggtgacagctccctcttaaggtcattgtaaagatttaaggagatgctgaatgcccaagtcctgcctccagtatatgtgcttttctccttaacttcccactcattaccttttgggccttgagttttcatctgtgaacccacataggataatagtgggactgacttccaaggggttgttgtgaggaatgggtatgagaattcaagtaaagcaccaaagagactgccagacacagtaggggtaccataagcagtagctgttattacgatatgattgtagtgaggtgaaactataatttcttcctttcactgacagaaaactctcaagcagctggtccaaagagcataaacagcacaaggcaagtagcaggatgttgctgaaggtttgggacagtggagagggtttattttagcacagcagacaatatgaaagagagtatcagaaccacgtacctgctatgacccaacttttatagaaaaagaacaagaatagatatgtttgtgtttgtgtaaaagccgaagaacaccccagaccagactgtgggaagctggggaactttcacttctacttattcccctttctgtgtttgaaagttgttttttggcccggcgtggtggctcacacctgtaatcccagcactttgggaggctgaggcgggcagatcacttgaggtcaggagtttgagaccagcctggccaacatggcgaaaccccatgtttctactaaaaatacaaaaattatctgggcatggtggtgtgtgcctgtaatcccagctactaggaaggctgaggcaagagaatcgcttgaaaccaggagatgggggttgcagtgagccaagatcacgccattgcactccagcctgggcgacagtgagactttgtctcaaaaaaaaaaaaaaaaaaaaaaaggaaaaaagttatttctttttagttgagcgtgtgctacactaaacaatgttacaatacatttttaaattgaatgtattttttttttgagacaaggtcttgctttgtcgcccaggctggagtgtagtggcatgatcatagctcactgcagcctcaacttcctgggctcaagtgaccctcctgcctcagctccccaagcagctaggactacaggcatgtgccactacgcctggctaattttttcatttttattttttgtagagatggggtcttgctgtgttgcccaggttggtcttgaactcttggcctcaagcaatcctcctccagagcctcccaaagtgttgggattacaggcatgagccactgtgcctggccagaaattgttttgaaaggctaaccagtaaaacattaaccaatttacaagagaaaaacagccccatcaaaaagtgggcaaaagatacgaacagacacttctcaaaagaagacatttatgcggccaaaaaacatatgaaaaaaatctcatcatcactggtcattagagaaatgcaaatcaaaaccacaatgagataccatctcatgccagttagaatggcaatcattaaaaagtcaggaaacaacacatgctggcgaggctgtggagaaataggaacgcttttacactgttggtgggagtgtaaattagtgcagccattgtggaagacagtgtggcgattcctcaaggatctagaatcagaaataccatttgacctagcaatcccattactgtgtatatacccaaaggattatacatcattctgctataaagacacatgcacatgtatgtttattgcagcactattcacaatagcaaagacttggaactgacccaaatgctcatcagtgatagactggataaagaaaatgtggcacatatacaccatggaatactataaatatataaaaaaagatgagttcatgtcctttgcagggacatggatgaagctggaaaccattgttatcagcaaactaacacaggaacagaaaaccaaacaccacatattctcacttataagtgggaattgaacaatgagaacacatggacacagggaggggaacatcacacaacggggcctgttgaggggtagggggctagaggagggatagcattagcagaaatacctaatgtagatgacaggtcgatggatgcagcaaaccaccatggcacgtgtatacctatgtaacctgcacgttctgcacatgtatcccagaacttaaagtataattttaaaaaaagggaaaaaaagtaaaaaaaaaaaataaacaaatcagcaaactacacagaagaatattagaacaatttctctcaaatttctcttccattgagcttcctgcctgaccctagagctccctcacctctttggcttaccagctcccatccttcaaagtttctgagttattctgtggggaatttgagctactctcttcctttaggtccaggccatctcagctaggtccagagagcctcactcacctccccaactaagcaagcatccctggaggtatgttcttcatgcaagggcagttcctgagagaatttatttggttagctcataaagggattatattgttttcccctgcacatgagagagagtagctgaagtctactgactttaatgaaattctctgtgaagagtctgggagggacggtttaggtaatccatctacaagggtgctcagagagtttggagcgaagcgattggtgtcgttatgatggcattctatggcacagtagttacagtgcaccaggcactcttttaaagacttctcaagtgttcattcatttaattcttaccacaaccctgtgagggacttcctgttattgtctccgttttactggtgaggaagctgaagcagagaagttaactactttgcccaagttcctttcctcctttgaggataaggagccaaaggttcaggaatgcccaaatcacatccctcttcttgtccaaccacccaacctctccacaggcaacctgatcagccacctttatacaaagtacagtattcagattggaataaaaatatatctccttgactccctgctctgagaggtatttcttctcagactcccaaaagctggattgaggaacatggcttagttggtacagtatagcaaaatgtcctgcttgttgaaactgaatttgtgattatcttctttttcctcaagaagtcattgagggctgttgtatccctataaaaggagaatttagagtagccaaataaaagggggctgaagtagtctcattacggaaaaagagagtgtgagcagccttttagtaattgattgcctcaagatgtggtattcagccagggtgaagggaaagtagttggggctgtggatctggaggtttacagaagcctttacccatcctgagactcagttctgctgttggtcttcagagaagtgtctgcacctgctgagaagaaatcacaccactgcactctagcctgggcaacagagcgagactctgtctcaaaaaaaaaacaaaaaaaaaaaacaaaaaaaagaaatcagacatctaaatatgtacaaaaaactaataaacctctggaaaaatggactcagaataaagacatatacaaataaaaaatatttggaatgcgtactaaatgccactgaattgtacactttaaaatggtcaaaatggtgaattttttgtaacttttaccacaatgaaaattttggaacaaaaaggggggatagaactatgggtagaatacagaagaatcaggccagggatgatggttcacacctgtaatcccagcactttgggagactaaggcgggaggatcacttgaggccaggaatttgagaccagcctgggcaacagagtgcgattgccatctctaccaaatatatatgttcatatatatatatatatatatatatatatatatatatatatatatatatatatgaatcataccatttgatgtgatgtctagtaattgctttaaaatacttcatcaaaatgtgggggatgagacaaattatgcaacatattgataattcttgaagctgaatgatgagtacatggggattcatcattcattttctataatttcatgtgggtttggaaagttccattgaaaatgttaaaaacaacccgctcctcctgccaaatcatttgaaaacttaatttggggagtttcttagagctgagttgacctttaaatattattaagtattaaagtctctagtagctcagagttaaagggtattcccagcaagtttaagagatgaggaagggccctgaatgtgagccagagctactaaagtaggatgtgccacaggccacctctctttctgctctggttcctgtgaaacatagtgcttgttccagtaacgtcacctctaggaatgtatcctcaggaaataatcgttcacatgtgcaaacctgtatgtgaataaggatgcttttctcagtgggtttataacagtgaaacaaggaaacaaggtaatgaatggctctaaagaggctggtttaataaatcatggatacaagtaaataattggatttaatgcagttatgaaaaataatctaaacaccttggacctcagttgcctggtttttaaatgaagaaagccaaagaagaattgtattcctcaactagttttaggaggccagcaaacctttgataccaaaatctcacaaagacattatacagaaaggaaaattacaggtgaatctctcttacagacatagatctaaaaatcctaaacaaaatattagcaaattgaatccagcaatatataacaattgtaataaatcaggaccaaatcttgtttatttcaggaatgcctggttggtttattattagaaacccaaataatgtaatttagcattttaactaataaatgagaaaaaagcatatataatagatacagaaaaagcatttcataaaattcagcatccattgattattttaaaaacttatggtaaattaggaatggaaggaaacatttttaaactgataagtggtatttactaaaaacctgcagcaagcatccacttaatgttgaattgctcaaagtggtcccttgagttcaggaataggacaagaatgtctcttctcactagttgtactctaggtcccagtcgatgcagtaaggtaagaaaaagaaatgtatatggattgggaaagaagaaataaaactaccatcattcacagatgacatgcttgtgtatgcagaaaattctaaggaagctacagattaaaattattaagagattagcaaagtcagtgtacaatatcaacatcaaaagaccagttatatttctatataccatcaacaagcccttagaaaatgaaatttaaaccaatatttaatttatagtagtatacacaattaccttgaactaaatgtaataatagacgtacaaaacctcaagcaaaagttatgaagctttgttgacaatgtcaagtgtttgtgaggatgtggagcaacaggaactctcaaacattgatggtggaagtgggaattggtacaactttgatatacagtttggtggtatctagtgaagttgaaaatatacacaatctatgagccagcaattcctctcctacatatataccttgtgtgtgcacatatgtaccaggagacattaaaaacatgttcttagcaacatttttcataattgtccccaactggaaacagtccaaatgtccaccgacagtaaaaggataatttcttgtaaagtcgtagaatggaaagctgtaacacaatactgagaatgatgaactgatgccgcatgcaaccaggttgaatctcagaagcataattgtaagggccatgagctggatatagaaggatatatgcattatagttctatttatataaagctccagaaacagtagtgtttgggcatctatatttgagtggtaaagctataaaggaaagtaagaaagcaacagctaaaactgtcatgagagtgttttgttttgttttggagagaggaaagaggttgtgattgggcaaggacttatgggaatttctggagttctgatctgttctgtttcttgatctttatggtgatttgctttataataatttgttaagctgtaaatttatattttatgcactttcctctgctccccccgccccccgcttaaagagtgttttagaatgtggaaattttaagataagatctatctcagggcttgttgtaagaatgaaatgaagtataaagccatgtagagcttgtagaatatgcctggcactttgtaagaccttaataaatgttaactatctaaacacaatacagatttgctgttattattgcttctcttatttgttgccagccctgccccctttccatgatatttgttgccaatgtttctcagcttactgttggtattttatttctgttaatgctgtcttctgagttatcagtcttttcttttatactttctttcattactcttaaccatagaaagttctctccaacccagaggtttaacatgtattgtgttg

SEQ ID NO: 2384 - DNA, 897 bp, Homo sapiens
aagttttcttctgaatcctactctagattattttcagacatatcatttatcttctgaatcttaaccttatttgacaatgtttttcataagtcatatgtatttttttctgtctctcatcctcaaaccatgtaagatcagaatttccaataaacagagaagactgaccttgtgcgatgtgcgatggtaaatttttcttctcagatgcaggttggactgagacagacatgcacagtttccttttaactttacgattctgttaggatttcatgtagtatattcttctttgctcatgtgccatttttctttgttctcaagggccttgttatcccattatattgaactaatgcagtatatcaagcaaaacatattccaaatgaattggggtatttctttgttcatagatccttcacccaataagacactgtttggaaggacattgttccaaaaatacactgtgctgcttccttcacggttgttgagaatctgcatactcagctgatgaggaaactgagtatgaaaacggctggatgatttgctgaagattactcagctggttgggggagaaaactaatcagtataagtgtgctgtgctagtattgaggctatgcagcgatcagtgagaagcatttgaaggctgcctactttaaaccattctggttccattttatcttcctccttgggtgaggggtatgtgagtatatgtattgtatatgtatattttaacagccataattgagtgtgtcatatatacttttctcctctttaggttttggtagtccattgttattcttaaattaggcatcatttaccatttgcagtcttagttctcctagaatagttctttgtctttccaaaagctaccaatggtggcagataatggctagatttctcttcaat

SEQ ID NO: 2385 - DNA, 2756 bp, Homo sapiens
gtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctaga

SEQ ID NO: 2386 - DNA, 2805 bp, Homo sapiens
gctatattccatttgagaggcctagttggcacccagttgtagatgccaagtgctccggagctcaggggaaaagcctgggctgcagatggactgtcaggagacagcagtctatatatggtatttgaaactgaatgggctttcacttatatggagagagaaaagagaggaggagcttgatctaaatctggaggccttccaacatctagaggtcaggtggaagggcaagagccaacatcggaaattgaagagaagcagccaaggaatgagaaagaggaaaactctgagaaagcagccacacagaagccaagcgaagggaggatttccaaggtcagcagatggagcaaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagttttggaatgcctctcagtacaaaggggaaagttgttcatggtttttctatatgtgaaatgtcaaaaaaaaactgcagaggatgtattacttattatttgtagcatcctcttttaggagatgcagatatattatcaaaataacatcattatgatcatttatagccatgatatgagcataaaattttactgaaattatcattttctctttaagtcctttatgtcaaaaagtaaacctatcagtgaaatacaaaaacaattatagagatggttctgaaagagcaacagaaggctgtgtggattctattggatgctgtcttctcaacggccttgtgatttatgcagtgttgaattagctggcattatttttatgttttagcaggtgaactatggaagctatgtggacattacatgcattaagggttttgttgctttggactggaaaatatataacttatggtacggcacaactgccaaggcctaatcagagtaagatgcctcttggaataaccactttccccagtgcttaatgtctggagcagagagggtctctattctggctaatgtggggaaaacgttaccaacaccctacttcccagatttttttgccatcatttcattttaattgtaaactcagaccccaacccttcacttcaaggctcattttgaatcaattatctccttatccctacaccaagagccacattcgaggtcctcttggaataagtggacaaggcatcatggactgtacttttagccctattttctggccctttattatattctcctcgtttttgtctttttattttgcttcaacatttagtgtattctctcttgttgtgtctctcttatatgccccttaaatcatttctataatggaatggggaaatgaatatagtcccactgtctcctcttaaggttctcctaatcacctttcttggcattcatcttccgctctttagaatccctggagaactctatgcctctctacatacctctctcttacttattgtatttcagaagtcatgttttcctttcctggtaggatagatttgcaagctccttggacataactgttcttggattcttttcgctgcttggtaaatatttgttgtatcaaaaggtcaactaatctcctaaaagaagtcaacaagtcatagagaaatggagaagccggtgatttagaacattgtggtctaaccttcctaatttagtatttcagtttatgctgagaggaagctgatgtgactgtcctactattttttcttaaatttggctttgaagagagatttgaatcttgaaaattcaatacttaatgattttgttcatgagtacttgggtaacattgatttaaacacaggattcaggttttaaataagatgaataaaaattctaatacaacattagttacaaaaatgaacatttatttagaataagaaaagaataacaagtcacatttgtaaaaagctgataatcacc

SEQ ID NO: 2387 - DNA, 5521 bp, Homo sapiens
atcggaactcgcggcggggttgctgggtcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaaatttgaggactacctaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaactacctggcattgccttttgttgagacttaaaccattggatattgagtttacaaagcatttgcatgaaaaagtgaatatcatcccacttattgccaaagcagacacactcatgccagaggaatgccaacagtttaaaaaacagataaagaaatccaagaacataaagttaaaatatatgaatttccagaaacagatgatgaagaagaaaaaaaacttgttaaaaagataaaggaccatttacctcttgctgtggtgggtagtaatactatcattgaagttaatggcaaaagggtcataggaaggcagtatccttggagtgttgctgaagttgaaaatggtgaacattgtgattttacagttttaagaaatatgttgataagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtaatcagtccaatattccatctcttagcagacattgtgttcctttttaaatagtatcttcagtaaaatttatagataatataaccttcttatacatattttttaaaaattaataccctagcataacaaaatggagaaatttctacaagcaagcactgtttacaataaaataatatagacttcaatacataagtgcttggacatagtgtattaggtatgacagcataatagagtacttacaatgaattattaaagttataatgaacaagtgtgagttgggaaaaataaaattataagccattccatacaggtggcataagaacactaaaaatgagagtttggggtggatgtatgcacaaaaactagtgttaggataataataattgaccagacttatttgtgtatgaatgaaaaagagggaaataacctttactgaactaaagacatgcctggataaattacacacagttaaaggagagaaaattagggaatgtgatatttttgctaacaggttgggccttatttataatgtagtgtcaaggaaactcctagcgtcgcaacattgggcagggtaatgacaaaacatcccagcagacatatctactatcttgaaacccttctagatgtcgagttatacatttagtttctattagtcaaaaagaccttggagacatttccttcattaggtggcaagaaagaaaagatggagaaaaggataaacttaatataagaatccacagagcagtagtttgatagatatctgagaatagtaggaaaaaaattgggtaatcccaaaataaatcagtgatttcagtatgaagttttctcaacataaatctgctataattaaaaattacaggccttcaggaagtgtcgagtctgggacgcccagcgcgggcccgagcagggggaagggaagcgcagctcggtccgcgtgggtggaggggacgtgaagccgccctgagatgatggttgaggaagggctctacggctcccaagctaggccaaatgcctccggcggccgcgcccgggcgccccttcccctgtggggcaaccctagcttgggacgcgtgaaccacctccgtagctgccccaccagcacccccagccgtgcgcccctgcaccatgcagctgccctgcgcatggagccgcgagggacagcaggcccagccctcagcaccacctgcctgccaggaggttcgggaaactggcgccgcagcggagagggcatctgtccaacgcctcccccggggctcagctgcgggcccccaggcataggcacccatgacccttctgtgttgtttgtctttgtatagtctgcagatgtggatcctgactcctgagagaagtagctcaccgtgacgaagctgcgtttgcttttatcgatttgcaaatcaaagaagggggacatattgggagaaggccccccaaaatctggccataaactggccacaaaactggccataaaatctctgcagcactgtgacatgctcatgatggccataacgcccacgctggaaggttttgggtttaccggaatgaaggcaaggaacacctggcctgcccagggcagaaaaccacttaaaggcattcttaaaccacaaacagtagcatgagcgatctgtgccttaagggcatgttcctgctgcagataactagccagacccacccctttatttcaggccatcccttcatttcccataagggatacttttagttaattgaatatctatagaaacaatgctaatgactggtttgctgttaataaataagtgggtaaatctctgttcggggctctcagctctgaaggctgtgagacccctgatttcccactttacacctctatatttctgtgtgtgtgtctttaattcctctagcaccactgggttagggtctccccaactgagctggtctcggcacttctctttgccttaaaaacaggtacagcggaccttcctggcatcagaaaaaggcctccagaaaaagagacacaggtactagcaattccaaattatccagagcccttctaagttgtaagatctgaaagaaatgtctgccatctatattctcagccacacttagtttcttaatctgcaagatggaattaataatagtacttactttatgatgctgttgcagaaattcactgagttgctacacgccaaacactgagaacccagctgggcatataataagcattctattgcatggcattattgccatcatttttacttctattactgctactgcttgtaactgcttgtaactgtttgtgcttttttgatatgaaagtccaccatcagggagcactgtagtggaaaaggtattaggccaggcatagcctttagttctctggccttgggtccttcatctgtgatattcagttaacaatacctagccagtaggggtgttaaagattaaataaatgtgagaatgtgcctgttgcttaatcttcctcaaagggttatggactctcagagccagaagaaggtcatctctcctttgctcctcgtatgctgggatctgccacatcaatggcaaccgctgggcctccagaatttgctccagggtgtttggaagtcctgacaccctcctgatcttctctgtaacatgcacactttggcctgtgtcagtttgctggaaccacatcaggccggccctcttcctgggacaaaattctttctttttctttctttctttttctttctctttctttctttttctttctctttctttctcttttcccttccttccttccttccttccttccttccttccttccttcccttttcttttcttttctttctactgtgacatgatcttggctcactgcaatctctctctcctgggttcaagtgattctactgcctcagcctccaaagtagctgggattacaggtttgcaccaccatgcccggctaattttttgtatttttagtagagacagtgtttcaccatgttggccaggctggtctccatcacctgatctcaggtgatccacccacctcagcctcccaaagtgctgggactacaggcatgagccaccacgcctggccgagagacagttaagttatactttaaatgataataggcctcccccaaaactcagctgcttttgtaaagctaatgggaggccatcaggctgggggcaaggaggagagcccggatcctgctaaggtgcagacataaacgagtatcagccattattctggaggttataagatatgcaccttccccaattacccctgcaatcacaccattattgtagattggcccttagagtatcttttcaggttttttggcatgtctgacactcatggctctacttggacccaccaaccctgctcctatggctccacccagaagccattcagcctagaggacagctctgaccccccctgtgatttcatacaatcagcagcaagtaactgttacctcaccatccccaccccttctgccagactgcctttgaaaaacctctaacctgtgagcacgagatgattccagaacaaactctgtctcccatgtggcatgaccagccttgggtctcttaaactttttctccactataatgccatggtctttatgcagcaggcaggaagaattcaggtggttataattccgtatgtgctttttgaacatttttctactgggctattgctctcttcataatgatttttttaacttctctctataaggaactgatttcatctgaaattgaagagacaatcagagaaaaactatagaccactcatgatggttgttatatgtgcttggctgggccatgggtcccagtgtttggtgaaacacagcagcagatgtccctcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatcattgcatcctgagctacagtaacttctgagagaccaaaaaagcaatactgtctcagcaagatattctaagatacaagaaaggctagtaaaatggagagtctatattacattttaaatattatctaaaatgtaattgtgagattcaaaaaggcacaagatgaaaacactgg

SEQ ID NO: 2388 - DNA, 3398 bp, Homo sapiens
attttagagcaaaatgtaattcaaaacattaatctcccacaagttaaatattctcttgctctctgaagtactttctttgcttcactagtttggcttttttttgaagtgcagttttcatatgaacaatttctagtagaccttccagatatacagcatcttgttaaaaattcatgccagccagaatacaagaaggtcagaaaatgcctttgaatttacgccatggtcttttcgataattcattcaggttttaaaagggaaattcctcattaagtaaaggacctaatgcttattaatttatatgcttaaacaagggactccactaattcatttattaaatatcaaagaccatatgttttcacccctgtccttgcttattgattaattgtcttcagccaatagagaggaaagcagggggaaatctagtaaccgaggtaagcttccatctcctttttaaacttaatgaaaaatggcacttctttatatccctacgcaaaatcccaaatgacacattttaaaatgagttttcttgtgtaggtgtggagtttgcaatacttgagagatgcgattcaatcatttagatgcaatggggatgatatgcacaagtggagaaaataaatgctcttttaccattcctccacactttgagacatcgaaagaagaaaggatgacaattagcagcaatgacagtagcagtaacaacagcagcagttactgtttgtggaggattttctatgtgccaggactattttaaacactttacattcattattctatttaattatcacaacactctgatgcagtatgtattatatttaatattctaattttatagatgagaaaatatgaacaaaaaagtagcatgcccggtcacacagctaataagattgaaaatcacaggactttgttttatgaatatatacaagtatcttatctcagtgttcatgcttttttattcattcatttaactaatatataatgaacatctactgagaagtaaaataattttaaatacttaaatgttattattctgtttaaggtcttggcagaactttagtctttcactggcagaaactttggctgaataagtatttattaaagtaacaggaaacacacctcatctaactgagagtaaaaattgtcatggcttttggcatatatttctgttcactgatttattagcctttaaaaacgtgcaaaattaaatatgtgcaactgacaccacagtaaggattatggttaattcattttataatcatatctcagacattttatgagagctagatgatttaaaatctgatgtgggatatagatctttcactcattcaatttgattatggtcaggaggtcctgagccatggaaagaacatttattacctgcttagtttactagggcaatatttatacatagttatctataattcgaagaatactttgaagagaaatgccaaagcttgtttctctttcacagcatgtttacagacttcaaaactaaatggaagtcattgagaacttattttcaacaattttgtatttcattattcaaagaaagaaaaactcgcttaaagtcataattgttaatgctaattttgtgacaaattaatatatttgaatgacttaaatattctcacagctactaaatatagattgttttataagatgtacattttactctttatatacgtgagtacatgactcctagttgaagttcagcagttaagattgaattactaatgatttgaaaattgatgatatatcaaatttcatcataagccagaaaacacagttctaccttcttcaaaatctccatggccatttgaaatagaacatagaaggagattggtaataaatatataagttgtcttatataaatttttcttcaagaaagaacaactgcccatattggaagacgactagaaacctctacttgtcacttcatttctgatgttaaacaaattgcttgtccctctggaccttgtgttaaataaatgttagacctgtcaggaaactaataggaaacttgtccaaatgctcgctgtactgccagcaacaaacctatcctatttcccagaagaagtcactcttcctttggctgaaaacttccagttgtaatagagaccctttccttaaggacagaccattaaagtgaacaatctgaggcttgactcgaggtcagattttagacaataataatttttccaggttcagttgacctcatccacacaaatatctaccaaaaattcacctagcgcaggagcccttcaagcatttgtaggtgattgtccttgaaaactgtcatggaatcctcacatatattattttttaaactttaaaatatctagctcattaaatcatttttttaaagatcttaacacttcaaaatccttctttatcctattaattcttcttttggtaaactcttatttaacattacctttaaaaagcttggcatccataatagaatatagaattccaagaccagtatgactctgagtaagaggattacacattctataatgacgacaactcttattttacagaagctaaacttacattagagaggactgttttgtttttattttgtttttatttgtttaatagccacatcattctaatggttcacactgaacgtgcaaactaataaattcctctatcttttagcatataaattgctagccacaaaactattatcttgtactttcataaacaaatgtttaacacaaaattcagaagtcagtttttttttctctcatgtaaacattacattaccacaccagtattaagggcaattttaaagtagacttttgtcattccacgtatatgttcatcctaacatcatgtcacctcctagtcacattctggattctctccaactgtcaaaatggaggtttggacaatataggatacacacataccttcagatacactttggagattagtttaattagatataaatcaaactacttttatcatgatgtagcactcatttactttaaatctttctgcaatacaatcaagatttgttcaacgccttgctgaaagcagtatctggcctatctgtgatcttgccttgattattatcaatctagaaattgtatcaaaaaataaaatgaagttgaatggatcttctatattaaataattagttttctaaatgcccctaaactattcgctaaataatcttttctatttagtctgttgttctggatgagggttctcagtcttgactgtacattagaatcactgggagttttggaaatataacaatgtcagtgcttcccccacatcaactgaatctgaatatctactagtggagcctacatcggtgtatttgtaaagctccacaggtgataatggcagtttctaggacacatttgcccaagtaaaattataccactggtg

SEQ ID NO: 2389 - DNA, 9866 bp, Homo sapiens
ctctgtttcaaaaaaataaataaataaataaaaataaaagaaaagaaataattaaggcaaaactgacatttctttattaatataacactgcgcaataagtttaaattgatttcatagcaaggggtgttattaagttagtcttacaacaaactagagagaaaaatcaattgtatcatcaaaagttattttgaaattttagaattcaaaatagagggcaaagaaaacaatacaaaagcaaaatgaaataaaaaacattgcaactcagattttcacattctttaggtgttagcatctgacatagaaaagttttttttacaagtattgtgatgaaaaatttaattcacctatatgttggcttattttaattcatttaattgcagtcaagacacagttaggtccacatactacatagtgataaaacaagggaagtttgtttgtggcaaatctcttattatgtaacttttatatattacgtggccagaaattctcaccttgatcctcactatttttttgtttcagtaaaatattttttaaaaaaaaaagtcatgaaaaactttatgtagtgtttaatacgttaagacatatgatttttaaaaactttgtaatcaatattggtcactattgtctgtctctgccacatgccacatctctccttaacctatttatagccttcagatttctgtttttagttcgtgatggttgtcattgtcactgtatgtgtgtgtgtgtctgtgtgcgtgtgtgtgtctgtgtgtgtgcatgtgtgtgtagtctcattttgttattatgtcctctgccactttctttgtaaatgcaaagagggataaaaattaagcttaatatgaagcaagtacttggcacctgctttcaaagaactgtgaatcataaatggaagacggttcattcggctacctcataactgtatttaagaccagcctgccgggtgcggtggcttatgcctgtaatcccagcactttgtgaggccgaggtgggcggatcactaggtcaggagttcaggatgagcctggccagcctggtgaaaccccatctctactaaaaatagaaaaaattagcctggcatggtgacgtgcgcctgtagtcccagctactcaggaggcggaggtgagagaatcgcttgaacccggcagtgggaggttgcagtgagccgagatcgcgccactgcactccagcctgggcgacagagcgagactctgtctcacaaaaaaacccagcctgtggattattttaaatgttacacttttctatcctggattctctgtttgtttattgtttatatgttctgtttgtccatcgaattttcctatttcttgaatcgttgtcagcatattatcctttactcattttaacgtagtttttcttaatttttgaaatgtatttgtaatagctactttgtaactattttgtagcaatctttgcttaatccaacatagggtccactcaaaatcactttctattgactaatttattccatatgcttttcaaatatgcatttccacatcactcctaagtttctggtcaaagctggacaattttatgtgatatactatagtaagactggattttgattgctttttctaaaggtttttggatattattttattttgtgattttgtttgtgcctgtacttaaactgtgggatctgtcttgccatggtattcagctatttatatctctttacaatatttttcttcttttttaattcctgatttccaggggtcatttccttgtaggcactgctatgtgattaaccaatggtttgggcagaacttacagtcaaatgcctcaaacctatgaggcttctatttgacaatgtaattgtgtataggtaaaagaaaaacattcaaaattcaagcaactttaaagtctgtttcagcttttactttctgccaggcccttggatctctcctgcaaatatgtgtaatttctgagtcagccaggaatgtgtgcttacctactctttctatggctttcttatttacagggtgtccctgttacatttctggatcatgcattgcttgtcccaattgggacagtaacctcatggttgcagagatacaggattgaattcacaggtccatgttgtatttcgttgtcatgtctccttggttggcaatatatgaacgtatctcagtcgtggaagacattgacacttttgaagagtacaggtcaggtattttgcagaatgtaccttaactggggttttcttatgattagactcgggttgtggaatttggggaagaatatcacagaggccaggtgcccttctcatcacatagtataggggtacatgatatcaacatgacttatgactggtgacgttcaccttgatcttttgattgtaaggcagtgtctgtcaggtttctctaccgtaagctttacagtttttccctctccatacttagttcattagaagtaggttactaagttcagcccacagttaatggagagagaattatgctatatcacctggaaggaggaaggaatatcaaagtttaaagttgtgtcaaaaccacgtggtaatgaataaatgatttaagggaggtatttgagactcttctgtaaatatctatttcttcttaaagttttattcactaatttttagcattaatcagtgaatcttcactgcaataattattactgtggtatttaatggtgatttaaaacaaatttactaattctatatttattatttggatttttctgtaggcattattttctattatttttgaaaccagtttttctgcctcatttatttcaaaacataattcctcagattcaccatgaattgtacaacactgtggctttaaacatacgtgccatgggaatagtctggaatacctttctcctgtcttgttatcaaacacgttttactgcaagaatcaatgaaatgctcttactaacgtctgaagtcttgacttacaatttttaccatctttaggaaaatgattatactatggatttgtgtcttcaaaaaagatatattgaaattcccagtatttcagaatgataccttatttgtaaatgaggtcattgcacatataattagttaagatgaggtcatactcgggtagggtggttctgttatccaacaggactggtatttttatgagaaaaagacacagagacacacaaggggagagctccatgtgacaacagaggcagagatgggagctgcaagccaaggaacaccgattgccagaaaccataaggagctaggaagagacaagggagatttttcccctgcaagtttcatagggagcacagtcctgctgataccttgattttggacttctagtcttcagaactgtgagacaataaatttctgtaattttaaatcacccggtttgtgttactttgttacagcagccctgtgaatctactacaatttacaaaacaacacagtttagaccaaaatgtgaaatattaagttaaacttgtcacagcctcagaatgtgtaactctaaaattaaaattggttgaatgccctttttaaattttagaaactcagagaaacgctggctttttctttggcatagaattttatttaaaagattagtccccaagttcggaaaatttgtagtatatttatgtgatgtcaatgagaacacatatcattttaagagatatgtagatgttgacatcattgtaaagaatgaatttaactggaaagtgaaaaagttaatcagtatgcctttgaaaacagaaagatcataggaattagcttgttttaatatttacatatttttgaaactagggaaagacaaaaaattatagagtgcatggtttgaaagatggatttagaaattatcctattactaattaaaattactaattattaagtaattatattactaaattacacattgtttaatgtaactaacattcattaattatccaatatgtgccaggcacggtgcaaggtgctggaaatataaatatccacaaaataaattcattttctttatttaataattaaaaagcaactcaaagagaggaaaggcagaataacaacaaagtcattcatgtttaccctcatgtgattgttgaattactgtatactctttatttcagctgacattaaaaaattgcattttatggaaactcatgaaagtttatgtgcataagggaaattaagaaaataagaatgatttgtgattaaataatggcttagatttatttcagattagatcattcagatgtcagtaacggtatttaagtacactatatgcaatggtgtgaaaatacgtaaggtaaaaagtttccgattaatgcaaaatttattcagactacataggaggaagcatgacaggaaagagaatatacgccatggagaaaaatgatgcagggagggaagagagagggtgaccaagactggacgaaattaaagttcgtgaggcaggagcatgtttactcttttagaggaattgcaaggaggccagtgaagctaaaacagagtaataggcaagaatgaaacatgtcgattaagtcagtgaatggctggattatgcaggaccttattgaccattataaggatgtttgctttattctgagacacagaaaaatcactgaaaaaatttgaggagaaaaaatgatctcataatcatagaagtgatgatacgtgtaaacactacaaagagactgcttttctgcaggcattaaggccagggagagaaacccaggaagaagtgagcattagttgtaactctgtgtaagtgactttgttttcttctttggtatgtttaaaacctttcatgaagtgcacttttttccctgttgctaaatcacagagttgggctctgctaccctgagactatgtttaaacttgattataagacactggtagataatgacggctgtaataacatcctatcaccattaaacataaaagctgatgataattaccagcccatcttgacatatgttatatcattttctgaaaaacgtgtttttgttgcttgctgcttcaggaaagtaaacatattagactttggacgtcatcaccagggtgttatttttggatagttttaaatatgttatgctctatgattggtaaagaaactgcattatattctatgtgtaaataagtataatctagaaaatactttttagaaatggctaaacttgaccgtgtcaatttctgtcttgtttctagcatgtgaaacatctaaaccaccagtagtgatctaacatataaaataagacattgagcctaatgattttttgttacaatttcaaatgtgtcattttcattgctatatcacattgtacagtgaacaatagtggtagaatttcagatgtttatgaatacatgtaaaagatggctcatggaaatcagaatgaaaataggttatgatgcaggactcttgtaggctcagagacaaacaaaacacctccaaactcaaaaaaaatccacacatttttgaccactcgcaagtaaattttctttgccaagacacatagggaagaatgagtaaacagaagatgaggaattatttcaaatagtaagctcttaggttcttagtcattggatgcatgaaaagcaattagaactcttagatatacagaacccaggctataaatgtaaaatattcctcctatcttgatcctttacccatgtcagatatcatgaaaataccaacattattttcttcatagttagaaatagcctcaaaacctttcttacagattacagtgacgtaggattgaaactttttgttatccttgagctagggctctatttctcaacaccgacactatagacaatgtgaaccagataattctttgttttacacggctgtgctgtgcattgtggggtatttaacagcatctctggccaccacccactagaggccagtagcaactactctgtttatccctacccccaagtcgtgacaaagaaaatgtccccagacaatattgccattgtttgacaaccacttccctaaagatagatatacctagtaaataaaggactttaagataaagcatagaagaaaattcttaaacttagcttgctatggtattagaaatgccatcatcaccttctctgtggctattcttccctctagcatgttcagcatggtaacttctggctctcaccctggtttttaaaatttcatgtccaggcatcatctgtctcacagcttttgcctaggagatcctgatgaggtactgaaaagatatttggatattaaaaacaattgtcactttaacgtcagtctcaggctgatgttatttacttatttaatgagtgagtttctgcattgggtgatggtatataattttatatagatcctcatgtatgtttatttgtttatacatatacacatataaaatctatctgtatgaatagacctatataaataaatagtttttttttttgttgactgacttgattcttaatttaactctcgtatgtagtttttaattgtgatgttttgtgaaagaaaaattcaatggatggtaacagtatttgtcttagaatatgctgaaagccaaatgaaagggagagagtgaagtctctgtaagtaatattgcattttgttttgccatttccctctgtttaggagcatctattgcttttagaaagctaatgtttagtaaaggaaccctaagaacaggaattaggtagaatgattatttattctctttttaatagccacatggttttcccacacatacagcttcttacaccgtcaatgggagttctatgccaaggacagagtgacaacaattggaaggaaaattgaaatttacttttgttgtttagattattttggtaaccatggtaatggaagaccaatatagcactttaacactcaaaaacaaatttaggataagttttatttattgagataaatattatgttacattgggaatactggtattttgtggctgaacattttgggctttaacagatggacaatttattttttcacctttctccttccaaaactataggcagcagcatcaagaaaaggtaaaagacttttagataatgcatttagtaaaaaaataaaataaaaataaaaaaaagtattacagagagatagcaaaaatatattgataacacaagtatatagaattcaatcaaatttgtttctgaacttcctggtaattagagtataaacacataaagttatttaatttaaaattgtgaggatcattatggagaataatactgtgaaaataactttgactgatgattatctgatttttttaaagttacttttctctcatcaaaagccatgctataaggataagcttattgatatctactgttgtcctggaatagtattaaaattggacatacaaagatattttttattttacttaattgtacattagtgtcaccaaaatatttgataaaagtgttttgccaacatattttttaaacacttaacattaaggaattctatgttttatttacatggagcactcaattcagagattcttttcacaaggaaattttggctccagatcttctattctttctttgtttctttctttctttttttttttttttttgagacacggtcttgctttgtcacccactggagtgcagtggcataatcttggctcactgcaacctctgcctccccggttcaagcaatccttgcgcctcagcttcccaagtagctggaattacaggcacgcgccaccacgcctggctaatttttgtatttttagtagagacggggtttcaccatgctgaccaggctggtcttgaactcctgactttaagtgatccgcccacctaggtctcccaaagtgatgggtttataggtgtgagccaccccgcctagccagagtcttctattctttaaataaggctgccttctggtaacttgtctgggcctaaaagccaagagtttacacattgtataattatactatacaatgcctggctttcaaaatctttagattcaagtcaatatacattaaaaaaaaaaaaaacccttaaattgtttttaaattacttttctcaatgactatttcaatttactctcaggaaaaccctgtgagacaacatagatattttcttctttttttaaaataaaaaaatactgaggtatacaaaatgaaatatgatatagtagcataaatgaagctaaatctcaggggttctagctttcagtcctttttctgtatgtgactgagcgtttgctctctctcaacacacacacacagacacacatattcttgtatgatacacatacatatatgtttttatttagacaaaaatttagggactatcttttttacttccttttctattttaactttggtttaatgggttgatattacactgaagttttcttaaaaacatgtttagagctgccagtttctttttgtaaagaaactgatagaacaatttgatgtgtgatctgtgtttaatatttagggctcaaggatcagaaagaagagtgttatcctaacatatatagttatgctgaccctatgtcctagtttgcttggaatagtatgaatttatgcctgtagtcctgagataattattaatagcatttcttcaactttcaaaagtgtctcagtttgaggacaatgtatggttattttacagcccttctcaaagtctctggagaaaaaggagcgttgaaaataagtataaatataaatttaatcgattcaaaagtgaaacagatgactaaactgttctttagggcctagaggtcaactagagaacatagcctggaatggaactgctgaaaagcaacagttattccaacgtattgtgctattgtaaatgaaaaataaaagctgaaaacaatgtcagtctttatgtggaggcagaaatgccataataccttctctgtggctattcttccttctagcttgttcagcatggtaacttctggctgccatcctggacaaaaacaagcaatataattataaacactctttcactttttagtttagttcagttcctagaactagtaatgctttaaaggggtgaggtgccacttttagtctaggaaatacaatgttgcaaatactaatttttaaaaaaataaatgaggaagaaaataacatcacaaacgctactcaaaaatcttttataccatgcaacagttttggtagtcataatgacatcatgtgattgacattataataacttaaattcaatcacatacaaaaactctacataaggcctcccaattttatgttattgtcacaatttatatctattaatattgtgtatcttttaacatctttttagttacaactacttttaatacatgtgtcctttttcatactagagttaaaagtgattacaggccagtcagtattccagttaacaatacttcagttttccccaaatgttaacattgtacctagcttcaatacagttatctaaaccaggaaaatggttttctgactgtattagtcgcctagggctgctttaataggtcttgcaaaagtacacatatacttgtcttatgactcagcaattccaccgttagtatttaccccaaaatgataagcaattctgcaaatatgcttcagtttacatatttagacaaaaactaagtaaaattatatgaactcatgtcaactcacatagataaagcagcttattaagtgtattagattcctggcagtagaacacttcagattttagagatgacatattgcacagtataataatttaagaaagtcaatatggagtctcactgatctatttgatccttcttttaccctaccatattctttctttgtttaatattttaaactataattttaattttcgtcgcaaaatatttcaaatatataaaaaagtacagagaagaatatgacacatttccattttatctagatttaatgag

SEQ ID NO: 2390 - DNA, 4813 bp, Homo sapiens
aaaacaatctcctaaattgctccttctgctgtgacttattggctcatgctatacttattgggttatcaaaatatgtcattttctcacaatgtggagtggaagtccttcaatgtatctgttggggacatgaatgtaattaattttctgttcacaggccttgcccagggaagatgggactggctgatttgaaagactggtgcagctctggactgagaggacttcaagctaagtgatgggtcctgaggtctagggactctttcataaaccatctcatttatggaaacctgacacacatatgggaaactagatctttcacttgccttttactcttctctcttgcctctgtctggccccacatatcaatgtgtacttgtagtaaaccatcatggaagctactggcaacacaggtcaacaattttgaccccaatgggtgaagctaggtaccatccagccctcaaagctgtaggcctttctccatactcaaacatattttgtgtcctattttctgagctctcccctaggatgaatttgatccttgaatgtgtgctgaggtcccagtgtgtttctgtgtggttcatgccaagcaaagtgtttacacttagaaaataaaaaaattggctgggcacagtggctcacacctgtaatcccagcactttgggaggtcaaggccggaggatcacttgaggttgggagttcgagaccagcctgatcaacgtggagaaaccctgtctctactaaaaatacaaaattagccaggggtggtggcacttgcctgtaatcccagctacttgggaggctgaggcaggagaatcgcttgaacctgggaggcagaggttgcggtgagccgagatcacgccattgcactccagcctgggcaacaagagcaaaactccatctcaaaattgattaattaattaaaaaaaattttaaatcataaatttttgatcctaaaaggcatattggaaccatttcatgaagggtgtcctgcctcataaattgcaaaagatttcttctcattatcaacaaagctgtaaggtctcacagaacatgttttcaaagttttaaaaattgtgataaaatttaccatttgaactatttttaactgtactgtttggtggcattaagtacattcacactgttgtgcaaccatcactacaatccatccatccccagaaatttttcgtcttcccaactaaaactctgtacacattaaacaataatgccccattactccctccccatagaccctccaatcccccattcttctttctgtctgtatgaatttggctactctaagtacctcatataagtagaatcatacagtgtttgtctttttgtgactggcttatttcacttagcttaatatcctgaaggttcatccatgtagcagcatgtgtcagaatttccttccattttagggctgaataacatttcattgtgtgtatataccacattttgtttatccattcatcattggctattgtgaacaatgttgctatgggcatgggtgtacaaatatctgttcaagtccctattttcaattctttcatgtatgtacctggaagtggaattgttagatcacatgataattctatttttcaatttttcaaggagctagcataccattttacatagcagctgtactgttttacattctctccagtaatgtataaggtttaggtttttgtgtgtgttgttttaaataatagccatgctaatgggtgtgtagcagtatctcattctggttttgatttgcatttccctaatgattaataagttgaacatctttttatgtgcttattgaccatttctatatcttttttggagaaatttctattcaactcctttgcccatttttttgcctgggctgcttgtctttttgttgtttgatttgcaagctttttaaatccttggacctgttattcaaatgatgtatttcagaaaattctgatgtataaaacagattaaaaccgaaatccttcaagtacaggtggggaggagatggagcctacctgttcattctttacttccatggcagcctctaacaggactcctttatacgtctagcactgtttcttagctctttggaaaaactaccgtacccttggcatttagatggggatccatgcttcagaatatttgaagggacatagatatgcccaaagaaggactcacctctgtgttttgccaccttcaaatattgaccatggctagagaaatgtggtgcttttcactggagtatgttagtgttgttttgtcacttagttcccgaagacacactcagctattgatccttccacctatcaagggaagctcataaattattggggaaatgtcaagaagaatgaagaaaatgacagaaattctttcaaacccagagaaatacattatttacaaattcatatcccccactatcaggtagatccccacaagcagtaggaatttgtaagaacaaataagccactgatcatattgctatttatcacagtcactcaatcctgcttcagccttcagaccttgttgaatcaggagaattttttaaagtgggtgtttgtagggtttaaagcatttttttttttttagtttgaaagtaaaattctgagaagagtcttattatttgggggtctaaaatctgaccctcagcccattggttaagattcatctcccttttgggagtcttactccttgtttcgggtaacaagccctcaagattttcatgttttctttggtctgtgcaggtccctccacttcttcctcattggaattctgtacccacctgtcatcttgagaaccaaaatttttttcatatccagaccacttctgtttgtgacaagtgggaaggcaaccaatagcacagcacttttacttgcttgagttctgaacaattgagaaattcaaaggaatctgaaggtggagtcttatcaccgttaggccaggtgtggtggctcatcctgtaatcccagcactttgggaggccaaggtgagaagatcacttgagcccaggagttcgagactagcctgagcaatatagcgagactctgtctctacaaaattttttaaaaatcaaaaaatagctgggcattgtggtgtgtacctgtaagttccagatacttgagaggttgaggcgggaggattgtttgaacctgggaggttgaggctgtagtgagccatgattatgccactgcactccagactgggcaacagagcaagaccctgtctcaataaagtaaaatatcacctttaatattggataaaggttagagtggggacacagtttatatgtatgagcaaacgggcttcccaatatagtggccctgtgttagagaggcttacctcctctgtcacaaactatgctgtaccaccacagaaccctcttacagggccaggcccctctcactgtttggcagaaatcagaacagaacacaactcctctgtagtcagccatatcccgtgaagaagcagtatggtcagagctatgcatgccccagttccttgttctaagctcatcaaccaggtaaatcatcccaatccccctcctcttcataagaatatcacagcccccacatggaaagaaacatgtagagttgggaagaataatctactctagaatttcccagtttatttttctcttaacccactgagtttaaccactgagccatctccatgaagggggaagattagcagtttatgaggacagtctgactcccaccttcgtgaggctaacctcccagtagaaaccactgggattgctgatgggcaatgtagatggtgatatttgcagaaggctctgaaatgtgcctgaagactatattaattaaattaatatcaagactgtgccttgtgtaaggatgcaaatttatcacctactctatttcctttctcaaataatgaccagctgaattgtcataagtatactatcagaggatgtgcagtgagaccaaaggataacattaagacactatgaaaataatgtgcatcaataagatgctactcatttgaatataatcttcttttatcacatttgcaggaggacatttaaattcaaactccctcatgctttttagttaaagtctagagaaatgaaagtccaaagtttttacctccaaagattttaaagttcaaaataaagttttctttctcttgggagtaaaagttccaaaaattaaggaccaaaatgtatcctccctagcttcttactatgctcaactttaatgagaaaagttctcaaggcctgtgcagacttggggttcttcagcagttttagtctgtactgtctcttactggaatggatgtagttctttcagagcctctgagtgtgtgttggttcaatgccaagtctctgatgtttcctacagttcaaggaattaatagaacctacaagataattgcatcactggccccacatattcccaattagaaaacaaacaaataggtggtggtagtcccttcatggcccacattgatctctgcctcctagaattcactccttgtgaaatcccttcccctgggtttgggctggacctactatgttgcttttaacaaatagaatatgatgaaatggtggcgtgtcacttctagaattagtttaccaaagactgtgacttccatgtttgtagcattctcttcttctctggctgttctcagttgtttgtgctgatgaagccatctgctgtgttgtgagctgcctgatggagaggcctatgtgacaaggaacttgccagcaagggatgagactcagtctaacagtctttgaggaactaaattctcccagcagccatgacttttccttggttcagctaaagggagggtcttt

SEQ ID NO: 2391 - DNA, 25130 bp, Homo sapiens
gcaggactctaatctgactgtgggtcataagaccttcattccagagagtcctgcttccttctctggaggaagcaaccctgcacagagggaaagaagaatctcaacatacagtcctcagcagctttagcatgggcaacaaattaagtctctgtaaaaggcccaaaggacagggtttggtgagattctggagagctggaaacatggaggttgacaggaatgtaaagaagaactcatttacatgccaggagggtggaacaccccaattccatgaggataactgctcctgtactccagacctcaccccatgtgtctcttcatctggctggttatttgtcctttaagatctccttactcaaccagtaaatgtaagtaaatgtttccctcacttcagtgagctgctctagcacattaactgaactcaaagataaggtcgtagaaactccgccttgaagccagtcagtcagaatttctagaggcccgaacatgtgactagagggaaggagggggaagtcttgtgaaactgagccccctcgacctgtggattctgacacactctctgggtagatagtgtcaaaactgaattgaaggacacccagctggtgtccattgtttggcgtgtgtggaaaaactcccacacctttggtcacagaagtcgtcttctgtgttgatgattgtggtggtgaagtgaggcagaagaaaaatgcagtttgggagtttttccctgaaacacacacacaccatagaatactatttagccttacaaagaacgaaaattctgtcatttccgacaacatggattaacctggaggatattttgctaagtgaaataagctaggtacagaaagacaaatgatgcatgacctcatttatatgtagaatctaaaaatgtggaactcagagactagagtgatggttatcgggggcttggaagagtgtgagatatgggaagatgtttgccaaaaagtacaatgtttcaggggtgtctttacattgttttagtcttgaactagaagatgaaagcatcaaataaagaaatatactgtgggtatatggattacaaaaaaagtgttaactggtatatcttgtcttgggaaaatatggcagctcctatgaaacatctcggaaaatttgtaactgatgttacaaaacacccagaagaaataagtggtctggtgagaaaacttactcatctttgcctacatatgtatacatgagtaatttgattacacatttgtgcgggataatataactgaaaagaaaatgtaaaatttaacttaaattgtatttgtaagttgtaatttcattaattctgcattattgaagtacatgtaggaaaggtgcagaaatgcatcaggcagttaatacaaatacgttttttttttttttttttttttttttgagatggagtctcgctctgtcacccaggctggagtgcagtggcgtgatcttggttcactgcaagctccgcctcccaggttcacaccatcctcctgcctcagcctcccgagtagctgggactacaggcgcctgccacctcgcctggctactttttgtatatttagtagagacggggttcaccgtgttagccaggatggtctcaatctctatacctcgtgatccgcccacctcggcctcccaaagtgctgggattacaggcatgagccactgcgcccagccaatacaaatatgttttgctcaattttgtaatgtttatgctaccatcagttttttgaaatatgtaacttttactttttttcttagagtcctccaaattatgtttcaggctccttaaaaactttttatctatccctgataaatattcctcaataataattttaaaaatccatttggttaaatgaacatgaactctaagtcttttaaccagaaataagctattaggttgatgcaaaatatttgcattttttgccattgaaagtagtggcaacaaagaaataaaattgtatttttggaatagttttctcttaagctcttgataataaacctgtaagtattaactgccttacaaatggcaaaagaggccacttgaaggaaaggaaattccttaacaggactttccttagcaggaaagttagttgcctgggtcatcatttggataagaaaaaaatccattaaaaaatggcagtattattagtatcatatgcataattacatatataaaacttgccatatattgtgtgaaatatagttctttagtataggaaaaatatattgatatctataaaggtaaaattattttaactctttcacatacatgttatttgataaaatttgctttcgtgttttttctttgtcaggtttcattgatactcaaaattcatttcctttgacatagctcaggagatttgttagtaaaaatctcacccaaattcataagaattttccaataaaatatttcagaaatgaaacattttgaaagaattggtcaattatcactttctgctagatagagcatgatagtttggtgtatattttaatatatcagtgatatagtttggatattactccccacccaaatctcgtgttgaactgtaatccccagtgttagatgtgaggcctggtgggaggtgtttgggtgacaggggcaaatcccttatgtcttggtgctgtcctctagatagcgagtgagttctcttgaggtctggttgttgtaaagtgtggcacctccactcccaactctctctcttgctcctgctttcgtcatattaagtgcccactcctgctccaccacctgccatgatgataaggttcctgaggcctccccagaagcaaatgccattgccaagcttcctgtacagcctgcagaactgtgagctaattaaacctctttacttataaattacccagtgttgggtatttctttatagcaatgcaagaaaggcctaatacagaaaattggtactaggagtgaggcatggctattaagatatctgaaaatgtgaaagcaaattaggaactgggtaacaagcagcagtccaaagagtttgaatggctcagaagacaggaagatgaaggaaagtttggaacctcttagagactggttaagtggttgttaccaaaatgctgattgtgatatgaactttgaagttcaggctgctgaggtctcagatagaaatcagaaatgtattgggatcaaagattatgcatattatttcttagtaaacagcttggctgcattgtgtttatgccctagagatctgtggaagtttgaagttgagaatgatgacctagagtatctggtggaagaaatttctaagcagcaaagtgttcaagatgtggcctggatgcttctaacaacctatgctcagatgtaggcacaaaggaatgacttacatttggaacttacatttaaacaggaagcagagcctaaaagttcagaaaatttgcaggctgatcatgtggcaaataaataaaaaccttttacaagagagaaactcaagcaggctgttgagcaaccatttgctagagatatctgcataactgaaaaggagccaaatgctaatagccaagacaatgggaaaaaggtttcagtgacatttcagagaacttcctggcagcccttcttaccacaggccctgaagcctaggaggactgaatggttttgtaggccaggcccagtaccttgctagcctgcacagccttgagacacggctccccaaattctggtcactctggccccagcctcagctcaaaggggcactggtaaaacttgggccatcacttcagaggacacgagctataatcattggcagattccacatggtgttaagcatgtgggtgcacagagtgcaagagttaagaaggcttggtagcctctgcctagacttcagaggatgtatagaaaaggctggtgttcaggcagaaggctgctgcaggagtggagccctcacagagaacttctagtagagcagtggggaggggaaatgtgggtttggaagcccacagagtccccagtggggtattgcctaatgaagctgtgagaagggggccaccatcatccagaaccaagaatggtagatccattggcagcttgcactctatgcctggaaaagctgcaggcactcagctgtagcacttgagaggagccatggggctacatcctgcaaattcacaggggaagagctgcccaaagccttgggagcccaccccttgcattaacgtgccatggatgtgaggcatggagtcaaaagagattatttcagagctttaagatttaatgactgtcctgctagttttcggacctgtgtgagctctagtccctttctttgcctgacttctttctcttgtaatgggaatgtttacccaatgctggcaccctcattgtatcttggaagtaaatgacttgttttgattttacaggctcacaggtggaaggaactcattttcagatgggactttggacttgggacttttgattgagttgttgcagaaatgagttaagattttggggaattgctgagaaggcatgattgtattttgccatgtgaaaagaataggtaatttgggggaagacaagggtagaatgatatagtttaggtatttgtccacactgaaatttcatgttgaattgtaatccccaatgttggaagtgtggcctggtgggaggtgtttaggtcatgggggttgatccctcatgtcttggtgctgtcctctcaataatgaatgagttctctcaagatttggttgttgtaaagtgtggtacctccacccccaactctttctcttgctcctacattcaccatgtcaagtacctgttcccactttgccttccaccatgattgtgaagttcctgaggcctctcggaaagcagatgccagcactatgcttcctgtacagcctgcaaaactgtgagccaattaaacctcttttcttataaagtacccagtctcaggtatttctttatagcaatgcaagaacagcctaatacaatcagtaaatatgtcagattctacaatgaggctactataatgtgaagatatttttcttaatcatttacatttacaaatagactaaaattcttgttttatgttattgtcttagttcattttgtgctgctataacggaatactacagactggtaattaataaacaacagaagtttatttggctcatgtctctggagattgggaagtctaagactgaggggcctcatctagtgaaggtcttgctatgtcataacataacatggtggaagtcatcacatggtgaaagcatgtgtaaaagaggaagacaggagaactcatactcttatcaggatcccactcccacaatatctagccctctcccaggataacagcactgattatcttagaagggtctcaactctcaggactgttgcattggggattacatttcaaacacgtggatcttgggagacacatttaaaccacaacagtgatgttttgaataataaatatacatctacaaatgtgtttcttccacctggcaatgccttcttctgatagttttattctgcaaatttcaattattcaaataaaatttcctcattggccctctttaacactttttcctctgaaatcttatattacttgttgctttacaaatactctttaaaaattattccacactggtatctaaattcttccttttttcccagtcttatcttcccaattggcttttaatttccatcaggaaaggatccatgtgttttgacttcttggtactgctcacagtaatacgtaaataattaagatttaatataattgggtttaatttaatttcatgtagattccaattgatttttccaattagatgtgtgagatttttattcattaaaatacgcaattatactagcatccatttttacttgtccaaagaatgagctaagatttaagttatattttgcgatcttgagatacatttcatatgctcttcgttgaatcacttttctattcatcttcaaattccagctataaaatatgatatgcaattgtcttagctcagattgatcacaaatccttgttctacaagataccatgtattcatatattcataaaaatatcaacagaaataatatattaataaatatttaagtatgtaatttcagaaagagatggtaatgtatcaggacagattttagttaggagacacaatatgcttatccgagcacaaagttggtttttatcaattgatgttagtttttgattatatactatatgtaagttctctatttataattataattttctcattaataataataataaatcatacctatattgtaccttgaaattatcaaagcccctttcatttccacctcattttctctctttctctttttctctttctttttccctgttcttttagtctctgtctctccttcagaaaaaatatcagttacttagcaggacatatattattgtttccatgttacaggttggaaatgaaatttcaaaggaataagttattttttatggtcttatagctaataattattaataattgatatatgtaggattgggatcccaaggtttaactcctaatcatgtgacttcagacaaaaaaacgtagaaataacagtttttctggattgttacatggggtcttaggcaatttgagtcattataacaaagtaccataaactgggtagttttaaacaacagagatttattttgcagagttctagaggctacaagtctgacatcagggtgccagcatggttaggtcccagtgagggtcctcttttgagtagattgctgccattttattgtctcatcacagggtgaaaaacaatgtgagctagctctttggcctatttttataagggctctaatcccattcatgagggttccaccctcataatgtaactacttcccaaaagccctatctccaaataccaggatactggggattcgattttaacatatgaattttgggggaaaatgaacattcactttataacacatagagagtgaggtagtctggataaatgatctagcgtgttcactcataaatgttattttcatgctccttttctaagccttttctattataacagcaatgcagtttgtaactttaagaattattccatgtagaatgtaaattgatatagccattatagaaagcagtgtgaagggttgggcatggttgctcatacctctaatcccagcactttgggaggcctaggtgggaggattgcttgagcccaggtgtttgagaccagcttgagaaacacagaagggcctggtcactacaaataataaaggaaaattagccaggcatggagatacatgcctgtggtcccagctagtcaggaggctgaggtgataaaggctgcagtgagttgtgatcgtcaccactgcactctagcttgggcgacagagtgagaccctgtctcaaaaaaaaaatcaccaaaaccaaccaaccaaacaaaaaaacacacaacaacaaaaacagtgtaaagtttcctcaaaaaataaaaaatacaactaccatatgatccagaaattccactactatttacccaaaggaaatgaaatcagtactttgaagagatatctacattcctatgtttattgcagcagcattcacaacacacaagatatggaatcaacccaagtgtccaccagtgaatgaatggataaagaaaacatatataggcaatggagtacaattcagctgtaaaaaataatgaaaccctgtcattttcagcaacatgaaggaaactagaggacatgttaagtgaaataagccaggcacagaaagacaaatagcacataatctcactcattgcggaatctaaaaaaaatatacatcaatagaaatagagagtaatatagtgatttccagaggttggggagggttgggaaagagggaatggggacagattgatcaatgggtacaaaattacagttacgtgggaagaatacattttggtgttctatagcacagtagggtgaatatagtaaacaatgttatggtgtatatttcaactacaagagaggattctaaatgtctcatcacaaagaaatgataaatgtttgaggtgatgaatatgctaaataccatgctttgatcattatacaatgtatacatgtgttgaaacatcacaccgtactccataatatgtataattactatgtgtgaattataaacaaaatatcattccatgtaatgtgaggaaattgtttctctttgaaaaaaatgtagctatcaacaatactggtaaaagcagatgaagaagcaaaatatcaaaaacccataatcctgcaagagccttaacaagattaaatatttgattatttctaggacacaggaccttttaaaacatttcctgttgttctttggatggtccactgtgggtagtttgaaacagtctacgagacttctctctgtatcaaaggaagcaatgagatcagagtaaaaatatcagagaaagattttttaaaatgaattaaggaaggtaaatccaagcagagtttttataacattcacaaaagcatgtagctttgtgttaaatcgtgtttttaaaaaatattctcttcttgcttcgtatctttgagtcagaaagctggatgtgtgtctaaacaaactaggcaatgctaataccaagaatcccggaaaatgtgctaaattcactattctatgtaagtttgctcagatggtggagaaagtgcattaaccagtactgcaaactgaatcttttgtgtgtgtgtgtgtgtgtgtgtgtgtgtgtgagagagagagagagagagagagagagagagacagagagagagaaacagacagagaaagagagagagagaagatatttgaaaaaaatacaagaaataaagaaagaaatattcaaggaaatagatagcatgaatgaaaagcaatctaaacttcaggtagcaatgaacacacttacagaatgcaaaaggctctggaaagtctcagcaatagaattgaacaagtagaagaaagaatctgagctcaaagacaaggtctttgaattaacccaattcaaccaagacaaagaaaaaagaataagaaaatacaaacacagcctccaagaagtctggaattatgttaaatgaccaaacataacaataatcagtgttcctgagaaaaaagatgaatctaaaagtttggaaaacatatttgggggaatcattgaggaaaatttccccatcttttctagaggcctaaacatcctaacacaagaagcacaaagaatacctgggaaattcatcacaaaaagatcatcacctaggcacattgtcatcaagttatctaaagttaagatgaaggaaagagtctaagagctgtgagacaaaagcaccaggtaactgtaaggaaaacctatcagtttaacagcagatttctcagcagaaaccctacaagttagaagcgataggaaccctatcttcagcctcctcaaacacgacaattatcagccaagaattttgtatccagttaaactaagcttcatatatgaaggaaagatatggtgtttttcagaaaaacaaatgctgagagaattggcactaccaagccaccactacaagaactgttaaaaggagctccaaatcttgaaacaaatcctggaaacacatcaaaacagaacctctttacagcataaatctcgcatgacctataaaacaaaaatacaatttaaaaaacataaacaaaaatttaaaaaccaaggtatacagacaacaaatagcacgatgaatggaatggcacctcacatctcagtactaacgttgcctataagtggcctaaatggtccacttaaaaggtacagaactgcagaatggataagaattcaccagccatctactgccttcaaaagactcacctaacacataaggacccatgcaaatttaaggtaaaggggcgaggaggggaagacatttcatgtaaacagacaccaaaagtaagcaggagtagctattcttatatcagacaaaacaaactttaaagcaacaatagttaaaaaagacaaagagggacattatataatggtaaaaggccttgtacaacaggaaaatatcacaatcctaaacatatgtgcacctaacactggagcttccaaatttataaaacaattactaatagacctaagaaatgagatagacagcaacacaataataatgggggacttcaatactcccctgatagcactaggcagttcatcaagataaaaagtcaacaaagaaacaatggatttaaactgtaccttggaacaaacggacttaatgtatatgaaacattccatccaacaaccacagaacatatattctgttaaacagcacatggaactttctctaggatagaccatatgataggccacaaaacaaacctcaataaatttaaaaaaattgaaattataccaagcactctctcagaccacagtggaataaaactgaaaatcaactcaaaaaggaaccttcaaaaccatgcaaacacatggaaattaaataacctgctcccaaatgataattgggtcaaaagtgaaatcaagatgaaaattaaatattattctaactgaatgacaatagtgacacaacctatcaaaacctctcagacacaggagaggtggtgcgaagaggaaagttcacagccctaaatgcctacatcaaaaagtctggaagaacacagacaatctaaggtcacaactcaaacaactagagaaacaagaacaaaccaaacccaaaaccagcagtagaaaagtattaaccaagattaaagcaaaactaaataaaattgaaaccaaaaaaagtacaaaagataaatgaaacaaaaatctgtttctttgaaaagataaataaaatggatagtccattagcaagattaaccaagaaaagaataaataaaatccaatcgagctcaataagaaatgaaacgagaccactgaaattacaactgacaccactgaaatacaaaataccattcaaggctactacgaacacctttatgtgcataaactagaaaacctagaagagatggataaattcctggaaagttacaaccctcctagcttaaatgaggaagaattagataccctgaacatactaataacaagcagcaagatagaaatggtaattgaaaatattaccaacaaaaaaaatccagggccagtttgattcgcagcagaattctaccagatattcaaagaagaattggtaccaattctactgacactattccacaagatagagaaaaaggcaactctccataagttattctgtgaagccagtatcaccctagtacaaaaatcagaaaaggacataatcaaaaaagaaaactatggactgatatctctgatgaacatagatgctaaaatccttaacaaaatactatctaatcaaatccaacaacatatcaaaatgataatctaacatgatcaagtgcgttttataccagggatgcagggatggtttaacatatgcaagttagtaaatgtgatacaccacataaacagaattaaaaacaaaaatcacttgatcatctcaatagatgcagaaaaagcattttacaaaatccagcatctctttatgatgaaagctctcagcaaaattggcatacaagtgacatatctcagaataataaaagccctctatgacaaacccacagccaacataatactgaatggggaaaagattgaagcattccctctgagaattggaacaagacaaggatgcccactctcaccactcctcttcaacatattactagaagtcctagctagagcgcagacaagagaaagaaataaagggcatccaaactggcaaagaggaagtcaaactgtcgctatttgctgatgatatgattgtttacctagaaaaccctaaggactcctccagaaaacccctagaactgataaaaaaaattcagcaaagtttctggatacaagattaatgcacacaaatcagcagctcatcaatacaccaacagtgaccaagctgagaatcaaatcaagaactcaagaaatctccacactgttcaaatcaagaaatcaagagccccttttacaatagctgcaaaaaatacaacaacaacaacaacaacaacaaacttaggaatacacctaacaaaggaagtaaaagtcctctacaaggaaaactacaaaacactgctgaaataaaccatagatgatacaaacaaatggaaacgcattccatgctcatagataagtaaaatcaatattgtgaaaatgaccctactgccaaaagcaatctagaaatccaacacaattcccatccaaatacaaccatcatttttcatggaattagaaaaaaatctaaaattcacaaggaaccaaaaaagagctctcatagccaaagcatggctaagcaaaaagaacaaatctggaggcatcacattacctgatttcaaactatactgtaaggccatgatcaccgaaacagcatggtactggtataaaactaggcacatagaccaatggaacagaatggagaacctagaaataaagccaaatacttacagccaactgatcttcaacagagcaaacaaaaacataaaatggggaaaggatacccttttcaacaaatggtgctgggataattggctagccacatgtaggagaatgaaactcgatcctcatctctcaccttatacaaaaatcaactcaggatgggttaaggacttaaatctaagacctgaaactataaaaattatagaagataacattggaaaaatccttctagacgttgacttaggcaaggatttcatgaccaagaatcccaaagcaaatgcagtaaaaacaaagataaattgctgggacttaattaaactaaagagcttttgcacagcaaaagaaacagtcagcagtgcaaacagacaacccacagagtgagaaaaaattttcacaatctgtacatctgacagacgactaatatccagaatctacagtgaactcaaacaaatccataagaataaaaaaacaaacaatctcatcaagaagtgggctaaggacatgaatggaaaattctcaaaagaagatatacaaatggccagaaaacatattaaaaaatgctcaacatcactagtgatcagggaaatgcgaatcaaaacaacaatgcgataccacctcactcctgcaagaatggccataatcaaaaaatagtagatgttggcatggatgtggtgatgtgggaacacttgtacactgctggtaggaatgtaaactatacaaccactatggaaaacaatgtggagattccttaaagaactaaaagtagaaccaccatttgatccagcaatccccctactgggtatctacccagaggaaaagaagtcattatatgaaaaagatacttgcatatggatgtttatagcagcacaattcgcaattgcaaaacctgacaccagcccaaatgcccatcgatcaaccagtggataaagaaactgtgagacatataaatacacacacacacacacacacacacacacacacacacacaatggaatactactcagccataaaaaggactgaattaatggcattcacagcaacctgcaagagattggagactattattctaagtgaagtaactcaggaacagaaaaccaaacactgtatgttctcactgatatgtgggagctaagctaagaggatgcaaatgcacaagaaggacacaatggactttggggactcagggggaaaggtggaagggggtgagggataaaagactacaaacatggtgtagtgtatactgcccgggtgatggatgcaccaaagtctcacaaatcaccactaaagaacttactcatgtaaccaaacactacctgtcccccaacaacctatagaaaaagaatttttttagttaaattaaattaaacagaaaaaatttaaaaaataaaaacagaagccacaggccaagtgcagtggttcacgcctgtaatcccagtactttgggaggccaaggcaggtgtatcacttgaggtcagaagttcaaaaccagcctggccaacatgacgaaactcccatctccaccaaaaatacaaaaattagctgggcgtggttgtgcatacctgtaatcccagctacttgggaggctgaggtacgagaattgcttgaacctggtgggggcagaggttacagtaagccgagttcacgtcactgcactccagcctgggtgacagagtgagagtctgtctcaatgaataaataaataaataagccacagagagacacacaggaagaaaggccatgtgaagatatagaaagattgaaattctgcatctatgagcaaagaaacattaaaattactggcagacaccaaaagtacataagagatgtagaataaattctccctcagagcctccacaaggaagcaacacttccaacaccttgattttggacttctgcactccagaaatgttagataatacatatctcctagtttacatcacttaatttgtgctaatttattatggcagccttgggaaactaatacagactcatgatgcctccatggcagccatccaaatgtttgctctgttggcttgcatgtgtgagttcttaagagaatcctagagagtttctctactgcatttcccaggtctggaaggtcacccttaaacttaactttcccttcctcttcattcctgtaacttggagtatatccaaagctcatgcggatgtcatcctcttgtcttgaggtaaattttaatatatggtgtgcagttctggcaagaaagtttagtcctttggtggcatcccactgatctttgagaaactcagaaattctcaaagtgccagatgtaaaaaacaggttgctctattcccttcacttctgtagctgtctccagttttcttgctctgctctaggagatctactgtctaacagacaactaactaggaggatggtatgccaggctttcttcttgtcagaaatccatttctaaaagtgtcatatgttttccaattttttgagaagcagctcccctgtccctttggggatgggagttaataatttttctctaagagcttatagtttctacaagaacaacaacctgatatctttatctccttaattccatactgactcaccttctttcctggattgggaaggaaagtggcattgtagctggtggtagagttaatgctggttctccaatcccataaattcaggagtaagtgtgggggaatgcaatgcttgccttaactgttaaccagctttctttaaaacgttaggtagttaatgcctcattgtcctcaaatttgggccagggttactgattcttgggcactggattacatttcccttaaccactagctatacatgcttaacacaaaatccctccactagcatcagatgagtttgtgggtttggaactttagagtgaaaaagcacttagcaagatttgatttcactatatatttgacattcaactcaactgttcaacttacctttttgtgaggtgagggaatttgactaaaatcagcaattgcttacccaaacgatttcaggagctagaaggaaaagtaaatgcaggaagtaattattttgaatggggactgtgaccagtttgagagtggtaataccaacctgagtcgttgaattttaggccttcttgaagcgagtttctaagctctgagagatgttttaatgtccattccacatttaaatgtccatatatccactctttatgggcaggtagataacatatgagggcatttttcccttgtcataatgtttgggagtgggtgctactagccattttagtaagtagggatcagaaatgtgatatatgcaattgtcctttgtctcccatgattttcaaatgatacataaggtattaacgcagaaactgttcatattaacttgagcataatccaaattctgctttatatagagcttagatagacagacagaagagtaaagtattttgcatattttccagaaatacaattgctatttatattgagtaactattgcactttattttgtttattgttttccatcattatctagattcagccaccctttcagaaaatcatttcagcgatagcaagttgctgatagaatttgagtccataacacttcacacttaagtcaggcagcatttgtagtttttaactcatgtgattatacagatagaggtcagcatctgactatttcatacaatcttctcatgtagtcatgcctgaatatacataatgaacttcagatttcttcttaatgaactgctttcttgttatttatacttaaatttcagataaggcattatatagactttttcaaaaagctatttgtgggaagatctttatatccatggtcttcatttcaggtggtaaagcatttattacaaagtactttttataaaaatggaaaattgttttgatagcactgctctatatccactgtcagaggtctacaaaatctcagaggtcatcaatattctaatgtatatatatacacacatatatcagtcttcacctatcccttggccatattctttaacatgttatggttctcaggctataatattctcttagtcaccaggggcctaaagtaatctggttttacttgtagcatagtaaaaacttcaacctgagactgactgccagaggacctattcatttgatggtttcctgagtaggtacagttttcaagtctagatttaatatgaaagaagtatagccccctaaatattgtgtatggttatttgtagatatattcaaaattattgttttgccatgattaaaatatttatgagactgaggagattttaaaatttaaactaataaattggatcaactcactgttaactggtaaagcattttcatcattataaagagaatgcatcatctaattttcaaatgttttatctttctaattgaatttctaattagcacatgctagtaaaatgaaaatattaatgagatcctcataggtgcttaatatagtgatatcaagtactatcatacatatgtgtgtatatatacatatatatgcatgtgcataagttctgaagaaaatttttattatgcaagataattaagtgtcatttgacataaaaattttgcaaagaggtaaaaagtggcataaaattaaagaaagttaattatctgatctttctcctttcggcaatttactttcttttgtccacagatcaatcatcctaatgctcatttctttaattccctttaattacaactgagaagtaagcaagtgagatagtaatttctactgaaatttccatgcttaatctgcaaatgtagtgagcactgatatagtcaaggaacagtgtggctgttgtgagaaatagaaaatggaggacaggaattatactcagtttcccccattattcagcaataatagaaaaagttaatttacattttcttctttaaaatgtacattttaaaatttcaatacatttattgaattgagcaacaaaagtaatgtgtagggtaggcatttctgtaactttttctccctattttgtattttcatttttctgtattttttctgtaaagttttgtatatatataaactaaactaaactaaacttggaggttgaaataaaacccagattgacactgtatatagacagcagtacaatccagaaggaatctctttatatggtcagtgagaaacatttctatttttaacactactaaggggctccactaatgaagtttgtctggcagaggatgtgacctcagtattttataacacagaaatttctcctcaaggtagaaagctggctcgaagaaacctgtgactgtcatgtccctgaggggtgctttagagttcatagcttcaggatatctgtgaagttctgaaattgcaggcaataatttaagcattagtccccatgtttgtgtgtgtgtgcatgtgtgtgcacacctgcatgatactttggggggaagtggcccatttggtatgatccagttctaaaatatgattatccatgaccccctcaaagcttaagatcccctgaaatttcagctttctgcttttttgcaggcaaagatctaatttctcctctcttttaagtgaattatcctgccctttaacaaatagtggcgatacgttattttggtctttacaatccaggaacactattggttttgacaggctttgctcaaataaagactagtttcacttcatttccaaggcattcaactctacccaagtgacatttgtgaaagccatatatttcatttgtgcattccaatgatttaatttagtaagctcaataagcttatctctagtcaaagataacatggcatttatgactgtagagtgcgtgattgaatgggattcttcctgcttcagtttcaacttagactccattttgttgttatcagacaccaaagatcccgtgagaaaaattgacatatggagattttaaaagacactggttgaaactcttaattccggaactctttcacgtacttaggaaatacgcaagagagtcatggtctcaagagaaggttttaagaaaggggttattaaaactattgctttggagagtgcacttcacatgcaggctgttccatcctcttttgggggagaggcattaggcaggggtttactttccagtcccaatattgaagagggtgggcttctaggcatccaattgaagatctttgaaatagtcaaaaaaccttgaggataagtgcctgatcccaacaaaggaagctaaagcagttagtgttctgaggtcttttcttcccaggaggtccaggagaagagagagggtctgactaacagtgctggtggctgagccgggagatgctgctatgttgagattggttcactttctcctagcttgtcaggacaccggatgtgtgtcctgattgtttctggtgaattggatgtgggctatgtggtacaggatcctcttgggcctgtccatttgggatctcaggagggataagggctgcaagtgtattgcgggatgcccttggacaagggaagggtcagaagaatccacatatagacactgatacgcccaagacaagggaatttcagacaagaggaggagcagggaactattcccaggctcctataatcaaaatcatgagacagagagagtagattttaatcatctgccaagtttatgaagaataccagcttcactgatctactctgtccagatagcacaaagccacccaaagtaaatgtggcacagagccaaacagcagcttgcaagtgcaggaagaaagggaactgcagagagtagatagtagaggcaccagataccaccttagcccattttcctcaagcatctaattggggaaaaaagagatttaaggctacatcaagattggaatattttgagtatctatcttgtaatggacattctaattactggactgaaaggcatttgcaaactaaagtgatcatattgtgatatattccctaagaatgtgcaaaaaaaaaaaaaaaaaaaaaaaaccttgggacctacctgagcttctattcagggatggggaagatggcctgtatgtcttttcctaacctaccatcccctaagtgggagagaaaaaaaaaaaggttgtactttattcatatctgaagaccagtctgattatcatatgagttacactgcttaacagaatccaagcagtaaatactatgattgataattgtggtgattaatactgaatgtcaacttgattggattagaggatgcaaagtattatgcctgggtgtgtctggagggtgttgccaatggagattaacatttgagtcagttgactgggaaaggtaaacccatacttaatcttggtgagcacaatctaatcagctgccagcatggccagaataaaaagcaggcagaataacatgaagactagactggcttagcctctccgcctacctctttctccagtgctggatgttccatgccctcaaacattggactccaagctcttcagctttgggacttcaactggcttccttgctcctcggcttacagatggcctattgtgggaccctgtgatcgtgtgagttaatatgccttaataaactcacctttatacatacatcaatcctattagttctgtccctctagagaactgtgactaatacagattttggtaccaggagtggttctagaggaaaagaatattaaaaatggagttcttttgttggttttcaggtttctggagttggcttcttaaagtgattagccataaaaatgctaaggactctaattctaatagtatggagaacagacagtccttggtgtgaacaatttagagagttattatgcaaaataaatgcatttgatactcttgattcaccgctcatgaaaggcaaggagtttagtgactcaatacctaatacctttgaccatatgtggagaaccaaggaacataatgaagttggttggttgctcctaagttcactggacagagtgatgaaaaaaaacgaactcagggattctaactaactcctggcttcagaagcagatactgagcctcaaatctgctaagattgccctgagtgagtcttatctcctgcagagaaagagctgaaattgtggaaaatcagacacaggctattaccatgtgagtggttgacctgcaacaaaaggtgcacgcacagcctcgccaggtgtctactattaaagtgagagcattgattggaaaacaatgggaccttgcaacttggaatggggatatgtgagaggactttgatgaagctggggacattgagcttgtaaactctgatgaaccttttctgccagaaggaacagcttccccatccccagtagtggtaacatcccctccccaacccatgctgctattagcctttccatctttgtctgaggagatgaaccctgctctgcctgaggcaagagtgatggcctcccctgaggcagttgctaggcaagataatgttgattctcctcaggagcccccctccccccaacacccctgcttgcttctagacttataactaaagttttggcaggcccctagaggtgaagttcagagtgtgacccacaaggaggtgcactacactcgaaaagaactccttgagttttccaatctatataaatagaaatctggagaacagatatgggaatgaatattaaggatatgagaaatggtagaaggaacatacagttggatcgggctgaatttattgatttgggcccattaagtagggactctgcaattaatgttgcagctcagggagttaataaaggttctaatggttaatttgcttcattagctgaaatatggattaaaagatggctcactgtgagagaactggaaatgcctgatttcctcccttggtttaatgtagagaaagggattcaaaggcttagggagattgggatgctggagtggattagtcactttaggcctactcatcccagctgggaaagtccagaagatgtaccttttaccaatgctttggaaaacagatttgtgaaggcagcacctgcgtctttgaagagttctgtatctgttgcttttctccggataccatatctaacagtgggaaccatagtcactcaacaacaaaatttaaatgcaatggggataattggaacccaaggtggcaggagccaagtggtggcactcatccatcaaaggcacagtgggcatagctaccatcatggacaacagaggcaaagcagcaatcgggatagattgatttgtgtagagctctggcattggctagttaatcacagtgatcctagaagtgaaattgataggaaacttactgcattcctacttaatttaaataagcagaaaacttccaggccgaatggacaaaagactaatttgaattataaaaacagagcatcatggcccctcaattaattttcagactagagccagtttacagaaccctttgcatgaaggggaggccaggtccccttgaggaaggaccccactacactaccaacaatttatgctgttaatctttctcccatccttccccaaagggacctttggcctttcaccagggtaactgtgcatgggggaaaggaaatattcagacatttcagggattattggacactggctctgagcagacattgattccaggggacccaaaacatcactgtggtcctccagttaaggtagggggttacggaggtcaggtgattaatggagttctagctcaggttgaacttacagtgggcccagtgggttctgggactcatcctgtggttatttcccctgtgccagaatgcaaacttgacatagacatacttagcagctggcagaacccccacattagctccctgacttgtagggtgagggctattatggtgggaaaggccaaatggaagccattagagctgcctctacctagaaaaatagtaaatcaaaaacaatatcgcatccttggagggattgtggagattagtgacaccatcaaggacttgaaagacacaggggtggtgaaccccaccacatccccattcaactctcctatttttcctgtgctgaagacatggatcttggagaatgacagtgtattattgtaagcttaaccaagtggtgactccagttgcagctgctgtaccagatgtggtttcattgcttaagcaaattaacacatttcttggtacctgatatgcagccctttatttgtcaaatgcctttttctccattcctgtctgtaaggctcaccagaagcagtttgccttcagctggcaaggccagcaatatagctttgctgtcctgcctcaggggtatatcaactctttggctttgtgtcatagtcttgttcagagagaccttgatctatttgcccttccacaagatatcacactggtccattacattgaggactaaactctgatttttttttaacttgcccaaattcctatctaagctatctggtgagtcatgccctacaaatcatacattctcatcagatgggttttatttaaccctatatatcgtaactttccaacctgactctggcataacattactagacaaagaagaaaatcaaaatattttacccccaaaacacatttctttgatatattttgaagtagccctggaaagctgttctttgttgggggaaatttgcatatgtaaagaatctctattaacatagctagatttttttcttccagactctctcaatcctaaagaaattaactaaaatctgaataggaaacatttgtcatctgttgtctcgaagggcagccagtataaggcttcaaaataaccttagtctccacaatcttttatcttaacctgaacattccctttctatcaatcccaggtctttagacacaaacaaccaattgtccagcagaaaatatttaaattcacctatagcctggaagcccccactttgatttgtcttgcctttctggaccaaaccaatgtatttcttaaatgtgtttgattgatgtctcatgcctctgttaaatgtatgaaaccaagctgtgccccgaccaccttggtaacatgttctcaggacctcctgagtgctgtatcatgagccatggccactcgtatttggctcagaataaatctcttcaaatattttacagagttcaactcttttcattgacaacattatgacattatgctgattggatccagtgagtcataagtagcaaacacactgggctcatgctcatagaattcatcttaccatgttccccatcatcctgaagaagctggattgatagaactgtggaatggccttttgaagtcacaatgataatgccagctaggtaacaatactttgcagagctggggcaaagttctccagaatgtcgtgtatgctctgaagcagtgtccaacacatggtgctgtttctcccatagccaggattcacaggtccagaaatcaaggggtggaagtggaagtggcaccactcaccatcacccctagtgacccactagcaaaatttttgcttcctgttcctgtgacattatgttctgctggcctagaggtcttagttccagagggaggaatgctgccacctggagacacaataacgatttcattaaactgggagttaagattgccacctggacactttgggctcctcctaccttaaagtcaacaggctaagagggggtaactgtgttgactggggtgattgacctggactatcaagatgaaatcagtatactactccacaatggaggtaagtaagagtatgcatagaatacaggagatccattagggcgtctcttagaatcaccatgccctgtgattaaggtcaatgggaagctacaacagcccagtccaagcaggactacaaaatggcccagatctgtcaaaaatgaagatttcggtcactccatcaggaaaaaaaccccatgacctactgaggtgcttgctgaaggcagagggaatacagaatgggtagtagaagaagatagtcactaataccagctacgaacacatgaccagttgcagaaatgaggactgtaattgtcatgagtatttccttattcttttgttaaaaacatgtttgtgcatgtatacacttgtactagaaaatttcttcattttatttccttttttcctttatcatgtgacataagatttattgacttcatatcagcgtttaagtgttgttaattttgtgtaatagcatttgggttgtggattggtgcatttctggttgtattttgttaggtgtaattatgaccttattattgtctttatttgaagattacatatgatttcaggaaatgtgtatgaattcaagttgacaaggggtgaacttgtgatggttaatactgagtgtcaacttgattggactgaaggatgcatagtattgttcctgggtgtgtctgtaagggtattgacaaaggagattaacatttgagtcagtggactgggaaaggcagactcacccttaatctgggtgggcacaatctaatcatcggccaacacagctagaataaaagcagacagaagatcatgaaaagactacactggcctagcctcccagcctacatctttctctggtgctggatgcttcttgccctcaaacatcggactccaagttcttcagctttgggacttggactggcttccttgctcttcagcttggagatggcttactgtgggaccttgtgatcgtgggaattaatactctttaataaactcccctttatatatacatcaattctattaattgttctgttaatagttctgtccctctagagaaccc

SEQ ID NO: 2392 - DNA, 3925 bp, Homo sapiens
gagtgagaatatgcggtgtttggttttttgttcttgcgatagtttactgacaatgatgatttccaatttcatccatgtcctacaaaggacatgaactcatcattttttaatcaaataataaaatcttcactttttacttcttccccttggcgtcttttttgcgttagtattttccaaaacattatctcatatgagtgttcaaatcaatgtcttcaccataatgtagttatgtgtttcctactaactgtaggcaaaaaaaaagttactgactctctttctattatgatagcctatttctttcttcctataaataagaagtactaccagcatcatcagttagttactgagtacttattttatgttaaatcctgaaaatacagggggaattataaaaacattgcatctttccttctcctggtgatgttgggtcaccagcacatatgagaaaactgactcaaagttgcccaagatggcagagtataccctggaaaacccaacttgtatttttgtaaatggatgtgctagaacaagaaaagatgattaatcctctgtagtaaataatttaccacattctttgtagcttcaacactttaggactaaggcatgcctgccatggaaaattcaccaacatcaattttgaactcatagtataatttgaactcatcaattttgaactcatagtcacccagcaaagtcaatgccacaagatatgttattaaaacttttattttcttaataaatgaagccagaattatttttttaaatttagtctctaatttttatacattttttctgcctgtcattcaaaagatagacagaatcagtgtgccctaaaagaaaaaacatcttataaaagctttatcttcagtcccaaaatttatcaacttgggctcagagaggaggataaataaaagagctatgaaatactggaattgtaggaacatgtatagttttatagtcttaaacaactgcatagattttattctgatgcagacatcacaaatgtagaatgaatagacgccttactttgttactcaagaaagacttagaagttaatatcatatgttttatcctcactaattttaaagaatcataagatggctatcatactttcattgatttttatatgaatataatcaggcaatgcctaatacagaatactacttccttctcatatcaaacttggtgacaaattcatattcacacttccattctcacagaaggaaattcttttttactttagaagctttatccagcagctgtctgttgaaaaaaaaagtccagggagtgggtttttagagaattataaatttccctagtagtttacaataaatgcagttctaatatctgaaaatgtgtttatcacttcttattacaactatttcagcaggagtgcctcttactacttctgcagagtcaacattcctgaagccccttcctgtcaagcctcctacaggtgggattaaagacaagactatgccttcctctcccagcagtgatttgggtttgaataatccgaacaaattttgcaagctctatcctgcttcctttaatagtccagtaatgactcaacaacattatgttgggaaaaaaaaaaacacaaaagaaatgaagccagggagacatttttagacaaaataagagagaaatctcttccagcaaaatcaaatgcaaatggtaaacataaaattatcccaaaactttttcataggaagtttgtgttttataaaacatactagcttatttacataccattttactcttcttgagtgagaggttgatagtattcatggaatcatagaattttataaggacttacaagtccatctaacttgatctgttcatttcctaggaaatgagaacctgaatggtttagatgacccctcttaattttagaatcaaacataggaattctcatggtttcatgttattttaggtaaataaggatccttaggtatatacataaggaagcattttaaattaatatcatgtggttatatcattcttactaagtatgttttaagtgtctctttggtgctaggctagtcactcttgggaatacagttccctaaaggagcgagcgtgtaaactagttaggttaataataatacttcattgcaagagccgacaggcgcatttttgtgtacatatttttggtaactagataagtgaagcataatggtccagaaaaatcttcatatatttagatgattttcagtggatagaagtgggaagaagaaaggatgaaccaaagggcttggagctaagagtggcaagaattcaggcacagtaaagagactgatcctgactggagtgatccacttgctcttctaaccatatttttttttcatttttccccccacaggcaccttctcactactagtgtattttattcccctttcatattctctcttccacccacttcttttcctccactcactattatttttcagttctttctttacccagcctttctccttcatgtgaaaatgttcattcttctctcctccttgaagctctattctttgtcatatgtaactctttatgctctggttcttctctatttctgtttcttttttgttttctctatgggctctttttttattcattacctaaatgtaggtattcccatggtttcatccttgaccttactctacaaacacgatttctatttccctgatttcatttctcatctgtatgcttatgacctttctgtcaagtattagattcacatatccaaatggcagctactgcttcacctggatgcctcatagccatttcaaatccacctagtcattcaaagtagaaacccacagctcagatcttattagcacaggaatggctaccataacgatatggaactaaagtatgtatgtattttttatttattatatttgttttgtttatcttactaatttttggccccattattgcactcagatgcctcaccttcacctataactcaacatacctaaaacggaattaataatctctacagtcaacttgaatttcccaagttttctgtctttgctagtagttccaatgtttattagtcacctacacttgaatctttgaggctgtctttgactacttaattatctatatcctatccattagcaaatcttatcaaatcttagaactatttctcctttctgtagccattcattacatttctactaccatcacctcacaccttaatgctgtaacaaccttctggaaagcttacttgtacctcattgttattctctcactccctagtagcaggatttcaaccctggatcagttccaccctatacattttctacttctgcataaagcctactgagtgatgctgtggaaaattataaactatagagattgggtatgttttcagagtcttggtacctaacctctttggacctttagtcctacttaatctgtttccttttccttcactttccccttagcgacaattttaaacctatatcattcttcaagactctcttcccccgctacactccttctcttcacacttctcagacaagctcctttgtgatttcatcaagaaaaatttggccatcagatgtggattactaccaagtatcttggtttaactaaatcctcctgtaaccctgagttctcctttaactcctacattctccccttcccttcttaaccaagttatttttaaaatgtagtacactcttactgtctccacttattatttactcaactcactgccgttctttgggtgcttattccctcagccttcacaccaccagtctaccacctcactgtaactactactcacagtggcaaagtgacttctaaatttgtaagtccaatgaacatctttatttagctcctttgacatcactctctcctgttcattcttataatttgctgtcctttgctttggtggacttttcataggctcatctttctc

SEQ ID NO: 2393 - DNA, 1830 bp, Homo sapiens
agaagaaagatccaacagggttgtcttagtgcatttgggctgctatagcaaaatgccatagattgtgtggcttataaacaacaaatactgatttctcaaagttccagagactgggaagacgaagatcaaggtgcaagcagatttggtgtctgatgagggcctgtttctcttagatggcaccttcttgctgtgtcctcacatcgtgctggggatgaacaagcctctgggtttgctttcacatgggcactaatcccattcatgagaacagttataatttaatcaccccccaaaggcccctacctcctaatctcatcatattgggattaggatctcagcatatatatctggggggaacacagacattttatccatagccagggtcttccaaacagaggaattagtcaaatgtcccagagagaaagagtatactacacacatgcaacatctcatctcacaggaaatgaaaccactagatggccctgctcattttaataaaacatcaataaggaatatgtaactctttaaaaaggtagccgaccaagtcaatatatcatactgataggaccttgggttttgtaactttggctaagtgagattttaaaagtacatcatttcctgaaagacaccaggttgtaaaaaaaataaaacctaagtgaaggtgtgactttaaaaatcgtgttgtagtaacaccaggagttaactcagcctgatgatgagtcctgaggccagaccaaaaatggatcagccagtactccagatcctgcagccttggctgggccaagcacgtatactttttctttcgggtctagtaatattactccacccctgggaagaaataaaaatatattactgaaaccctaggaagatattaaaataagtatactaatatcccccaggaaggtataaaacaagcacataaattgtcaaagaaatgaataagtccattgttctgagactttagaataggttcaagtgtaagtataatattaataataagctttgtagtcattgcatttgtgaaagttttatgatatttgaagtgttggggaaaaaatcggccatagtgaatttataattgcattttaaatgatttaagataatgcaatcaaattatagtcatcttaaatcatcaagataacttctttttaaaatttgtattgacataacaattcttaattttttgcaccaagtaacagaagatcaaaatatatgaagtaaaaactgattgaacttgaaagaagaaataggcaaatttaatcttctttcagcaattgatagcacaagtagaatatcagtaaggacatagaagacttgaaagacacaataaatatcataaaccaaacaatctttctgtttatattcatagagtattccactcaacaaccacataatacacattcttttcaggtgaatatgtattaaggtagacaatattctatgatacaaaacaagccttaataaattgaaaacaattcaactcaaagtatgttttctgactataatgaaattaaattcagtaagataaagatacctggaaaatccccaaatatttggaaagtaacacacataaaattagaatgcattttgaaattaaacatattataccaaatatttcaattcaagccactcttgagcatagacacaaaacttcttagcagtattttagtgaatcaaatccaatgatacataagaagacaagaccaagtggatttcatccatgtaaagttggcctaacatttgaaagatcaatcaatgtaactcaccatggtaagaactagaaaataaacattaaattatctgaataaatacagaaaagatacttgtgccacc

SEQ ID NO: 2394 - DNA, 6133 bp, Homo sapiens
tctaaacaattttttaaaattttaaagaattttatgtttgtaaaatggataaagcttgaggccctaagacctgggtcaccaacacctaactctttcatctcctatagaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctgattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaaccttggttttcaagatgtgtcttctgcgtatttgaatggcctgtgtgtgactgagtccttggtgcagggccccccactctggagggcaacagtgtggcggggcaccccggctgctgtttttggttctttatttcatgagttctgtctttaagcttttacttcttcattttcaagtggagaaacatgaacatagtagcaacaattcatttttatgtatctttaaaaaagatgaccatctcttagaaacaagttcttttagaaagcagtggcctgttctagagagtgctgttcactcccatgggaacaggaccctggagcctgcagtgcctttgaggctgcgtttttggggtgcagatgctttgcggggagcccagggccatgtgggatctctcttctcaggcctgcgtcctgggcagctggattccctggcctttctcgccgacctcatgggtgagtgtggactgcagtgtcgcctactccacccttgctggggagcatggatgttactggtgcccactttgcccccgccttcccccctgcccccggtcttgcctggtgccctcagagcctgagcctctcacccacacctgccatgtaattccggtcctcctctggctgtctcacaggtgagggaaacattctgccctctgtcactccaccaatttagttttagccattaatttgctttaggtttttttagtcattcttcagtttatatttgcttgatcaaccaaaagaccagccagcagggcactcttgagtcagctctgaagagatcagctggctaagatgatttttccagtgctcaacattaacttgatcatttccccccacccaaaaaaaaaatgcttaactgcagagagcactctactctgggtgacagagtgacgccctgtaaaaaaaaaaaaaaaaaaaaattgctcagagtagtccaaaggttgtttaaacagcgctgaatgactgagagagcttgctgcttatttttttccttccagtagaaaaacagttatagcccagctgatgaggtagaaatgcactgagcaggtctcagccccagcggaaacagagtagccctcgtcatccaggtgctgtgttgcttggtaaaagtgtgtctgcctcgggctgcgacctgccacgtgaactctctgacccagcaccagccagaatcaacatttggggattcagactgcagcaacaagtgattcccctcttggcctgcagttctgtaatcccaaaattgtttctaattgtggatatgagacatcaaaatgagggctgaatcagatgaaattatgctcagttcagcctcagatttaagtgatttattgttttctagttcttcagacctaatagagctgctgtggtggctctgtcagtggttggcagtggccatcagccctcaccctgccattgggggccttgtgcgttggcatctggttgttgctagcagccctgagggggatggggcaggccaccgccacctctcactggctgctgggctcaggactggtctgctgttagggaagctgcaagtccagccagttgactgcacctatttaagaaaaagcactactctgttacctgagaacctttgagattcctgttgtgaaggaacaatcatatggaaatgaaaacttaagcttttagctaataacagaaaagtgaactagcttttgtcagttgttcaaaagtgtaaaattctactgaaagaagacagctcaatatttcaaacgctggagctgtgttatttggtaaccaagtagagacggcgcccggcagtaatctgcggctgctcagtgtggccctttcactgaggccttggtccacagcaccagccccgagaggggtcccagctgccgaccttcaggctttcttttctgtttataaagtgagggtattctcagagagctttgaggagaaaatagtgaagcttgaaggttgttggtgaagctgtgaaatattgaacacttcctaatcttagattaggttttctgcatcttagatgagtcttgaatagctataaccaaaggctcttgtttatttaaacactttaattatagagagctaaaggcaggaggcacagggtttgggtgggtgaggggctttgcagaatacagctggtgctcatcagcccctgctaggaatttaggactcactggtgtagttgctataaaagctgccacctccaggaagacaactatgggtgtttaaagtggtggtggtgtagacagcgacatttccagtgagctttaggcaggaatgcagggagggccttgggagcgaggcagcaggcgggcaggtgtggatgggtccatgctcagagccatatcatcacccccaggcagcatcctgaagcccactgagaatttgggctgagtgatgtgccccggagtgggaggcagctggcaccacacgtttctctggtagcttcttcggctgtggaagtctccaggttaggggctgatcaccaccacttcgtccatgaccctctgtctcctgtctttagaggtcagcggaacggttccgtggagccgccctcccttaagcccagatgctcacaccgagcttcctgattgtccttcttgtcatggctgtgttcaagatgttctttctgtggggcgtctcttccttgctgggctgacagccctgggacagcggggacgccacaccctggggcacaccgcctagggtcccttgtgtggtggggggccaagagagactgctatggaaggtgatgttgactgggattaccagtacaggtcctgacaactgtaaggtcacaattagtatccagcatgcctgtctgccatgcatccctttgcccatcctgagctggcgatgatgccacatgtgaggccctgtcctggactcaccatgtgggtgtttgcagctctgcctgagagaccttgttcctcatgcacaataggaagcagcaggcctgtctgttaggactgctgtgagtcactgcgatggcccaggagcctgccacgttctgaggtcatcagcacagcacccgttgttgttactgggagttaacatgcaggggggactccctctaacggcagcatgctgagtactggcagcctcactgatccggtcatgtggcctcgggagccgcacaggcttcatgggggttttgtggttttaaggactgtgagggttgactgaattatatgcactcacttgtcatgtttctgggctttttgtgcccttttccctggtactgcaggaaaggaaaagacaaagtactgtcaagagcaattgctgagcagatttgatgtgatgcagtaggatgagacatgatactgggatcacctcttccaggtcaccgcaagggtttatactgctccatgcctgcagtgcttctggctctgttgcgggagcacctgaccccagtagccacagccaagaaggttttacttttaaatggcatcggcaggtgggtaagagttgatgatgctgctggcaggtgagggaccggctgtggacttccatcgccggttccacctgccctcctgggccagggtctctgagatcttggatgtggatttcatctccttgttgtcaatacctggtgcttttatctatcatcagtacactgtacttttacttctctgctatgttgactcctgagaacatgagatttaacaatgcatttattttattaaaagccagtttttcttggcaatctgtattttttaacacaagacagtctgacattagcgcactggtgttggcggcctctgataaggcaaagccaccttttgctgctgtgttgccgcaagaacacgggtcatctggtgatgcggacacgttcccgttggagctggagcgtgtccccctcgctgctgtgaagaagcacagtaagatat

SEQ ID NO: 2395 - DNA, 2130 bp, Homo sapiens
acttggaacttggaacacattttctgataggcatcatgctatgaatggcagacaggttctccagccagtgagtaaatacccgtcagcccatttgtaactgagctgggagttaggagccctggattctggtttcagctctgtcactagctacctatgtgatatgagcaaatcctttagttactgcccctgattttctcaccccaagtctgattatttctctctattggctaatatagaatttaattgccattaggaatactttcataggaagctatattccaattcctcatgtgtaatgacaagaatgcatctcttcgcccacccgaggcagaggcaaggaagttctgcccccactgtccccagcagcccagagcctggctgcagtagttatcgggcaaatggggactcagaagagagctagagctgtgatattggcccctctggcatcagggcagcagggaaaatgggaaggggtccaactcagctataccaggctctgagtcaagttcattttcagagtcaggagattggtagtggtgtgtggagtgggcaggtaggagaggtcaccaaggcaagtttggggaggggtgtcccagtgtgtacagctcaactttctagtgcatggggaattctgtaaagaggatttgaccagggttaagggcgatatcaaaagcaaactttaggatatttaagacctttgcctgacttttacagtctagaacttcatggcaactccttcaggaggctaaatttgagttctatatctccattttgaaaaggagaagcctttttcatgccttttgcttctgaaacaccttggacatctgggaacattgaggatggagggatcctctgttttgctgtgctgcttgggtagcagctgtgacccagctcctatgccttggagtctggggaatacccagagaaacaggaggacggcacaggagctgactcaggggaagctgcagtgaacagcacatcccctcctctccacttctttcctcccatcccctctgtttctctctttcccaccacaatgaggtttcttttgttcccaaggtttgaagcctcagacaccagtgtggtattttcactgggacatctgcaagagcacatgggaggtaaatttgactgttcagcaggaagcaggaaatgtgatttgctggaataatttgatggaaaactctgagctttctggaagccacagggggtactgtgggagggcttcagcaagcccagggttggcaggtgattcaggtagctcttgcccaaccgtctccgtctacagaggaggaatctaagacccagaaagatgaactgacttcgccaagatcatcaagctaggaggtgacagaggaagggcagtaaccccactatttgtcattattaaagctcctggtacattttcagagaagaggcattaaggagagatggctcaaagggcatcttcatcagtgggaaaatacgccgtctccccagtcatcccaattagaaagtatcaagcggtaatcagtgtgctctgaatatgcggacagcacagattcagcacctgttttcttcctttgctttttcttttttaattttggaaagatttcatatcaatgctaattctgaccagatttatctcctccatcctgacttccctcccattttcttgtttcttatcttcagatgcctatcacacatccccactcagaccttgcctttatctcaaagcacggcacaggccagttgaagtgcttttctccttatacctggactttggctgcagctgtctgactggattcctggccttcagtctgtccctgacttgggtaacactggagtctattgctagcgtgacaaagacaaagatatgtccaaatgacctaagacggaggttcaaaagtacagagaagtttctatatactctcttcatttcacccttccttgaacttcaagatgctcttgcccctggcttattctctcaaacacatttgcattttgctgccactgcttcaactggggccctgggaggtatgtatcccttagcttgggccagttctgcccttctttttccaagactgtttcatctttcctagaacctcctgtctcctcctcctcctccttgtttgaggcagggaatacacc

SEQ ID NO: 2396 - DNA, 2015 bp, Homo sapiens
ggcagggtggggtgacctgggaagctgtcaggagaggctaggaagaaggtctccttaattcacaccccgactgtccttagggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtcaaaaaaaaaaagaaaagaaaagaaagatttttaagaattcagcaaaaactcagccagctctttctatggggcagttgctaatttagttctaggcaaacgtggacacattaaattctcctacaaaccctccacagcgtgc

SEQ ID NO: 2397 - DNA, 1113 bp, Homo sapiens
taagaaacacagattcccaggtcacctcatagacagggctgcactgggcctcctgcctaggcctgttcgatgaagcaccaacaagccccacagctttgttgcttttgctatgcccactgggaccagtgagagaagtgcggtcttatccctgggaggagagaaagagccagcatctgcaggcgcccacaggatgtcaagaaactgtgcaagagaggaaagaacatacatttgagagcccaaaagaccagggtttaagtcctggttccaccaattccttgctgttttggtcttcgaacagccattgaacttcaagcctcagtttcctcgtgtgttaagtaagaacagtaccacccacttcaccaaatcattgtgaagatcaagtgagatcgcagtcatcaatgtttttgtaaactgtgggccaggcaaaatgaaaacttcctgctcagagtttaagcctgtgtcacagactgggtccccaggaaggagactctgagatagatatttacttgcaatggtttattaggaagaactcataaaattacacttgagggctgggtgcggtggctcacgcccgtaatcccagcactttgggaggccgaggcaggtggatcactaggtcaggagatggagatcatcctggccaacatggtgaaaccccgtctctactaaaatacaaaaaaaatgaaagaaaaaaaattagccaggcgagattgtgcacgcctgtggtctcagctacttgggaggctgaggcagtggagttgcttgaacccaggaggcagaggttgcagtgagctgagattgtgccattgcactccagcctggtgacagagcaagattctgtctaaaaaaaaaaaaattacacttgaggaagggatggggagaaagcaggattagacagagggagaagctgagctgtgatgcagtctcaatgagcatcttacctgatgccatgggaaatgtgaaatggaatgagccttcagagttgttccagactggggaaaggggctcaggcctcaatgtctttccatggatcaatcattggatgtgaaccaccctgtaaagaaggcatgatctggagcaaggcagctctctgcagtcagggttagggcaaac

SEQ ID NO: 2398 - DNA, 17098 bp, Homo sapiens
ttttcattctatcaacccacaaagagtatagccagcatactgaaatgcacattggttgaaggttaaggacttctacaactatctctgctcagctgaaagcggataatgaacaagaacatcaatttgtgcaataagcttttgactaggagataaagtcttggaatcagctttgtgggggcagaacgaaaaagatggatttgatgtcgtgaaatggcaattctaaaactcaggagatatgttggtgtttctgagctcttactccagtgtccacttgtccatagaatcacctttcacttctggggtcagaggacagctcctggaatgatctctcatcttacggcaaaaagacagagtctcgcgctattgcccaggctggagtgcagtggtgtgatctcggttcaatgcaacctccgcctcccgggttcaagcaattctcctgccttagccgcctgagcagctgggactacggatgcttgtcaccacacccagctaatttttctatttttagtagagacggggtttcaccctgttggccaggatggtcttgaactcctgacctcgtgatccacccacctcagccttccaaaatgctgggattagaggcatgagccaccgcacccggcctctgtaatctatttttaacacagaagcagagtgatgatttcgaatgtaagtgatatcatgccactcttctgcccaaaatgacaaccaaatcctaacaatcaatttacgaagacttcaatgatctcacagcatcctctgttcaactttgtctcatgtcctggtattttatcctttcttctaccctgcaaccatacttaccctttggctagttcttgaggatactaagaactcactcttccagggatttagctctgtggtgccctctgtcttaaacactcttggctcagataccaacgtgacatatctctcactctttcaaggatttatttaaatatcactttatgggtgagaattcctttgcctgctctaattacagttgcaagaacatgtaccatcagcctggttgttcctattctccttctctgaatttttaaaaaatctacaacattctatatttttcttccttattttactgttttctaacttttccaaataaaccatgagaagacaagaattttgcttatagctgtgtcctcagcagacagaattttgcctgacatggcaggaggcattcaataaatatctgtttaatagaaatttcagatctgagataattgcatgagctataaattgtttcaaaaattacatatagatgtatcagtttttttcccaaattggccatgtcaaacactttatcagcgtgatttgtttttactggtagtgatgttaagagagattccatttgacctatttattttggaagtgattcgactatgagtccactgtctaaagaggttctaatcaagttaattattttttttatcagaaatcttccgaagttttcctggtttgtggtgttattcctgtataataaacctgggatggcaaaaaaatgatataaataagcaaagctggcttgcttctacccttgtttctacatatttctacatgttctaccctcattcttactttcctgtgaatgagaaggagctttatcagtgctgaagagaaaattgagaaatcaaaacatgtccttaggttacctccctgagagttgaagcttttagtaggaagagtaaagaaatgtaaatataagaggattttaacaatggttcttcacattcctttcactttacctctcaagtatgtggtgagagccttttttttttttttttttttttgagacggagtctcgctctttgcccaggctggagtgcggcgacgctatctcggctcactgcaagctctgcctcctgggttcacgccattttcctgcctcagcctcccgagtagctgggaatacaggcgtcagaccctttgtcttggtaaaaactccaaagtcctggcttacctggaaccagaggatggactatgagaacagagatctggagaaggtgggcaggacttcctatagcggaggctaaaatctttctgacaacttctctgtgattcaggaagcttaacagagtggaataaatctaagagtttggggaaaaagaaaaaaaaagcaacaaaaacactgttagtgatagagtgtacatccataggaaatgagtacgtgaggaggcatgtataccttggaaatttgatgtctttgcctactcttactcttcagcctgcataatcattattgtctattgttatcaattacatagtaataaggggtgaaatgatgttgaaaagtcaagggcttctcagttaactagagctgccttactggttgggttatttcactgttcgacttatacatttcctttattgttctttgttctttattttattgttttttgcttgtttgtttgtttataacatatgagttgctaaacacctaaagcttacagtaaaagagccagagaggcaacatgagctctatttcagaaatgagttcttatccttggttttacgtcttgttatctgtgtggccttgggaaagttgcttaacttcatacttcccaggacctactcagaaaggggcaggaacatcagttaatgtgttaaccatcagttagtgtgtcactctgatttttcaaagagaaactgcttcccagcggtgaaattcagtctcacctgcaatgttgtgtgtatatttaagccagttggcttggctcttgtgtgatttttatgattgatgagttttcctattttcatcatgatgttcctctgagagaagaaaccagaactgaggccagattgataacaatctcattatggccttattattgttctggtcctggagatccataacttggttttctattagcccattactcaaatgagactgttggaaagcaaaagcttctgttgtgaggcagcatgagccacctggcttttggaaatgcctgtttggatgcactgaagatgagaaagctatgtggagtggccagcacaaaggatgctttttcttccttgtgcatctgtattcgtgtgaggatacagtctccctggaaagagagatgcataagacctattaacatttagaggataaatgcacactcactaagaggtaaatatgcctattaacgtaagaaacatgcatcaatttcactggcaatctcacacaggcaaacactaatgttgtgaggacagaaagatccaagggcggcttgaaatggataggttttaatttaagaaacattataaggaaaaaaaagttgtgaccttaaaaagatgaagaaaacttggcattggaatctgaacaagatatctgcaggttttctgttcctgagatttcaagagcaggaaaactgagtaagaaaaggaatgagagaaaatctaccttctacattgcagattgtgccattatccatttaatcctaaatttaggataaatcataatctccttgcattagttcgctaggactgccataacaaagttatgcacagactggatggcttaaacaacagaaatttgttgtctcacagttttggagaccagaattgttgatttcttctgagacctctctccctgcgctgtggatgtcagtcttctccctgtgcctgtgcatcttcactccttagtttttttctgtctttgtcctaatttcctcttattataagggcaccagtcatattggattacggcttgccataatgatctcattttaccttaattaattctttaaagaccttatatctaaatgtagtcacatgctgaggtatattcatgacacacatgctggggatgaggactcagcatatgaattttaaagggacacaattccatctgtcaccctcctccatgaaaaatctaagtgatgggtcctcttagcccatttttcagaagagaaaaatgaatgttctgaaaggttgaaacgctgtcatattcaaacagctttaaaaaatacagagagtagctgaatcacagaaaacagtgacttgctctttccttccctccaagatgtcctttgcttccttgattaacatttaggaagaatggacctagaaaagggaaaaacataaaaacacaaaatcataatgctgctcctccgatttctgggtttttatgtaattataattactagtatactaagaaacaacccatgatcttgaaagcattcatttaatttctcacaaaactgtctaaacaatggaacttaaaataagtgaacaaatatttggttaaaatatttggataaattatgtatctgtgaatattttccacgtgcatacttaaatatgaaatattaagatgtgtgaggcatgtcataagaacaaatatgtcttgtttgaaaaaatgcaagtaaataatcttattttcagttttgtaagtttagagtttttcctacgaaacttcagtctttatggaatcctaatacgacgttcttatttctatatgggatttagctactataaattgggagaaattaagagtgacatctatttatcttgacattctatatatagttttttcaaggtaaatctattaatactgctttattcaaaacataatatggcacaatcaaagttgtatcaaagtctgttaggtagattcatgacaagtcatcattactaaattgttcacagtggtagaaaggggtgatggaaagatgacttgagtaaaactgaggaatccttcagtttattttaagctcagctacaaacctgtctgatgatactgagcaggctacgaaagctttccaggcatcagtttacttactagtaaaaatagaaatccccaacatgtaattagcaaattagatcatatgtgtgtaaacttcaagaatgtataaatgtaaaatattattgctattattattatttttctttgtctttcctaaggaagaaaattgtctgcttgtattctaagcactttgtaaacaaacactaggtattcaatgaacagggagcaaaatctagttctcagctagctgatagagtgagggagagagacagggtgggtggtttgtgattaaacactccaaatgttccatgctaaaatagatatcagtgtggtatgccctgggagcataataaaggacacccctgatggagtaagcagggatgaggagggagtcagaaagtttcctagagatgacactgaaacaaagttaattagtatgagcaggaggtagccgagtcaatcaaatactttttcatacagaatacattccataagcgattgctttataaccaattaaactcttcacacaaaatataatgggagacttaattatgttttgatataatttgtgatttttaaaaataaataaatggttggtttctttctacaagatttcctgtggattttcaaaaactttcaattatttctagatattaatattaatacttctaatgtggtgattctgacatggcaggttgtatttccaaaaacagtcacaacatttcctattttgcatcttcctctacaatgtgactttggccctcctttcatggaaggatgaagcctctgcttcttcccttaaatgagagtgtgcttccaaatcctttaacagatagagaatgccagatatgatgctgtataacttctcaggctgcctcatgaaaggtgatgcacctttgcctttttcactgaaatacctgtgcttggaacacacacactttaaatatgctgcaactgttaaactgtgaggaagccaagctacatagtaggcaaacgttggggctctgaacagcaggattagtctttgatcttcccaggccaggcaccagccatgtgagtgaacaaccctttcgatggtattctttccaggctcaagtttccccctagcttttgagtctttcagccatagtccccaacatcaagtaatgtagtgtagacaaactatgccctgaggtacattatgaattcccaacctctaaaatccaggaacataattaaatgtttgcagtaagctgacacgttttgggccagtttgttatggagtgaagaatcagaataaaacttgacaccaaaattgtgatgctgctgtaacaaaaacctaaatcatgtggcattaactgtggcccaaacagtgggctgaatcttgaagggccttgaggagaatatcagagaacactggagtgctagggaggaaattgttacaggaggctgaaaacaaggtaattcttgaagtgcagtagcaacaagttttggtggagtcttccctgtgatgatgtgtaaaatagaaaataattttaattaactagtggatttgactgagaaaacttccaatatggaatatgaaataagatgattatttgatgtattttagctaacatatggatagagagaagtgagccaacaagaaattgtcgggttttaaagcaactaaaatttataggaattataaaggagccaggatttgttgggttattaaaaacaaagaacaaaaaacaaaaatgcaaaatcatgtgataaagagccactgggcaaaaataaaacacagagtacttgcagaataaatataaagccaaggttattattgcagaaatcctttgtaatactttagaactatattaggtggtacctcgtagaacctttaaaatagactgaggccttctaaggatctcaacattgtgctttacagaccatctctcttaaactatagggcttctgagaatctgaagagcctcccagaaacctaatccagagaaaatttgtagaagtatgcttagtctaatggaataaattataaatcaatatacaagaaacccaaaaagttttattttcatttatttactaatttttactaatttgactaattttatttatttactaaactaatttatttggagacagggtcttgctctcttgcacagacagcagtgcaggggcggtaccagtagagctcattgcccaggctgcaatgcaggggcagtgccaatatagctcattgcagccttgaattcctgggctcaagagatcctcctgcctcagcctttgagtaactaggactacaggtatgtgccaacgtggcatgccatttaaatatatgtgtatgtgtgtctctgtgtgtgtatatatatatatttatatatatatatatatatacacacacacacacacacacacatatatatatatatatatatatatatttgtggagacatgatctccatctcattatgttgcccaagctaggctttaagtgatccttctgccttgacctcccaaagtagtgagattacaggcatgagctgccacacctggctctagaaagtttttaagagaaaaggactgaaaggaacagatagtataaagagaaaatagacttttgagaaaccagattttaataggcagaaagttggctgagagggacacttagttacaaacatgcatcctatctaaaaatgtagaaaactgattgatttggaaggttggggcacgaccacagagtgcagagccaagagtcaagggtaacaattaaaaaggagtagcatggaattctaatcaagaactgatgatgtgtgcttgcttgcattttagaaattgttattatctggtgtcttctattttgtgtgcctttgaatgaaaatgactacagtggttgtcacgtgcctgtcccactattgaattgtgtgtgtgtgtgtgtgtgtgtgtgtgtgtgtgtgtgtgagagagagagagagagagagagttgggaggtatatagtctcctgtctctttagtttacagatttttaaattgatagaaactgcactagagttgtcgtacaaaaggggcttcatctgaacatggacctggttttgataatgaaatcttaaacttccatctgattccataatagtagaaaacttggaagtgttggggagggcgaatgtattttctaagttgaagggatgtaaattgttgggactagaagtcaaattggagagagttgtatcttcaaaagatatctataactgtattgcacgtatttatttatagtgtgaatttgcaacttctcccctcaaaatgaggaaagaaaaaaggccttgtgattgctttgagtatggcagaaatgacattcttccatttgcaagatgtgatccaaaaggtgatgcagattttgcttcacttattggaaaactcatacttcagtcccttcatgaaggcagtctaactgccgtggaactgctatgctgagaaaattaagctacgtggtgattttgcatgtatgcatgagagtaagcagttctagcccttgattcattccatcccaggcaccggacctgtcagggaaagaaccttaaaatgatctcaacccccaatcatcacattatggttagtctttaattcatccaagtagaggtcccatatgttatgacgcagagacaagcattgtgtaatgtccatgtggctgtccttcagaatgtgagactgtaattaagaaatttcagataaagccactaagtctgacttgatctgtgatgcaatactagtaaccaaaatggtacattttaaataaaaatgtattatatttcaaacctatatccatattgtaaaataaatccacacatatctaagaatataaagccaaaagtaaaagatctcttcacacataccctcagaacaaaaggagttagtactcttggtaaaagtagtccccgtttgaagctagatgtgcattcttccagatactttatacacttacatattttatagatactctcttttgagggataataataataatttgtggaatactattcatatggttcaaaatttttgccatttgaatgtaactggttatgttggaaatcgtaacattgcagcttatgtataaatatatatgattgcttttaacatctaaatacagaaatgagatatgactttcatggacattagcaatttttttcttcataagcctcttaagatactaataatattctttattactttttggtataaatgagtataattaaggatgaactaatcatataataattgctataataattattatattcactgttttagttgattttgaaagattaaacttagaacatttgtgtcagctttaggcactgtgtctactaagcttagaagttggttctgacctaatagagtctttattgtggatgtttataatttgtttaatcatttttgaattgaatagttttttttgaagtttctactgtgaaaataattttttttgttaaaaatgctgcagtttacatgcttgtaccttttcccctttaagtgcatgcataaatatttctctagaacacatatctgcagttacattttttaccttgataagtatgtgcatttttaaaattttaataaatactctcaaattgccttctcagaaaactagcaatttatagtctttataacagtgtttattcattgacacacaaagtgtgtttgttcaattgacacacaaaaatcaacagcattgtagtatgccaacagcaaattcattgaaggaaatccaaaaagcaatgccatttgcaggatctacaaagaaaatacctaagaataaatttaaacaaggaggtgaaagacctctacaagtagaactataaaacactgaggaaataaaaagattacaaaaaatgaaagatatcctatgtccctggactggaagaattaattttgtgaaaattactgtactaccaaaactaatctacagattcaatgcaatcttgcagtgtcatataccaatgtcattctttataaaaaagcctaaaattaatatggtaacaggaagtctagaatagccaaagcaatgttgagcaaaaaggaacaaagttggaggcataacagtacctgacttcaaaatatactacaaagctatagaaagaaaacaacatgttactggcataaaaacagacacataggccaatggaacaaaatagagaacttagaaataaatccatgtgcttacagctaactgatttttgcaaaggcctcaagaacattcagtgggagaaaggacagtctcttcaataaatgatactgcagaaacttgatatccatatgcaaaaaaagaaaactagacccttatatctcaccatatataaaaatcaaatcaaaatggattaaaaacttaaatgtaatacctgaaagtataaaactaccagaagaaaacattggaaaaatgctttaggacattggtcttggcaaaaaatttttggataagaccccaaaagcacagataacaaaagtaaaatagaccaatgggattacattaagctaaaatgtttcttcacagaataaaaacagtcaatagaatgacgaaacaatcaatctatataatggaagttttaatatttgcagatttatccatctgctgaaagattaataacaaaaatatataaggaactcaactcagtagcatgaaaacaaataatccaattaaaaatgggcaaatgatctggaaagacgtacaaatggacaatgggcatattaaaaaatattcagtatcactgatcatcagaggaatgcatattaaaaccacaatgagatattttctcaccccagttaaaatggctattatcaaaaagatttttaaaaggatgctggtgagcctttggagaaaggggaatgcaagtacactactagtgggaatgtgaattggtacagccactatagaaaacagtatgaaactttctcaaaaaaaaaaaactaaaagtaaatttaccatgtaatccagtaaccctcctggtggatatatagacaaaagaaatgaaatcggtatatagaatagatatctgcattaccatattcattaaagcactattaatagtagtgctttattaatagtaggcaaaatatgtaatcaacctaagagtccatcgacagatgagtggataaagaaaatggggtgtgtatatatataatggaatatgtatttgtccattttcatactgccatgaataaatacccaagactgggtaatttgtaaagaaaaagaggtttaatggactcatagttccacatggctagggaggcctcacaatcatggcgggaggtgaaggagaagcaaaggcacatcttacatggcagcaggcaagagagtgtgtgcagaactgccctttataaaatcatcagatttaatgaaacatgttcaatatcacgagaacagcctgggaaaatgtgccctcatgtttcaattacctcccacctgatccctcccatgacatgtggggattatgacagctacaattcaagatgagatttgggtggggacacagccaaacgatatcagaatatgataaagaataagtacctgttatttgcagcaacatgtgtggaacaggaagccattatgttaagtgaaataagccaggtatagaaagacaaatatcacatgttctcacttatatatgagagctaaaaaagttcatgtagtgaaggtagagagtggaattatgggtatcagagagtagaaagggtgagaggtggtgaagagaggttgggtaatgggtacaaacacacagttagatagaaggcaaaaagttcaagtgttagctagcatggtaggttgaccatagttaacagtaatttattgtacatttcatcaaagctagaagagaagtttgaaatgttaccaacacaaataaattgtaactatttggagtgatgggtatcctaattgtctgaatttgatcattacacattatatgcatgtctcaaaatatcacatagattccataaatatgcacaactattatgtatcaataaaaaagcaaacaacaatttacaaaacctgtacaacattattttatctccattaaatataatctgcatgtgtctcagttttgttttggtccttgaattatctgtttccgtttgttttagaagatggcattgagggcaagttgcccttctgaaaagtgattaagaaactgtacagcatacctaagcctggactttctactaattctcgtatcagaataaatgttttcaggtgcattttcatatactgggcaattggtataactaataatcatgtttttaatggtcgttgggtaaacttatagatgttcacaaaagggaaataaaaagagtaggtacttttgtttttgttttcattatataaaacaaataaaatcagcttacattaagtactatgccatggagatttgagttgaaaattcctttgtgtgaaacttcagtgacctctaatctgatcatagatttggtcataaactctttcatggagataggcccgaagtacacttctaagcctacctttttcatctccttcccttgtctttccaatctccatcttttactttcaatccccatctccagggaggagagaacagaatgtcatgtgatttgtgggcttgcttaaacagtcttctataatgcagacatggttggtatagaactagggttgtggccttgagtgcagctatttctaagcaaatagtgaactttgtcatcttaaatgctcatattaacaaattagacacaattaacaaattagggaatcaaaaatatgcccttttaaaaggatcttcaacatattactaagtacggttatataaacatctatggctggaaatcaatgaccataattggaaaatatgaaatggagtgatgggcctgctagcatgaaaaagtgtccatgaacccaatgtcccaagatttgccaagaataagagatgcacaggcttgggggtggtttctagtaatattattattattaaaattaaatgatatagcaaacttatattttgactgctatttattgagtaatgagataagaaagtaggctcaatttgccatcttatgtgtatcaacccattaatgataatttatcccctgagagttccacgttttgatcacattatttgctaattttacttcgaggagcctcagaattctttaaacattgttagtgaatccacaattaaagcagattccagtctgtatttaacacaacccacatttataaacttttcaacatgttgttttgttttaccatttaacatctcctactggcctcaagatcacctaacataaacaaataggtattaaatattgatgacgttcttattgagaaccaggtaatttcacagtaacaataattttcaaatttcgagtttctctctttctcttccttttttttttctgaaccacagaaactttcatgaccattacttacttgaaaagggattgtaagcatggaaaagatgtatgtgatatctcataatttagatttgtatatttttacattatatctagaaatatttactcaataaatattaggaccgggaaaaagggggagttttaaatactgcatccaatgtcctcatttatagctgaggaaactgacatgcaaagaggtgaaatgacttgtccaaaattcctctgcctgtaagtggaaaagccagggaaatagctcaggtcttctctgcagtctagaatctttcagtatactgtgaaattgttctaattgcaatccaaaatcatacaccaaagacttgtgtctctatgtgtgtgtgttgtatgtcatttgaaagtcagttgctaaatactcatcgaactaatcaaaaaatggcagctatggtaatgtctatgtgtctataaatatgatggatacataaccttgtgttcttcctgttccatgtgcctgcagcaattgtcctcaaaatgaccgtggcttcccacagccttctccctttaaaagctctgccattttttccccacaggaagttttgttttctcttactatagcagaaccacgtggcttgagattgacaagtaacctctttgcaggtgtcatttcccaagaatcaacagctctgccacaatgtttccaattatgtttgacagcgtccttgtaaaaatctgtcaacaacctattcagcttgtcacatacaaagtacactttcctagtctggtcttgtctccccagcaacaggtattaggtcaaaccaaactacacggtcatcatggagagttagagccttacaaggaccaccctagagtgattttaaaaaatcacttttgggccagacgcggtggctcaagcctgtaatcccagcactttgggagccgaggcggatggatcacgaggtcaggagatggagaccaacctggctaacacggtgaaactctgtctctactaaacatacaaaaaattagccgagcatagtggcacgtgcctgtaatcccagctactctggaggctgaggcaggagaatcgcttgaatcagggaggaggatggaggatgcagtgagccagatcgcatcagtgcactccagcctggatgacagagccagactccatctaaaaaaaaaaaaaaaaaaaaaaaaaaaaaaaaatcattttaggatgaaacagagttattaaggagacattgctgattaaattcactggaagcccatgatagggagtgccattgaggttgatagctctgaatactctgaagaaggctgcactcatacattaatgtattcagcatagtcaggggttacatctcagactgctgacagaatctgccgatttgataactgagcagccatcattgtacactgagaaatcctggaagaaggaaaaagtgccaggaactataaaggtgagaacgtgtcctgattttttagagaggaaaaaatcaggaatgtgtcctcattttttagagaggaaattacagatttttgtcactgtctaacggaggcaattaaattaatgttgtatttgaacacttaggatacataagatctctcatacaggtatgtgaagatatctattatatgggttgactcacaatgcatgaaattaatgatcaatgagaactaacatgagttaagagccaagtgttgccaaatttcttagttgtcttttttatagagagtaaataaatatttcataatggaataaacatggtgaaatgagagctggataatatatttatttgatttcaaggtggtgtcatagcgctttcatcataaatggagaaaaaagttcagtgttaactttagctatgttctgctgagaattttatgtgatttaaatgaagccatatgagatctatttagcaaacttggaacaagtttaagatctgtatttaccagaattacactccatgaaggcagggcgtttttctctctgattcactgcttgattcccaattcttagaaaagtgtttgcctgatacacatactaaatataatttcattgaatgaatgcagaaagcctggggaaacggaatactatgtaaaaatgggtgtcatcaggtaaacaggaactccagtccttctcaggtgtcatttacctgatcatagagtttccaatgagttggttcatgttgatctcgaatttattcttggctgccatattttcttgtgtttctactctatatgtcttagtagttcagcctactacaacaaatcaccacagactgggtggcttaagcaacaaacatccatcacatatctggaggctgggaagtccaagatcaagatgctggcagatctggtgtctgatgagggcctgctttcttattcatagacagccatcttctggctgtgtcttcatatggtcagaggggcaatgtggcactcggggatctcttttataagggcactaatcccattcattagggctccactctcacaacttaacctaacctaaagtatctccaaataccatcacactgggagtaaatatttcaacatagaaatattgagtgtgacacaaacatttagtctagatcacgcctaaatgtgacttagtctctgaagagagtaaatgtctataaaagacattactgccactgcttaggtgcctaaatgcaatctctactaatgattcctgggttgaagctgtcagcctcagaagccaaaaagggaaagagaagcgtaggaaaaatgcctgcacaacttccaacttttcattgcatgaaaaaacttttgcaatggggatttaaaatgctcaaggctggaaacaccagtgtttggacagagtgctaactcctcagtgtggaaacaacctcatggcagtgaaacacaatacgtttttcacataactttattgtaaatgcaaatattacgtatcatatagcaccgctactgttgcaggcattcctacctccaccgtgacttcctgtgaaatgcaattgcaccttccctgtaaaaatttcctttttcgttgctatgtagaaaatcattaacatagcctaagtgatactgctattcttagaaagactcccttgccaggttggccctcgggtggcatgtggtaacttcaatttcccaccattctaggaactgataaatgtagctccctgtgcctaaaccgtacaaacattatggtttatgctgaatacttgctttctttctgagagtctgcaatactgatacatctgaggctgagggtttttacatgaccagctaccaatagacacttcaggcactgaggttgtaatgcattcctctggtagatgatgttttacatgcattgtgacaacttgttgcttgaggtattaagtgtgtcttgtgtgagtacaccatgagaagtctgttggaagcttgagtctagttttctctgaatttcaccccaggtgcaagaaaaggtgacttttctctttgctgattttgctttgtattctgttgctagaataagtcatagccatgaacataattatatactgatttctatgagtgttcctagtgtatcattaaacctagcagtatttatggggacccctgacacaattgccaagaaatgaagcacattaaccgtacagattttatctgagactacattctgagcgtccctggaaattatcgtaatccaattcttttaatgtctacttgcttatttaaaaatacccatttgacattttaaaataactaaaagagtataattggaatgtttgtaacacaaagaaaggataaatggttgaggtaatggacagttcatttactctgatgtgacacattgtgtgcctgtatcaaaatatcttgggtactccatcacaagatattattttttacttttatttttaattaaatttttcttttttacttttactgttattattttgttagtattagtatttatttttctaccattatcttattggatcatac

SEQ ID NO: 2399 - DNA, 19602 bp, Homo sapiens
ccaaagtgctgggattacaggtgtaagccgccacgcctggccgaattagattttttaaaagtagaaattaggaaataaagcctcctcagtctaactgccagccacttaattattttcacaccccacagggaactgctgtttccttgcatttttcacatgtgtcccaagcagggcctcaagtctatctgccaccccctatttctccagcctgactctgacttgcagtaaaatacttaatttccagttccttctgacattcccaaatgccagtttcccctcccttattcacatgatcaactatttgtcctttagtgtacattttgatacctattgtaatcattttttgacaaagcatttgatggcacatttaaaaagatttgttttctgtttgtaaatgtttttttcttctagtttccctagacacagatatcttatcagaatgttttttgggtcagggtttccctttggaaaagttatagggagacgtgtcctcagccacccttcagttttttccttggacctgagattcagtactgtctggggaaaaaccaagatactggccatggctgtgtctgcaagagtatctagtgaatatcagctcctgggtcattttctcccataagacaaccagagatatggagtgtagcctctcatctcccataagacaaccagaggtatggagtgtagcctctcatctcccataagacaaccagaggtatggagtgtagcctctcatctcccataagacaacctgaggtatggagtgtagcctcttatctttcataagacaacctgaggtatggagtgtagcctctcatctcctgtaggacaacccgaggtatggaatgtagcctttcaggagagcaggtgaatgccctggggctgagaggcatctactggtgccctgtttttttggaaagctaaccccttgaggtattagtattgtctttacccaacccagcttccatttcttggagacacattgctgttcagacaatcagatgccggtattgaaggggaaaccaaaataatttttgcctctggattctcctaggggacagaaaaatagtgaaagaaaaatggtaaaaagtttgtggaaaaaaatagcactccaaagacaaagaaaaagaaactgaccccagtgagatggtgcaagaacttgcaaagtaaaatgtacctggggcactcactggggcatagttcagagtctcctgagagaatgattattgagcacttaagtgaacaggatggggtggctgaatctctcagtaattggatgacctgacttgacacatgaatcagacatatctctaccttgaaacgattaaatgatttgttcacttattttgaccttagttttttttcttcttctttttttttgagatggagtctccctctgtcgcccaggctggagtgcagtggcatgatctctgctcactgtaacctccgcctcccggattaaagcaattcttctgccgcagcctcccaagtagctgggactacaggcgtgcacccacatgcctggctaatttttgtatttttggtagagatggaatttcaccatattgcccaggctggtctcgaactcttgacctcgtgatccacccaccttggcctcccaaagtgctgggattacagacgtgagccaccgcacacggacttttttgttttagacagtgttttcctctgtcgcccaggctggagtgcggtggtgcaatctcggctcactgcaacctctgcatcccaagttcaagtgattctcatgcctcagcctcccaagcagctgggactacaggtgcccaccaccacacctggctactttttgtatttttagtagagatgggggttcaccatgttggccaggctgtttgagctcaaaattctgacctcaagtaatctgcctgccttggcctcccaaagtgctgggattgcaggtgtgagccactgtgcccggctgacctcagttttttaactgtaaattgcatcttattagtagggcttgaaaggtaagaaaatatttacaaagggcataaaaaggtgagtatcaaaaaataatatctaattatatatttcatttgttgaaaattctcattcacctttttctttctcagagtgaatttaggagttttctcaggtgtggttttcttttcttttcttttctttttttttttttttgagacagaatctcgctctgtcacccaggctggagtgcagtggtgggatctcggctcgctgcaagcttcgcctcccaggttcacaccattctcctgcttcagcctcccaagtagctgggactacaggcacccgccaccacacccagctaatttttttgtatttttaatagagacggtgtttcaccatgttagccaggatggtcttgatttcctgacctcatgatccacctgcctcggcctcccaaagtgctgagattacaggtgtgagccactgcgccctgccctcaggtgtgctttttatagctgagtgatttcaaacaattccatctagcttttggaatgtttgggaaaaaaataagaacattttttcttccgttttggctatagagaattaatatatttccacaagaaaatgtggtagataattggtgagttacatagattcgtgaaaacatcagtttctttttttgcagggtaaatttgcaaaagtaagtatctttgttctatatcctgttattttgatttctgagtttaatggtaaattttatgtgatgaaactaggtacctcctagaagtgttcccatataactgtttacctcatgatttttaatacaaaaaataaaataatgctttattgtccaaaagaaataaatacatttgcttctcttactgaggtacaaaaggtaagcaccttaaaattttcttatatgaacactgtttttgaatcattttgctggatttttcaaacacttagtttcaaaaactaagtgaatgactctgacatgtaattaaagcttgagcccaatgactgcaagctaaggttaattttgagctagcaaacggaggttattaaaggcccatttagttccttctggaaagcctttcctgcagatgtcccagcctgcttaccgcagccatggaagaagcctctatagtgagagaagctacagagccctggaaagctggggccccacaggcagatgcagttaaggttaagatagaaggggtttgggagtgtcttattgaagataaaattgttactgttttgaggcagttttgagaggttttaaaataaccagctagatgtacattaaaaaaaaaaaaagaattccaaaggagtattgcaacaggaggaagtaccaactataagatctttaaggattataaagattaggtagaaaaggcctttttttcctagagaaaacaaataagattagaaagaaggtgaggggaatatttaaatgaagggtgaaataatcagattttagatcagagaatgttttaccctgaagtcagtgtgttcttaggagtgttcttcagacactgaatctgcagtagcataaaatgaggttgtatggtggctcggactgagagtagctcagagttcaggagcctgtgggaagaaaataagtgaagtttgattaagaagtattttatgttgaccactgaagacaaatacagctgatttttttaacgagaaaagaaaatatgcagagtgttttcctggctgtgtagtaggtaagaaaagagagcaccatctaagtcacaatgggaagggtgtttcttttcataagtgttcctggagaacacagaggatagagaattttattaatcctagctgtttgttatctatatgcttcatcttttcccaccttttttcttggttctatacttttcttccatttgactttttgggggttgtatattttatttgaatccagtgaatataactacagtgttctgctgagttctgtgagtagctgtatcagattactgaatttcaaaaaggttatgggagtccccactttttaaacagtaggtcagaagcatagatgagcccatggggtttgtgactggcatctgcagtgaggacaatgttgtgggactgagccctgaatcagggtctgtgctgactctgggtggtgtcagaattcaagtgttagacaatgagttgctgttggagaattgttggtgttcatcaaactctgcagatttggtgccagaagaaagatatcacagactcctggcctagaatgaaactccgggtgtctgggaatgggaagctctgctctcctctacacaggctgtcacactgccccttgttctttgattccaggtctcctcccagggtgacagaagactgaaaacttaaaggagatctgatgacaaacccccttttgccacagctgccagcagaggatttccacccactcacaaacacccactagacattgatgtgtccacacccctctctggacaaggcaccaccctcaggaattttaccacagcatttttgatcctagtggtttttttggccaaaaacctacaaaagtgtctacaagtctcctggcatatccctattttcagacacggaatctgcagtagcatcctgttttctccaccagcctaggattcataatcttatctggctgcatggacccagaaatgaatcagagtacagccccacctgggccactatctatagcacaaaccagtccttccacctgcattgcactctctccaatcgagggatttttttcttttaacttttatttttgggtggttcaggggtacatgtgcagctttgttatacagctaaaattgtgtcatgggagtttggtgtggagattattttgtcactgcagtactaatcatagcaccaaaaatgtactttttctgacccttttagtcctcccaccctcaactaggcctcagtgtcttttttcccctctgtgttcatgtgttcttatttatctcttacttataaataataacatgcatttggttttctgtttctgtatcagttttctaagaatagtgatctccagcttcatccatgttgctgcaaaggacatactcttttttttttttttaatggccacacagtatttcatgatgtcatgatgtttatgtaccatatttgtttgtttgtttgttttgatatggaatctcactgtatcacacaggctggagtgcagtggcatgatctcagttcactgcaacctccacctcccgggttcaagcagttctgccacagcctcccaagtagctgggattacaggcgtgtgccaccacactcagctaatttttgtatttttagtatagatggggttttgccatgttggccaggctggtcttgaactcctgacttcaggtgatctgccgccttggcctcccaaagtgctgggattacaggtgtgagccactgcacccggcccatattttgtttttattaggttttttattttttgttatttttggagacagggtctcactttctttcccaggctgcagtgcagtggtgtgatcttggctcgctgaaactcacccactcaggctcaaacaatcctcttctatctaagcttctcaagtagctaagactgaaggcttgtgccaccatgcctagctaatttttctttttaatagatgggattttgccatgttgtccatgccggtctcaaactcctgagctcaggcaatccacctggctcagcccccaaagtgctggattacagacatgtgccatcatgcccaaccataccgtattttctgtatccagtctaccattgataggcatttaggttgattccatgtctttgctattgtgaatagtactgcaacgaatgtgattgtgcatgtgtctttatgatagaataatttatatatttttaggtataaaccccgttgtgaggttactgggtcaaatggtaattttatttttagtttagtgaggaatcactacactgcttttcacaatggttgaattataataattgccattctcactggtttgagatgatttcttgttgtggttttcttttgcatttctctaacgattagtgatgagcatttttttatatgcttgttagccacatgtttgtctccttttgaagacaaacatctttttcatgttttttttttggtcttcttttaagttagtttttttttttcttgtaaacttgttttagttcttacggattctggatagtaaacctttgtcagaagcatagtttgcaaatatttcctattattttgtagggtgtctctttactgtgttgctagtttcctttgctgtgaaaaaagatcattagtttatttaggtcccatttgtcaacttttgcaattgcttttgatatcttcatcatgaaatctttgacagtttctatgtctagaatggcacttcttatcttccagggttttttgttttttttttttttataatttttaagattaacatttaagtctttcatttaccttgagttgatttttttatatggtgttataaaagggtccagtttcagtctgctacatagtgctagctagttattctggcaccatttattaaataggaaattcttcccacattcctgttgtcacctttgttgaagatcagatggttttaggtgtgtggcattatttctgggctccctattctgttgcattggcctatgagtttgtttttgtaccagtaccatgttgctttgtttactgtagcactgttgtgtagtttgaagtcaggtaatgtaatgcctccagctttcttgtttttgcttatgattgccttggctattcaggctcttttttggttccatgtgaattttaaaatagttgtttttttagttctgttaaaaaatattttggtggtttgattgaattagcattacatctgtagatttatttaagcagtatggccatttttatgatagtgatcttttttattcatgagcataaagtggttttccatttgtttgtgtcatctctggcttctttaagcattgttttgtaattcttgtcatagagatcttttacctttctggttatctgtatttctagatatgttattcttttctgtggcagttgtgaatgggattgtgttttcgattcggatttggcctaggtgttcttgatatatagggttgctactaatttttgtacatttcttttgtatcctgagactttactgaagttgtttgtcagtttaaagagcttttctgctgagagtatatgggtttccagatgtagaatcatgttgtttgcaaatagggatagtttgacttcctctctttttgtttggatgccttttatttttatcttttgcctgattgctctggctaagactgccaattttatgttgaatataggagtgttgagagaaggcatccttgtcttgtgccagttttcaagaaggaatgcttccaggttttgtccattcagtattttggctgtggatttgtcatagataacttactattttgacatgtataccatcagtgcctagtttgttgagggtttttaacatgaaaaatgttaaattttattgaaggctttttgtgcatctattgagataatcttgtgatttctgtctttaattctgtttatgtgatgaatcacatttattgattcgtgtatgttgaacaaaccttgaatccccaaaataaaccatagttgatcatagtgggttaggtttttgatatgctgctggatttggtttgctagtagtttgttgaagatttcttttttttttttgagatggagtctcactgtgtcatccaggctggagtgcagtggtgcaatcttggttcactgcaacctctgactcccaggttcaagtgattctcctgcctcagcctctcaagtagctgggattacaggtgtgtgctaccatgcccagctaattttttcctgttttgagaagagacggggtttcatcatgttggccaggctggtcttgaactcctgacctcagggaatcaacccaccttggcctcccaaagtgctgcgattacaggcatgagccaccgggcccagctgtttgttgaagatttttgcatcaattttcaaggatattggcctgaagttgcctttttctgttttatctctgttaggttttggtatcagaatgattgctgttcttacataatgagttggggaggagtttcttctttttaatcttttgaaattgttctggtagaaataatatcagcttctatttgtacatctggtagaattcagctgtgagtatgtttggtcctgagcttcatttagttggtaggctacttattactaattcagttttttgagcttatctatctatttagggctttgattttgtgtgtgtgtgtgtgtgtgtgtgtgtgtgtgtgttgagttttgggaggatgtatttgttcaataatttttttattctagttttttttttatgtgcatagcagacttcagtatatttttgtggggtcagtggtaatgtctctttttgtcatttctaattgtgtttatttgtatcttcattaatctagctcatagtttatttactttttttaaatagatttaatgcctggatttcttgatattttgtagtttttcatgtctaaatctccttcagttcagatctgattttggttatttcttgtcttttgctagcttaggggctgatttgcttttgttgctctcagtcttttatttatgatgtcaggttgttaaactgagatctttctaactttttgatctgaggatttaatgatataaatttttcttttaacactgccttagctgtattgcagagattctggtgtgttgtatttttgttcttatttgtttcaaaacacttcttggtttctgccttaatttcattatttaccaaaaaagttattcaagtgtaggccatttaatttttatttaattgtatagtttccagttgttttattggtattgaattgtgtttctcttaagctgtaaactgtgtgtgtgccttgtatcgttttgggatttttgaatttgctgagaattgttttttttctgattgtgtggtcaattttagagtatgtgccatgtggtgatgagaagaatgtatgttatggtattttttagatgaagagttctgtagatgtctattaggactatttatttggtcaggtgttgagttcaggtcctaatattgttgttgattttcttcaatgatctctccattagtgcctgtgagatgtagtccccgattattactgtcagattctaagtctcttcataggtctctaataatttgctttattcatgtgaacccatggtttttttttataacaattttctctcttctgcttttccccccataaacattcttttaagtgcacacagtgtgcaaaattcagatgtccaagagttcaagaacttgtccagagacctggcttttgtaagagaaaatataaatgagaaataagaggctttattctcatatgtgaaaataagggtggataacttgctgatttttaaaaaaaggtttagattatatgtatatatttcttctgctttttgaaatatatgtaaatcatattagaaatgaaacaaaccttttgtcattcttttgactcagaattgtctttatctgggacctgagattcattgctttccttttttcttggcaaaagattatatatatttttatctttagtctttaaagtagacacagatttgttgagagtaaaatttatttcaagagcctaataaagttaagcacaaagatcggattaatttagcaatacagaataataaagactaaaagatcctgagtaagttctttggcagaaacccgattatccaaggtgattatttgcaggctgaaatacttacactgcgaaagccagaagagttcagtgtataaactgaacagtggagtctgttgtacttgggttgcttcagtacagttagtatagttatgtgtagtgtttgtagacaacctgcattcatgtaaattaaacagtattttctagaatagtataaatttaaggccacaatatttactttgattgaattccttattttaatattgttattcatacttttgaaatatagtgtttcaactgaattatagttcagataattttaaaaaatcttacatacattatgactagtacataaaattattcatacttatatattcatatctgctatcccaaaaattttaccattaaattgttacagtagatgttagtctgacatgcttattaatttacccaataggaaaaattataggtaggcataattttagtgtcatatattttaccaaattagtatgctgctattacaggataaataaagacaggtgatatggctactcaaaaactgtaatagctctccagttaggtatgttgcaagctctaatatattctactatattaacacagtcagatttcaattttttataaaaaagtgctggtggaagttgtcagatatattccagtgtagatctcacattcaatggttaggaaataagagagcagcagagatggaagataaatcttttaaaattctgctgagagctaggcgctgtggctcatgcctgtaatctcaacactttgggaggccaaggtgggtggatcacctgaggtcaggagtttgagaccagcctggacaacatggtgaaacctcgtttctaccaaaaatacagaattagccaggtgtggtggtgtgtgtctatagtcccagctatttgggaggctgagacaggagaatcgcttgagcccaggaggcagaggttgcagtgagccaagatcatgccattgcactccagcctgggcaacaagaatgaaactccatctcaaaaaaaaaaaattgtgctgagaatataccccctttattcaataatgctcatgtttctcttgctgagagtagctatgcactttgggtgtttggagagaaattcttcttagggaaatattttctggctgacttgatcaatcttatatctaatctcagttttttcttaagacacttttaacttttttctctcaatataatctttctcagaataagagctgtttttctctctaatgcattgtgtatctgtttcagaagccctattagtattccgtggtgtctgtgaaagacgtgggctgtcacagtgagaactctcagagctatctctatctggactcatgctaaaatccagcagtatttttttcatgccgccattataaataaaaactgaggctgaaacagtgctcccttttctattattgtgaaggtgcaattctacccaggaggcctgcaggctctcctcctgctgctcaggcttcactgtctgatgtggcactggagtgctgctgtggcaaatggggttcacctaagatgtgagtttccagctgtgagccctgtgctgtgggctgtgcctcagtggcagatggtggggtcaagagagtacactagccaccaagagagggaaagcaggagtgttctagcccagtgctcagagagtagagagctattgctttaaaatgtaaatagccaaaaagatagcacccgaatcaacactttttgtagaagagtcaaagcctaccttcagcaggccctggggttcaagttgcaaaactacctctagtcatgaagatgtgaaagctttactttgtcattgattataaccagttagcatacagggatggccttcccagctaccagatgaattcaggatgaactatgtatgacatggtgctgtaaattctacttgtagatgaattatggtgactgtctttctgtctttgcaatctcttgagcaaattgactgtaatgcatgtcacattcacatgtaattgtgtaataaaacagttttctttctgttctgttattatttaattcctctggggctgaagaaaattttgcttctaactgtattttccaaaccttgtctagaattaccagacataatataaacacatagggtaccaactaagctttactatagatgggccttttccactcaggcttccagtccattcacaattgtgctgcgaagtgcatgctgtaccctaaatatgcaggtggaattgtgtctctgcctacttggtatctatcatcctctgcagtcacttttagagaggctagaacagatttctacaaactttataggtcagatattaaccgttttacctctttcaatgacttgtgtcttcagacctgaaactgattcagtgaccatggggcacagaaacccaatcagagtaaaatatgtgcattgagtagacctgtagacgtgagaatccagttctccctccctcctcatgctataatgcccacaaatattcagataccacctgctgctactttacccatgcaggacctgaatttgcagctccaaattctaaatctaggtcttgagaattgaaaagaaaaaaaaaagtttttatctgaggaatgcaagtccttttagttatcaaagtcagagagccattaaaatgagcacagttatgtttttctcccttttcttcagctatgtatttatctcttgaaactgttcactattgccacaagtagctttaaattagaccaataattccactctggacactaaattccatacccttaaccttgatgtatatgcaatcaattattaaagttatttctttacataagtaaaatttctcacaaccaatttcgtatcagctcattcactgtacctctttttttttttttttttttttttttttgcctttacaaatccacttgtaagtgctgctaatgaaagtgtagattccaggcaacttgaatattttgtctcaagttaaaatccttaagcttgacccaaataaactgtctgcttatgttcatgttgtgtcagcttttttcaggtaaaatattatttagaatgttctagagcagcctctaagaggggatctctcctttcatttcactttacttgctgtaacacccaaaaatgcagagtgaggttgatttcacctagaatttgtaaataagacctggcctctgcctggaatttacaaggcaaagccagactttggattgagaatttacagaaaaccaacaggaggcattttctgcattgtgagatatcaacatagacattttaatttccttttttgagagtgtggccttttgacctttcacatcttcattaacctgccccagttatgtgagaggctccaggagtaaatagaatctgatggcagaatctgtaagtgtaaacaatcatcttaaggccacaaagtatccagagccacaccacaactatacctacttgtaaaatgtgatactggagtagagtattcttgtccttctacttacccaacagctagcaaatcaggacaggcaacccagattctggagttcagccaaagtagttccattttttatttagaatcatcctgagtcttctctgtctgtcttatcattggaccatcagcccaggttcactgggaaccctctcacaatcacctacgaatctctgagacatttgagaatgtccagaacagatccctggtacttgagtaaaaaatcaggaggtctggaggctcaaagagataaactaattgcttcaatttcatatagtcataaaaaaaaatagaagaagcaggctgggtgcagtgtctcatacctgtaatcccagtactttgggaagccaagatggtggatcacctgaggtcaggagttcgagaccagcttggccaacatggtgaaatagggatttcaccatattgaataatattgaataatgtgttgaataaaccaacatattttagccaggtgtggtggctcatgcctgtagtcctggctacttgggaggctgaggcaggagaatctctttaacctgttaggtggagactacagtgagccgagatcacaccattgcactccagcctccgcaacaaagtgagactcagtctcaaaaaaaaaaaaaaaaaaaaattgatgaagcagtcatgattcctaccatcctggaagttttagtctaaactaacaactggaaaaatggttgaattatgcatcatatggtgggtacaataaatagatgtgcaaaaaacaacttgggctttatttgagccactttctttatattgtggtttctgatgtctacacctgaacttataattggaagagttgttattattatttgtagttcttttaccctgctaagaatacttatttttcttctaaaaaaattattatagaaaaccttaagggatttttttttaaatttcttattagtatgtaatataaaatttacagggcagtggctaaaaaagattaaaattatacaaactcagatttaagtttacttaagtaagatttaaaaaaaaagaacttacaataccccccagtgccatagagaacagaattgtacattggctctacactctgccccagccctgttcatattcaccctttttggaggccttatttatgtctggccctaccctggagtcttgcctcaaagaactgattagaagagatcagagttttgggtcatgaatactgttgcctttttagagctggtgttcaacattttctgagacttaaaagcagataaatgggaaatataaagtatgtattatagaatcttactttacaaatttttaattaaaaccagtgcttgcagagacattatttagcaacttgttttctgttcctgcagctgatttctgttttctgttctgttttctattctttgcagttgattcacaagtcacaagaaagtaaatataaacacaataaaaatttatctaaattttattaagctctttccatctgtatccctttcatctgtctatagttagcttttattctatgcattttttgaaaaatcaatgacagataaacaaatagaaataaaaatgctgggtcctttaaagccttggaattattgaacacttagtatcaactgaaagggtgttattaggattaaatcacataatgtgctatcacagtactctaacatcctattgagcacatagtacctgcttaataaacattgcattagtacatgtgcacacgttgttttccaaatgctgacttactcagaaattgctgctttctgttttctctgtaaattttaaagagtcagcaaataatataatactttaggatgaagaatgattgttttcatttgtaccagaagtatctgtgttctgcctcatttctctaattaatgctaataataagcccagtgggagcaacatcattattgacagcgcacttgtttaagtgacccatttatggaccctttccatacctgcagaattacatttcatagagtggggccaaaattaccaagtcatttataagctccttagagcttgagaggaaatgcttagttaaggggttatcagcccaggcttctaattagtatcacctggccattttgcagaactctctttacttgtgccctttccatggattctgtttattgttcttggtggaagcattcatgttgttttaattaagtggctcatgtgactctaaggtgaggccagaatcaagtatgaggaattcataatacattcatgagagttaagttccatctttgcattaaagggtggtccaagaacctgttctgtttggatttggtagggacagtacaccgtggcccatatttacattactgtggcagaaattgctggtgcctgtgtcaggggatggctcctgaggacaaaataaagaaaagcatatttttatctctgtggagctactcattgtttcttcatctcttctgctataaaggacagaaatggatggagtttttctgtcttggttcttctgcctgtggatgtggtgacagcaggtagacctgtggtgctgacacttttaaaggcatattctcaagatgcaggtgtaatttgtctagaaaattttatctgagaaagaatcctagggaaggaggagaaagagaaaaaaatggccttttctttttcacctaaacatgtctgagatcaagatctgtgtccactattcttcctccaggaaacatacgtttagtacttgcaaacctgtacttctgtgtacctgtgtttttcctccctaatgagtttgtcttaactgctttaaaaaattcttacaataatcaaagtctctgaaaaatatatttttttctatataccagagctttctctatattatggcttcttatatgccatgcagaaatctcactatgaatttataatctgcaatattaaaaatgtccctttgtggctgttgaacatgggaaagtgtagatactcaaaattcatattggggaaaacctggggtttttagtgaagacagagaacatgtaatgttgtggtttcatctgtgttctttattatgtctatgcagtacaagattaagaaaacactcattgaagcagtgtggtatttattacccagaaaattctaaaaaaaattgttaggagatacctgctctctcagtgctgaagaaatactatttaaaatcactactaaaagttacagaacatgggagatatctctatcttgaactttccataaaactaatgtttccttatggttaaattcagactataatttacctttcagagggggggcaatatctcagcagtaatactgtgtccttctgggtacatcaggacattaaaaaaatgtgttctagtgtaattgatgttaataaatcacttggttgataagctctctgacacatttttttactatggaattaatcattttcctcttcatcattaaatatctttatgcagctgatgtgaataaaccaaaacatttaatctgacagctgcccttctttcttaggtttcctttgcatttgtctgtttttggaaaatgaaggctcttatctttgtttacaaaccagaaaaacagaaaaacacaggctcattctattactggatgttttaaaaaatagtctttttgggccaaaaacattggcatactgatgagcttattagaaattcagcaactcagactttatcccagatctgaaaaaaaaaaaattgcattaacaggatctctagcttattgcacacattaaaatttgagtcataccttctaactcaacatgtctattccatctgaataatatgcaaaactatgtcttttccatctgaaaaatacacacgatgaatttttttttttttttttgagatggagtttcactcttgttgcccaagctagagtgcaatgaatcttggctcactgcagcctccgcctcctgggttcaagcaattctcctgcctcagcctcccgagtagctaggattacagccatgtgccaccatgcatggctaattttgtgtttttagtagagacggggtttcaccatgttggtcaggctggtctcgaactcccaacctcaggtgatctgcccacctcagcctcccaaagtgctgggattacaggcatgagccaccatgcctggcacacaattctgtatgatgtaaatatagcactcaaaattgtacatgttagtgtttttgccctcaattttatactttattatctagaaaaatattacatatacacagatgttatggatcttataccactttcttttctcagagttagagaatacattagtgaacatttctgtgttgaaaactattttattgaataatttcagtcattcatataagtcagaaccagctctctctactctctccattttaccttgagtcacattaaaagttctgcccatgaccaattggtaaatatatgtgtttgtgtgtgttttccagggagcattgacatttagggatgtggccatagaattctctctggaggagtggcaatgcctggattctacacagcagaatttatataggaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaagggatggtgggatccagtggaccagaatcgtcagcaccttaccatgttcactgctgtcctttcgttctgtcactaagattagtttccgagactcatcaactctttctatcatgatgtgaactgttttgcactgcgttagcgtctgcctttggtttctgctaattttctttgactttcatttttcttgtccttctctggtgtttgctttgctgctccactttgaggagtttgggcagcttcaccctcagccgctccagcagttcctccatttggctgaagctctccgttcttctgttcttggcgtctgacatttgtcagcaaggcctggtttacagggaccacggctaccgcctcctctgcggggcacctccttcacttccggagggcgccagttccagtcgtgacccagctgagcacagcaggaaccgccgcagcagccggagcgcccacgcccacggtcgcccagcccggggatgcctcggctcaaagccggggtcgcggctcagcttagtgcgcagaaatccgaggtcaaccagagcatttcccacagctggccgagccctcctcgacctgcggggccagtttctcccactggctttctgctgccacctccccttccatcagagggacgctcaggattgtgcaggggcccgtagacaccgtgaggagtccagggaagtgaggaggggctgggccgggcaggctcaagcccagcgcacggccgcacccctcacgcctgagcagagatcagccactgccaccgcggggaggacagagggacccaggatcccccagccagcctccctctgcgtcaggagaggagggaactatttccaaaatatatatagagagagagagtagaactggcatatctgacccaatcgagttttcagtttttcttttctttttcgccttttcctctcaaattatgctcgcctaaagtgagagttcatttttcattctcacgtggcaatttaattttttaatggtcacaaacttagagactaaaatttttactctattttacctaagaatgatgaggtaacatcaaacttttaatagtgctttctgaattttacagtttattaccttagatttgattctatcaactaaacaataataactaaaaaagtcttggtttgcatagcttgaccatttacaaaggggatgtatttattcatttaaatgataaatgtgtgttgagcacacacgttgtgccatacttcttgctagctttaggagataaaatggagaaaaaaaatattgctctttactcttataaaactttcagtcttgctacataaaattggccaggttgttctcgaactccccacctcgtgatctgccacctcagcctcccaaagtggtgggattacaggtatgagccaccccaccgagcctctcctagaagttttaaatcctcgatatacatgaacaatttttgtgttagttgctttgcaaggatccaatctacctaggtagaaccaatagtttagctattagtttattgactagttctgcttttccagtataattgtgtaactgatttctcattttaacctgttggctgaaaccatggatgcaatgtttaataaaaatcttgaacaccaacataattattatgtttatgacattaaaagacaaactttcagt

SEQ ID NO: 2400 - DNA, 855 bp, Homo sapiens
cagtgttcggtgctcattcagccgtggggagcggacaggacggaaaaattcctttcattcccaggctgcccagaagtagctgcaagcacttttaaggaaatctgaaaaagagaagacaaacaaagaaactgagacagaaagtggaaatgaaaactccggctacaattcagatgaacaaaagaccacagacaccgcttctctccctcccaaatcctgtgaatccagtgatcctgaacaaagaaacagtagctgtggccctcctcaccagcgacaaggtgctggggcaaccaatggaaaagacaagacatctggtgaaaatgtcagagtgtgaagaagggcaaactgtggcttttctgtggtttgctgttggggcagctagctgctgattcctgggaaggaatttcaattctttccatgtgctcagagagaagaaggcatttgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 2401 - DNA, 1837 bp, Homo sapiens
tttagacatgtaaatttcccatatatcatcatgtattcacccattaaatttagtattcattaatgatttttgcctaaaaatatattactttagaattttccaagtagtgttttcctattttcctcaattcttttatatttattgtttggaattctccaatgaagaagagctttccctatcttccatatatttgtttattcaatttttcatgtatcatagaatagactcaaggattgtaatattttctagggctatatcccatcattatcatcatcaacatcatcatcatttggctcaacttgtacctcactgactattggaaaccctctcaagttaccgtttgtgcacttctgaattatcctcatcaggttttgagcattgcattcttttctggaactgcaatatgtttgagctctttgactcttttccagttatggatctctgtctttccctaaatctctctccataatgtataaccatatcttcttcagggcttagcttgccttacatgctttctctttaattgaattagttccttaatgacttttctgtccatgtgtatgaatagacatatatgtgttagtatgtgtgtatgtttcattctgattatcacttcccattcaacagatagtaagtaatattgtagtgtttatcatagtgcatatttacgggggaaaagatatcaacatgttattaaaatgaaaacagtaaagggttaaattaagggaagattttatatgtaaacaagtttcatgacagattgatctcattagtgggccaaattcttcaccttttgctgtaattgtgttctttgccatatgactttgaaaacagtttactgtcagacatgtggataatctgaaccccagtggaggcatcatctggatgaccatccggatgcttgaggaataaatgcttaattttgttatgctactaatttcttgtagttatttgttatgcaccagtaatgttgtgaaagtttattgatataaaaccatgtggaatgacatgcagagttggaccaaaaacaaaagctttatagttgtgaaacattgttcttgttgtgactacaagagagatgagccaaaagaatatggtgggtgtttcactaagtagagtgaagtttaagtaatgactgaactgcatatgcactctgcccagaagtgttagcataagatcagcacctgattactcagacatttctttaggaagcaaagagccacatggaaaagaaatcaatagtaagtggaggaggagcagcaagcaaattcaagagccccacattgaaagaaggtacttccatcaaatcataaggaaggtgcatatcaaaatcatcggcaattgatgacagaccacagaaaactgagccaatgagagagttcccaggaaaacactggagctgtgtttgttgacgggaagagatggaagttggtaatgcagaaagatgctacccagcatctaatcttactgggtaacaagtgcattgggatggaatagcagtaacatagcaaggtaatctcaaaactatagatgcatgtagtagaagaatgaaagctctagttctgcagttttcactggaatatggattatggcactagcactgtctagttgtttgttatcagaaagatatgaatgattcaaacattaagttcatgtcacctgtacactacagataccaaaaatgttaatcatgatacctagttccatgaggtcacacaatggcaagtatgataaagcccttagcataatgtctgggacatactgaaaccttgctaaacatgaactattcttaatgttattataattactattaatgacgtcaaaatgactatttctt

SEQ ID NO: 2402 - DNA, 3524 bp, Homo sapiens
gggagactgacaacggggcatgggaacgcagggctcatgccacaactgtcctagaaatagaaaattcttccaaagtaaaaagtttacatttaaaatatagggaaaagacttgaatagacatttcaccaaagacgacatgtcaatggcaaataaacacatccaaaggagctcaacctccatgaagaggggaaaagcgcatcgaagcccactgcacacctgctggaataaccctgatcaaaacccagaggatggcaggagccggtgaaaggtcggcttactcaggacccggcagtgccaccccaaggaatctatgtgagtgaagtgaaacctactggacactcatcgctgcattatcccaaacagcccgacctgcaaacagccacggtgtccctgctgaccccctgcccccagtacagcctcctcctggacttgggtaagtcaatcccccaacaggtgcaccctcccctccatttccactcagcccttatcccccagggacccactccacacctgggggccctgtgtggtgacctcctgccaggccagcctgccccagagggaggaacacagaatccatttggaaccgaaagggactcagctcagccgggaaaagtaggctctttatttccagcctcactgaccacgtgctgctctgtgtccgtggtggaccagccctgggcatgagatgagcagagctggcccccggacccctcctcaccacgtctgaacggacagcacttctgtgtccaggggtgtgcgtcgggctcccgggcagacaatccctgggctttcgcgactggcaccgaagtgaggctgggcaagaaggcactgggccagattcctccctggggcacttaaacggggccacagggaaagaatcgatgtggtgacgggtggaggcggggctccatggcagccacggtcaggagcaagccctcggcagcaaggtataaataagccaaagtgacaggggcagatgagtgacacggacagaccacacgcagagagtgagggcgccgatggagggtgccgccagccagtgtgagccgcagggagaaggcagatagagtgagctccagagtcgtgacccacggacacccaggtcctcttgccgggcacccggagcgcctggaatccagttcccgaggacttggcgggggctgctgctccagggcccccctggttatggctgggatgagtttgcagaggatgcccccgccaccaagctcacacctataaacactgatcatacaaagtgtgtcattcttgtcacaccaactaaaactgccttcggaaggcaggggaaaagtactcagggcacgacactgctccaaggatggaactctctgcaagtccagctgctgaaactgccttttgtcacctgggaccagttttatccacagctgctgaggtcacttgctccaactccagaaggaattctgctcacagctgtcacaccgaccagcacgtcccaggtcctcagaactttcccagcgccagtgaactttctcaaagagcaataggtaaccttctcctttcttgtaaaaccaccaaccttctactgcttctccaacctccaccatttacctggtcggcacgtatgccccaagatgcaatcctttcttcccaaataaaacgttaaacttggaaattcgcctctacatttttattttgacttgaacataccccagcaaccgtgagaccccgaggacacgagtgaccttccctgctcctggttccttcgtgtgcacgacaggccgtactgtctcctggagcctggggcctgacacctggaagctcagccggagcggccccagcaacctccctgtagctccagcagtgccatccctgtggtcagcgtggacctggcctcccagtggccccaagtccccccatagctccagtggtgctgtccctgcagcgtgaacccggcctcccagtggccctgcattccatggagggctgggccccctgccctcctgagcctcacagtggccagccagcctcacacgctgctgaccctcagtagtggccaaccccgtgtctgtcggagggcacaggccaccatccccacggaactcaggcctgctgcctgggcaggggccctccaggaagcctggcacttaggggtggcagctcaagcttgttgggggtggggagctggccgggcactcagggcccgtcatgtgcaaatttgggccaatcccaccccctctgggcctctgtccccatttaccagagaaagatggtctccgctgagccaaccaccttcatctaaaccaaaggacagaaaccacctctgctgagcctggaggcagccaagggagtggagaagccagcggggatcccctggttgggccacacacaccccagtgaggctgcgagagagacgcgccgcctcccgaggtgcagagtttcgcagggcacaacccactcccgtctgctcctgcagcaccctgtgacccaggacgggcgggtttcctgtgccccacttcacagacgggaacattgaggctgaggggagctgagtgaggtgtttgcggtccccagccacacggtgtggctctggctttgctcagatgccacacgctgcacgcactcctttactggacgcacccggccccgccggatactgccgtgccccctcccaggacagcagcaggagcacccagccctcctggatgtccccctgcccctctgtgccgcagccctcatgactcactgggaggccaaaaggaagccccaagtgattttctagcagcacctcccgcagccctcggggtgaggctgggctgttctgcctgcgagtggtgctaggggaacctcctgaggggtcccaggaaggcccctggcctcctgcctccacacccctgatttcttggatccctttcttggtcagtgagagccgaccgggtgaagtcacccctggaggaggagggagctgaagcagccggtgactcactcacacgagacagtgggcggcggccagggcagagcgggactccccattgctggctaaaatccagacagcgccttggcctgaggtgtccctgacaggatgagggcggagtggcagctgccgaaacctgaactcctctgccctgcccccgtcccttgaacccacgcatctagtaggtcagcgccagaggaaatcctcgaagaaaatgggcgtctcccttgctgagcacagaaccgcagtcagccctgtgtgcccgctccctggatgaggacaggaaggacatgggggagaggccacggtcaccctcaggagcccccagacccactggaaagcagcgcagtgagcatctgagcagtaccgcctgtgcctggcgcgagggtgcgaggcggggggccgtgtggccaggcagcctagggttgcgccaaagcccagcaggtgtgggacgagcaggactggactgggaggggctcgggggagcggggacctgtgctgagcttgaggtgtggctgggctgggaggccggacaaaggtgtgtctcctctggccatgcaggggtcaggcggtg

SEQ ID NO: 2403 - DNA, 3492 bp, Homo sapiens
gcctggggactgcaggcacagtgaggaaggtagggaagggtctctccaagacaggcccaccaggagcccccactgggaataatgcagcccctctcaggggatggagtgtctggaattccatggctgaggtgcaacaggtcccacagcctctccagcctctgtgggaagaaggatcatctgatgcctatgtaatagagttgctgaaggagtggaagcagctttgacattatcagtggaacccaccagtgcagactgcttcaccaagggcacctgaggcagcagatctgaggattagggacgtagggagctgaagcctggctggagaggtggtgcgcacaagaacccccacattccccgacaggagcctgaaaaagcaagacgccatgttgggaggacacggaagcagttctagggagaggagcacatggcaagaagccaaggcctcctgcccacagccgtttcttttgcagataccctgtgattgccagcaagtaaaccagatgcaattgtggtttccgtgaagcacagctggaaaactgctgcccccacggaggaagaggaagatgggaagatggtggttactgcacaccaggcaccagcctcggggctatgagctgtacaaacattacccattttatcctcgtgaccatgttctgagaaggctgtcaatgatctcactttatacatggggaaattcatgcagacagaggctgactaaattgccatggtcactcagctagtaggaactggagctgtaacttgaacccgggtcttttgtttctgtggctcctggtagcacatgccgggcttgaagtgagatccggaggatgttggaaacaacgtgttccccatcatgaaagtccttatgataccttatgatgcagagttggcagccaggagcaggggcttccagaagcatggctgacccttgttgggatctcgctcctgtgagccttggaacgtctagggagaaagagcagccaaatttagagctgcaggagctttgagatgcagctcaggcatcatctctgggaagtctttcctggaaccacagcctgggccctgtacctgattcccagcccctgtggctctttttgcatttgctgcctcttttcacaattctgtctccttatgtcttccactctacacgcaagccccttgagggcaggaccatgactcagtcatcctgtaccctagcacccaccctgggtctgcatctggaaggagctcactaagtgattattgagccaaactgaactgtagcaggagtgagcaaagctaattcatgggtgcagaatgggagcacagagctgccagaatccagagacaactgtaactgtcccggcacagggggcttcaggccgcggtgagagccactgaaagcaagagagccaggtggtggctcagttcacactgagtcctgctgaagaaataggcacatcgtgtgtgttaaaatcagcaccccatgcacctgtaggaagagactgaggcaccctggaggcccctcccaataattaaaaggccctctggggcctgtgggagccctagctgatgaaatcacaaaggcctcagcctctaaagtgtttccagtaaaatgctaccaggattttcctcccttaaatctggatgaaagggctgtctgtgctacaaagtgcacacctggcgttgatacgcagtctcttgctgcctgttaactaacccaccagccgacaagttctgcccactggcaggagcaaggacttataaaaaatagtgcctccctcccaagggcttatgagctggttaagtgcagaggacaaatagaatgaaagaaaaggcaatctcggcatagtatttagttaattcttctctctctcttgttccctctctctcctttctctcttcctccctcctttctatgacttgtcctctccacacaactccttttccgttttccctcccctgcctccccaccttctttcttgacttcccatcttgctccctttcttcctgcctgcccatctgctttcctttcttatctctggtgcaaattctgcatatagtcgctctcctcatttcatgacaggctgtcttcatcagtttctgagttcttttgttattttataaaatattttacatgctgtcctcaaaaaatcccctcccccagaaaaggcccattcaaaagtacttactatacgtccttagataggcaatgatctctgaaatatatataggcttgctctatatgtgtttttgtaagtgtacttttctttcattaaatatgcagatcttaattgtacagtttgaggtgttttgacaaaggtatataccagtaaaaccaccaccccaaccaaggtaccgaacactttcatctctctggaaagtccccttgtgccaccttccagtcaactctcaccctccagaggcacccactgttcagatttctacatgcattttgcctgttgctgaactggaacctcacagccttttacgtctggcttctttcacttaacataatgtttttaagtcatccatgtagttcattcttttttttgttgcagagcaatattccattgtgtgaatggatgtactttatccatcaacagttgatgaagttgggttggtggcactttttggctatcgtgggtaatgctgctctggatgtttctgcacaagtctttattgtggacatgggtttccatttcttctgggcaaatgcccaggaacagaattgctgattcattaggaagttatatgtttaacttcataagaaactggaaaaccgcactccacagtgttcatgctattgcacattgcccccagtgccatgtgaatgtttcattcttggggtctagaatatcttactgcagttttaattggaagttctctgatgacttttgatagagtatcttttcatgtgcttattggttatttatttcttctttaaagaagagtctagatccttttcccatttaaaattgcattgcttctatttttactgttgattcttagaagttctttacatattttagatttatatacagtaaatattttctcccagtccatggcttgcctttaccttttcttaatggtgtcttttgattaaccagacattttaaattttcatgaagcctattgtatcgggggttgtttttgtttgttcatttatggttagtactctttttggtgctagccaggaaaactttgcctacattctcctaagctcatgaatatatttttctatatttgtttctaggacatttataattcaaacttttatgttctagcctatcactcatgtatagttatgtatagtataaataaggattgaagttcatttttctttccatatacttatccagttattccagcaccatttgttgaaaacactttctttccctcattgaatttccttgaagcttgtgctcataacttatataacgagtattgcgttacaatttccattatatttcttaatttttcacttaacacaatgtttatatgatctatccg

SEQ ID NO: 2404 - DNA, 2487 bp, Homo sapiens
ggaatctcctggtctgcgggttgggaagaccatgggaaaagtgcagtgtctgggccagagtgcatggtacagtccctaacgacttcccttggctaggagagggaattccacgacccctagcacttcctgggtgaggcaacgtcccaccctgcttcagctcaccctctgtgtgctgcacccactctccaatcagtcctgatgagatgaactgggtacctcatttggaaatgcagaaatcactgccttctgcgttgagcttgctgggagatgcagaccagagctgttcttatttggccatcttgccagcacccctcccccccccacctaattcttaattttcttgtaaggagtcctaaattcaattttgacgttttacttattttcaacttctattgtagaacaattgaaacatatacaaaaatagagagagtaatataatcaacacgtattcatcacaagccttgaaaattaacatcccatggtcagtcttgttccatcttgcctttcattcccttcctgtcccagctctgaattattttgaagcaaattccagtaatcacattatttcatcctttacttcttttaaaaatatgacagaagtttttgacaaaagaatcttgatgtggggaaatttaatgataacacttttaacatgacagtttttaaaaattatgacatttgatttatattttattcaattttatggaaaataattatgcaaagtatctttttattataagaatcaatcctgcatgtagaagtcccgactaatatcaaagaacacagtaatcagtcttgtccatcttgttcaaacattgagagctagctaacaggaataagatatataaggaatacaaatgttgaccaggtgtcttagctaaagaacattttctactctgcttatctaactcatgtatttatattttcccaatccaatttcttagcaacacatttgcagaatttatttgactccagaatggctactggattattgagatttcctgaagtgaatagttttgtagagctttggataaaattagaacaatagagtcatatgaaagggggaagaatatgttgttggcaaaattcacatttcttctcatctactctctcctgatatcagacttcctcttcctgtgatgaaactgaggttcgttttgacactcctaagaaattaagaatggagggcaggtgaggaaagtaaaatagagacagcttaaaagacattgaaagagactgtaatgcaactcattcaatgtctttatctctgtagtttatgatgtctctcattgtccgctagaagggatttgtgctctcctcctggttgctgtgatgagacagatgtggaacatttcattttcctggactgtgtagacttcagctgtcatctctactgaggaggtaggacccaaggtgctaggttcccacctcagcagaacctccacccacctttcagccctgaagccatcatgtgactcgtactaggaaagtccacctgtgatgatgatgaccagtgagggctaaacaccaggggtctcccaaatgttctcagccatatacgaatttcaggctctacactggacctggatgatgaggggtgatggagccccaataataaccacagttgatttttccacaccccgttgatcagattaaatataatttagaaaaataaccaatgtggcatttttttaaacctgagatgtaaaataaaatccatgacagctgtactgtatactttgcctaatttactttctcagaggtttggaaggaatgctcagaaatatttagaggagtttctttcagtgagattacttatatttatgatattgaagatgtcttttttcaaagtgttacgtactaaatttcatctcccacagcccccttcccaaattcatgtattgaagcccccatccccattgtgactgtatttggagacagggccttcaaagagggaatttaggttacagaaggccctaagggtagagccccaattcagtatgaactgtcattgtaagaggaggaagaaacaccagagattcacttgcccagagaaaaggccatgtgaggacagagtgagaagctggtcatttgcaaggagagaagcgttaggagaaaccaaacctgctgacaccttgatcttggacttctagcccctagaaccgtgagaaaatacatttctgtggattaagccacccagtctgtggtactttattatggcaaccctagcagactaagacacagtatttaacactttcatgtataggtctttattctctgaaaatctataatattttactctagtaaaaattctcttgctgtgtggaatttatgggcactctactagctaaaatcattcactttctgaaaagagtgttgcaaagggctacagaacatactggataccattgaccaaactaattagaaaactaatgctgctcagtgactaaaaataacaggggagtgggtgcatatgcaggatggggc

SEQ ID NO: 2405 - DNA, 3219 bp, Homo sapiens
gacttacatcactcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccagaataatggtgaaggtggacacatttgctgaatatttaggtgccctccatgaacaacacatcctgctgcctgccttccttcccttcctcctcactgttcccctcctccccttctccccttctcctgccttctctctcactttgtttcctgtctcattttcttttttccatttccctccctcatttccttccctccctcccccctccctccatcctatccaatcctttcttttttttttgagacagactctttctctgtcgcccaggctggagtgcaatggcgtgatctcagctccctgcaacctctgccccctgggttctagtgactctcctgcctcagtcacccgagcagctgggactacaggcgcccgtgaccaaggctggctaatttttgtatttttagtagagacggggtttcaccatgttgaccaggctggtctcaaactcctgacctcaggtgatccgcctgcctcggcctcccaaagtgctgggattacaggtgtgagccaccgcacccagccccagtccttcctttttgtcttctcttccgacatctcaggctctgctcacctcgtttcctgctgaaaagccgcatccctggctgtctgtgtgaagcagaatctaggggcctccttcatgctccagcttccatccttgaggctcgcctgcccccgggcagctctggcagaggaagcctggccctggcgcgtctcctcaggagcgctcatgacgggcacgggcgtcacaaacacaccaacagaaacaacctgtttccatcgcaagagaacagctccttaacacgtagcatttcattctaaagagtgctaaacagctatgaaaagcggccagtttgtctgcacgttgggcctttcaatgattttacatcatccttgcgagagccctgcggtggtgtcacgccctcgcaccgcgggtggagaagcgtgtctttcagacagaccaagcgatttgctcaaggtcacagggctcagaggacacaatattaagcccaagaagctcacagcgtgaggggaattaggggagacagacacagacagagattcttggaaaacagcagccgagtggtcagtaccgggacataggttcgctcaggtgctgggggagccttaaggaggagtctccagtatagagcgagagcctgatcttccaaacgccagcctactttccaccacggccacaccaaactgtagtattttgttaaaggttctcagaactattaagcatttcttgttttctgattctggcactcagcactgtgccttatgcataggagacacgcaataaatatttgttgggctggcgcagtggctcattcctggaatcccagcactttgggagcctgagccaggaggatcacttgagcccaggaattcaagaccagcctgggcaacatagtgagaccccacctttataaaaaataaacattcagctgagcatggtggtgcatgcctctagtcccagctacttgggaggctgaggtgggaggatcacttgagtccagaagtttaaggctgcagtgaaccgtgatcacaccactgcactccagccttggtgacagagtgagaccctgtctcaaaaaatatctatatatttattgacttgtctgtgcacagtcactgaagatttgctagtcatctggtaaaccgcgtcaataaagctagccaaccagcatgcattcggctcacaggtggctgttttggcttgtattacctggtttgcctgtctacactggcagaggtagccagatatttgccagatctttaccatgtagagaggtgtttcattttgtaagtaattgccaaacaacttgaaatcattttaagcctttgcatactctgtgcttatctgtgaccatagatggtcattctggaggcattatagaatgtcgtagttgagggaccgtggggactattgagccacttctcactttacagggaagccaggaggtaggtttggagagggaaatccagggtcggcagagtccgggcccctccccacatctggaagcttttccagggcctcaggcggcccaatttcttgcctctgctccccaggggacagccttatgaagctgtgatggttgattaatctgaatccataaatggcactggccaataaattgcaggccattcttaaaaagtttataagcatgccattttatacatgacatttgtaatgaggaaaagagaacttaaaacaaacccaaagcatgtcattacccagcagtttcctggtcctggggcacatggcacagctggctccagccgtttccagaagtttggggcggctcacttcacccgctctatttaggggtctgggaggccaagcagataattacagtaattatcattccttagatctccatcatgccttagagtttctaaagaactgtcagaactgctaggccatggcagaaactggattcttcatcttcatagtatttataatagaattttaaaaaaacaatgtttatatccgattgaagaaatggaaatttggcaaatagagattttctaaatactagaattata

SEQ ID NO: 2406 - DNA, 4854 bp, Homo sapiens
caagatcagcttgggcaacatggcaaaacctcatctgcactaaaactaaactaaactaactaaataaataaattggactaaattttaaaaaataaataaaaatttaaaaaatcaatctgtataatttcctaaatcaacagactaaataagaaaaatcatacaatcacatcaattgatactggaaaaatacatgacgaaattcttaaactattcatagttttagaaaatttaataaactattaatatagtgtatttttttcagtgtgataaagaacatcttcaaaaagtttatggttaacaaagtacttgatggtaagaaactggatatttttcccttaaggtccagaaaaagagaaggatattatcttttatcactcttattcagtatcgtcttagcagtgccacatattgcaataagacaataaaatgaaattaaagttgtatacattaaaaaaaataaaatgcctttgtttacagatgacattattgtacacgtagaaacttttttaaatcgacaacacgaaaatctcccaggacaaataaaagactataacaaggtcacaggaatacaaagttaacatacaaaagtcaatctacaaaactgtattatactcaggtgacggataccctaaatgctctgactttgatgactatgtaatatatatatatataaagtattatgtattaaatacctttatacaaataaaggaaagaaaaataaataagaactgatggatagatagattagaaagaaagctagattgataggtgtgtgtgtgtgcgtgtgtgtttgtgttagtatatacccactctgtataccgtttgccttcagcaagcacctcagtgggttgtgttttttattcgtggtggagcgacccaaacattcattcctgaagggtctaggtcatttgtagtcctgcctggatttggctgttgtagtttcccattgacctgaatcacagggcatggtaatactaaaagatgccctaaaggatttcctgtattctacacatactcttccttacttccattgcggagtagtagactgatttcattttgatagtctgggtcagtcactccaaccaacactgtaactcctttcttagcctgttgacttagaggtaggaggagcccaaagtaactaggtgacaagcttaacttcaagttcaatggaatcattgtgtctcctgatggcagcattcccccttctggtactaagatgtctaggctagcagaacataatgtggtgggaacaggaagcaaaaattttgttaatgggtcattaggggtgatggtgagtggtgccacttccacttccaccccttcattaatgtacccatgaatcctgactatgggagaaacagtaccatatattggacacagattcaggacatacacagccttctggagaactttgccacagcactgcaaagtattgtcatctagttagcattgtaattgtgatttcaaaaggccattccattgttctatcattccagctgcttcaggatgatggagaacacagaaagaccagtgaattccgtgagcatgagtgcactgtcacacttctttagctgtagactgagtgcctttgtcagaggcaatgatcactgtgagcattggtgccatatcaaaggctcagtgttggtctctgctgccagtaaagagggcactcagtggtggctgtagccagatcaaccttgcaaggaatgtggatggagaagggaatattggacaaggtcaggaccgccacttctagagaaatgtgataccgggacaagatatgactaaaaatgtctgcagagcagcagagagtgcctacctcaagtagaagtatgatagttgaactttattgtgctctagaaaaagcaataaacccttctgcaaacttcataagatagcacagtaaaaggaactctacaccaagaggacattttcccttcaaaataacaaagcagaacacaaagtaaatcaaagcatataaacggagaaaggaattccgttgcctttgaaattgaactccagaaataatttacttaaaaagagttcctcagatatagcttgaagtctaaagacaatcattgatcatcaactggtattctcttactccatcagcactccagatacaaagcaagagaaaacccagagtaaaaaatttaaatggacaatatttcatctgcaacctggaaagtcttctatgcttgctgttgtattgactttcctacttatctcagaaaattgtgcatttaatcatctctctctattttctttgactcttttccagtgagagagtataagattgtttacctaaagacctcgaagtctagcaagataggaagcaagttgttacttaagcaggttgggggggcattatgggcacaatgaaaattaatcattggttctctttgcctatcaaaatacatcgttcacataggacccctttccccaataaatttagatcatgcctactctagaaaaggaatcacagcattgtcacttcttgatgttgtgaagtaatttgtaatgcgcagaaatgatttgaatacatgtcccaacagagctttgtgaaggaaactcaaagctattctgacataatagcaaatgatagcagagaagggactgaagcactgcagcaaacccaaaattgttccaatattcagctgctagaacaaaaaagaaaagcctcactactgaacctttttcatttcgtatagctgctcaaaatttagaaaactcatagaccataatccattaaaacagcatctattacatcaagttctaattgctaaacttgctggtaaatccttggggtaaagagattggaactcttccattttcaataaagattatttgtaaaactaaaaaaaaatccatgagacaatctgatagatgtctcattattcctgatctgtgttcttttttatttcttagccctacctctacaaccgattaaaatgcttagcctaaatactttcaccatttcaaagaaaccactacaaaaagtgctattttttggccgggcgtggtggctcacgcctgtaatcccagcactttgggaggccaggcgggcggatcacgagatcaggagatcgagaccatcctagctaacacggtgaaaccctgtttctactaaaaaaatacaaaaacataattagccgggcgtggtggcaggtgcctgtagtcccagctactcgggaggctgaggcaggagaatggcgtgaacccggaaggcggagcctgcagtgagccgagcacgccactgcactccagcctgggcgacagagcgagactgtctcaaaaaaaaaaaaaaaaaaaaaaatgctgtttttttcctggattttatgaggataaaatttagataatcttttaaaaatatgtacaatataccaaactatttaaatagacattagcattttctgttaaagtactgacatagtatttgcaactattttttaaatcatttttctactcttgatcgtttatagtcagaatttcagtcaagtttagcactatccaaaaaaatcagacaggatgtgttgcttcacaaataagaagctacatgtaagtcctgaagcacaaggtttaaggaaaggatttcagcaatgacttattcagcagatactcatcatatttcctcttgtgagttctgttatatagtccatattcctatgcttagagcagggattattctgcctcattggccttaaactacatcagccctataacctctacttccccacaggtttcagtgatctcccaattctgtcgcagaaagcttttccaacaaagtacacatttatattacaaccacaccccatatgtcctccatgaactcttattaattctccaatacacatgccattttattgctctgtgaagtcttccatgttttttccacgcatgctttctctgctggcctctgtgtatacctctattatatcatatagttctgtgcttatcacgaatttttgataatgcatttctggcaataaaggagaataaaacagaccctccaaagagtttggatgaattagagcaaggtggcttaccatcagcataaaatttcttccttaaagattagtttaattttattttagatataggggtacatgtgcaggtttgttatatggaaatattgcatgatgctgaggtttggaatatagatcccaccaccaggtagtgagatgctaccaggtagtgatacagatgctcccaccaagtagtgagcacagtacgggttaagtagtttttcaacccatgtttccctccgccattcctcctctactagtctgcagtgtctattgttcccatgtttatatgcatgtgtgttcaatgtttagttcccacttataagtgagaacgtgtagtatttgcctttctgttcctgccttaattcacttaggaaaatgacctccaactgcatccatgttgctgcaaaggacatgatttcttgaaatcatatgttttatccggtaaaaataccttaaaatatttcatgctatgccattatgtgtccttttaaattatttgtcattaataaaattgaagtttaaaattatttctaatgttcagcctttgttttgtgttctctttgcattagcactgtacacattcagtttaagaatcacctttttagattcccaacaaatggaaaagtgatatttgtataatatatatattttgtaaaacacaaaacaatatgcagcagaaaaattattgcactaagcacatgtattagaaaagaagattctcaagtaaatgacatcagcttctacatttttttcattatactttaagttctgggatacatgtgcagaatgtgcacgtttgttacataggcgtacacatatcatg

SEQ ID NO: 2407 - DNA, 6844 bp, Homo sapiens
atttgtcaattttggcttttgttgccattgcttttggtgttttagacatgaagtccctgcccatgcctatgtcctgaatggtattgcctaggttttcttctagggtttttatggttttacgtctaacatttaagtcttgaatccatctcgaattaatctttttttaaatgaaatattccttttttttctcagtgccatagataatagatgggtggactgtaacagtacctagttttcagctgaagcattttaatctccatcatttccactattaaaagaactaaatcatgcctgcttaatacgtcgtgtgtgttcgatactatttaggttatataatagtatagctcatttgaaacttagtgattctcagaaaaatctgagtattgcttatgttactaagagtttgtcatctggggtcaatacttatcatgccatattgctgtgtcccctatctcccattggagatgagaaaactctgacttttagtgtcagactgtctggaaatcacaatgtgaaattatcttctaaactaattcagctaaatcacatttaatatcagattttagtgactttctcatgactgtttatcaactcccaaatgactctttaattaattgtttctcctttactggctcattttctgtcagatccctttccttagagtgttgttttatccctgtgtggcagaaagactgtctgagattgtgctgttattaaatgtagtctggcataatttaagcacattaccttgatgatggtgatgtcactcaggtacttggcctacaaggagctagtacaatttcacttatttcattttaatggatccccttggttttgagcctataaactaaaataccattgcagtaccctccctccagcaatctcaaacttaattattccactccaggaagctgtctgatggccctgcagagacctgtttttgcactaaaacgcaatcccttattgtgtgacaaaattacttttgtttcatgttcttttctttatttatttacaaacagcatggaaaagcacttctcagcacaacttaataggtgattaccacaaatttgattttgagatttagattgaatagttgttaaagttttctttgtattctttcctttgtaatcatgatgacttcttaaatactattccaagtactgggcattgtgggtaatgtggcataaattgccaagatagctgactcaaatcttttcccctacttagttttgatattatttattaagtttcatagcttggatgacacctcttataagcccatctctaccaatatcttttttgctgctttgagcaaatttagttttctaagctaaaatttctaagtggttttgcagaaagcagaaaagacagagacacattgcagaaaaaggtgtggaaagattagagattcatagatgttgccatttgcagtacaaagttatctatgacaatggtcagtaatatatttcataaatgatcaaaagttttcacttacaatttcaacattttcacaattgtataataaccaagaaatacttagttttgttcatagtcaaaaagaaggttgaattgagagccagaaactctgtagtattttgcaagggacatatttgtctctagtcatcactttggtctatggggactaataggaaacgaacttcgtgcttctgtcacattttttgaagacaaagggacagcccatggatgtgctgtattttctattaataacatgttctttctcttcctagtttcctaggctttgaaaaaaatggtgaagagagagagaaaagagtaagagggactggcatacttacactttatgtgtgcatgcagtttttaattttgtgcttttcaaccctctctcatcagtgcaagaaattaaatgcatgagaattaatatgctcaagtcaataggtgaagcaataagctataacggaagagaaagggcttccatcatgcacaagctttatagacatttaattccctatgtggacaggaggtttacttatctgcacaagagcttcacacaaaacaagaattagattctcttcattttgagtttgcaatcctacttcatacaacaactgtggaattgagaaagaaaaataaatgcagagatagacaatatttggaaaaggagtcagaatgaaactgaattacacttgtttattttgagtttgggagaatgtggagaaaaacagattgaattaacacacacagaaaccacaaacacttttttcaaaaactcattttagtttatcttccctgaacaaactgagcaatatttagtgaagctctgtcttagtccctgtgaccacttttaaattacaggatggtcagaggaggattggtgagcacctggaagattgacaagtcacttccggcagagcaggcagatcatcaaatgtgatcaacatgccttcccctgtctccttcgtggtatttttataaagacacagtgtttgaaggacattaatctaaatgacgggtcacaggaaatgaatgtgataacaacaggaagtgtattatggagatatggttcaatacaagcaaggtaagattctgtaactagaaatattaggagatagtctggatcccagacctataaaaccatgagtgaaccataaagcattagaacagggcaagtattcatatactagatgaggctgggttttggtaactgtatataaaacacatttattaagcgtaaaacctattggccaagcattatgctagcctttgaagatacacatatgaatgaaacctgccctcaggaaattaaaagtcttatgggaggtagcctcttcaactgatagcaatgagataactaatttttgaattataaaaagcctgtataaattatgaaaagtaccttgaatgattatgattcatttactgcaataactgaaatcatgttactcttccactctccctgcaatgtatcctcttaattcagatgcctctaaggtcaatgtaatccaatctctatcagtttttcacagatgctggaattttggatagccctgggagggtgtggctggggcagaactcactctgcatggtaaaattagtggtctgatgttagaatgtgagatttcaaggacatagtataaaaccaatcatttcactggtcatgatcccttcattatggataggatggggtatcttgctccaatgaacttaggaaagaggaggtccctggattcctacttcatatgagacaacttgtttcctagcagtcaccctacagtctctagaatgaaaatgccttcatagcattttgtgctcctggtagcttaggataacaccagtgacctccatgtgattagatgcagacttcatccatcatctacatttgaaatatatgatcaccctcttctctttaaaacactttcttctcctgacttccagaacagaattatatcttgtttctcctctacctcacgggctgttacttttcagtctgttctgctggttctactttctctaatgtttccaagttggagtgctcagggcttaatcttaaggctttaatcctaccaatctaggcacccatctccagtgatctcatcaggacacatggcttcaaataacatcaatatttctgatgattccaagtttatgcctgtggcctgaaccatttctacaaaccccagacatgtatgtcaaatttccatgcaacatgtccacttagatttttcaaattgataacaacaaaaattgagttcctgatttctcttctcatacttacttccctctgcttcctcaatctcccctcacagtaacagtcaattctgttattcacactgctcagcccaaaaccttgacatagtcaaggtttcccaccctacatccaaatcaatagcaaattctatcatatctatttttgaaagacaatagaaaatctcactaactcttaccactttcactgaaaccattctcatccaaacaccagcatttcttacttggatttctgcagtagcctcatacatatcacccttgtcttattacaggttagtctcatccaaccagggagttctttttaacacatcagattatgtcactcccctacaaagccttctagtggtgatccatctccacaaagcaaaaatatgaagttctcatccagtctaatgatctggattccgtggcatttttgtgatctaatactgcccctcagtttcttgaatatgcaaaacatgttcccatctcagggccttggcgcttactgttttcattgtgctctttaccaagacatttgcacagcttatccctcacccaattctcaaccaccaccacctcagagaggagacaacacaactccctgaaattctctatctactttaccttgcttgatttgtattaagttaccatcacttaacatagttgctatattttttatgtctttattgtcagtccttcctcattgttctgtgagctcttttagggaagagactttgcttttctccatcctcttttatgaacctaaaagagcttcacataatatgaatacttgatgatattgattaaataaataaataatgtaagcccattgagaagctggactcattccacgctactgcatcactgatacccatagggaagaagagttgttgttcatggtgccatgtgatagagttttcacttctcctaaatatgagaaataaatgcatttgtccctgttcattccaggcaccattagaaccaaagcactctagattatcaatcaactccttgatttacttctgcttacttctctgcacactcgttaaccttgcccagtttctttctattgctaatctctgctttatcaatcttttcctcttggacttatagtctgtcatcagcaaaaacccctatattctgaccctcttccctaagcctgcccttcacactcttattccaatgcaaactggctatgtctcattgacctaactttctagccactttcttgagggaaatctttttttttctctcttttcctctccttctctctaacatccccatatacaacaatatctgaggtgagaacagacattatccttgctttatactttttttgttttcaaaatatttctcctccctgtgcatacaaaattttccccacctttaaagtcataattaggctctgtctcctgcaacatctctttgtagcagttatctataaacctccattcatttcactccctttttcaggatgacttcagcgtatcacccaatctcttattttctacctgcttccctttccccttttgattacttaaacaattctactgcactttccagtatgttttattttcctccatcaacaaaatggctatttcagacattcttctttcttttcagatttcctcataagcagaggagctgctgcagttgtgagctttacatctgcattaacaaggagtatcccctttatcaggaagctaaaagcttctcaaaaaaaccccagcaggctgctgtttctctttggccatatctgcggcaaatagctattccttgctttaaggaaattagaaaaagtaaaagtttagcttttccagcctttatatgaggagatagcaagggaaaagagagcaggaattatctgtagggttagccacaagaatgcccaacacaattgttcatcatctacattacaagcaggaagtaaaggccaccacacatcttttttgaacaaccttatagcctgcagctagtctctattcttgacctaccacaatccatgttccatgaggccacagtgacctttgtaaaacatgcatccaatttgtcatttctctactaaaccctccaatggttccaattacatttaggataaaacctatattccttataatggtttgcatagccctgtctattctgtgacttttatttcttaccactctccaacttgctctccctgcttcatcaacttaggcttctttatgtttctaaagcacaccaagataactcttgtcttgttccttctacctggaatgaatgtctctttgatcttctcttatctcgatccttttgtgatttagatgctggtttaaattttcctccttagacaggatttccttgaatcctctatcttaagtaactaccttttcattattgtgcttttaagttttttaacacagaatttatttggagttctaagaatttgttttttgttctggtgtgtatctgcagtttaacagggattatctatagggttagtcacaagaatgtattttcaggtcctagagaagcataggcatcaatagtaggtatcaataaatgtgttaaatgaatagcaaatgtaccagtgtgctaaacaattaaatatgtcactattagcctcttttaaaaaaaaccttgaaaagtatgtattagtatttttctatttttcagataggaaaattgaagcattaagagaaattagacatgttcacagttacactgtttggttctctaggatttatcagtggatcatctgacttggacaacccctatacttcccactgaattgtcttaatatttatgttgaaaagcaattgatcttacatgtttgagtgtatttctggactttattctgtctcattgttatgtttttttttctgtctttatgcccattccatgctgttgttgacaaaaagagtcaaactctataaaatattttaagagatttattctgagccaaatatgagtgaccatggccggtgacacagccctcaggaggtcctgagaacatgtgcccaagttggtcagggtgtacagcttggttttatatattttagggaggcatgagatatcaatcaaatacatttaagaaatacattggtttggttcagaaaggcgggacaactgaaagcagcag

SEQ ID NO: 2408 - DNA, 545 bp, Homo sapiens
cctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaagtaagtgtcatattttgacagtaactcccatgtgaacaagatggtaaaatattttaaaagttcaaacagtagtgaaataacaaaatataaatcatggtaatatgatgagttctcatgttggtggtgacaattctacagcacagtcactttttagccctctgtccggacaccacaatttagtacatcttcagctaaatcagagctaaaatgaggc

SEQ ID NO: 2409 - DNA, 4068 bp, Homo sapiens
aaaatgtaaagtgtatgtgaaggtatgggggagggaataggaaggggagatgataggcgatgataacttttcattagcttctcaaaggagtctgtacatcccccgcccccactgcgaagattaaaaatggtttcttagaggcttttaggcagggagattttccctttaaaatcagcagaagaagtctggatgcagcatagggaaaggaggcgtcatcaggaagtcctaagtctgaatgtcagctccaccttctctttttctcttatattgtggtaaaacatacataacataaaatttaccatttcaaccatttgaagtgtacagttcagtgacatttaggaaacccacattgttattgggtaaccatcatcaccatccatctccagaacttttttcatcttcctaaaatgaaactctgtacccactaaatagtaactgcctactacccccaacccctggccgctggcaacctccattgtaccttctgtctccatgaattgtgatgactcccggtgcggtacgtaagtggaaccatacagtatttgtctttttgtgactggcatattttacttagcgtaatgtcttcaggcctcatccatattgtagcatgtgttagaatttcctcccttttaaggctgaataatattctgttgtgtgcatatatcacattttgattatccattcatctgtcaatggacatttgcgttgtttccaccttttggctgttgtgaattatgctgctgtggacatgagtgtacacctgtttgaaaccctgcttttggttcttttgggtatatacttagaagtggagctgctggatcatatggcaattctatttaacaatttttgaggaaccatgtattagtccatttttacgctgctgataaagacatacccaagattgggcaatttacaaaagaaagaggtttattggacttacagttccatgtggctgggaagacctcaaatcatggcggaaggtgaaagacacatttcacatggcagcagacaagagaaaagacagcttgtgcaggggaattcccctttttaaaaccattatatctcgtgagacttattcaatatcacaagaacagcatgggaaagacttgccctcatgattcaattacctcctacccagtccctcccacaacacatgggaattcaagatcagatatgggtagggacacagccagatcgtatcaaaccaccatacagttttccatagcggcagcaccattttaaattcccaccagcagtgcataaggtttccaatttctccacatcctcatcaacaccactttctgttgtctttttttttaatagccattctaatggtgattaggtgattaggattatctcattgtggttttgatttgcatttccctaatgattagtaaatattgagcatcttttcgtgtgattttggccacttatgtttctttcttgaaagaatgtctgcaagttctttgcccattttctgatttttttttaagttgtgggagttcactatatgttttgcctattaatttcctatcagatatatgattcacaaatattttcttgtatttcatggttgctttttcactctgttgctagagttctttgatgcacaaacgttttaaattctgatgaagtctgatttatctattttttgttgcctgtgcgtttggtgttatatccaagaaatcactgccaaatctagtggcatgaggcttttcttctacattttcctaggagttttatagtgttagctcttatgtttaggcctctgatccatttggaattacatctccacctttcttaactatctgtggctccttgggaaaactacccttctttcctgattcagacactggggatgggaaaattacctcaaatgaaggttaaaaaaattgcatgtatctcctatactacctaacactgagagctcaataatattttgttcccttgctccttcactcttattccttctggaaagaagagtaaggaagagggagagaaacagtttggtatttttaggtagactagggagcatctcactggctggagtaagatgtgggggcctgctgtctttgcacatcagccctggtgtttgctggccctcttttccaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggtgcctgaaagagggaggaaacctggacccttgctctctgctgctaatgcataattggacatcacagcctatagttcatttgcctctgagaacctggtcttgcctctgctaagaagagaaatggagggattttgagggagaaggggcaggcccttaactctttttctggttttctaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaacaatgtgttctctaaaagtatgatttaatattctacctagaaactcagaatatttttcataactcctccagggcagtgtggattatgttgatgtgttaggaggaagtagaaggaagaaaatgaattgagatgtacgttttacttccatgtcaaagtcaccaaaatagcagttgaagggatatttgtgtcaggcaatagggagaataataattttatgccaccctcaaaaaacaaccacacatacacccaaattctctcactcctcagagaaaggggaaggaaagaaaagagagaagcaaaatatgag

SEQ ID NO: 2410 - DNA, 933 bp, Homo sapiens
aatcactaatgacctcatcttcaaatggtcagtgataataaacaagaaggagggatttccaagggagcagagcattaataaggttttatctactacaaaggatatcacttgggaaggaatttcttgaaactgctcccaagagagccattggaccatgtggtaaacaactcctagctgatggattattgggaatattaacatcatccagaatgctatggggagaagacaactggaagctccgtgtggacaaacctcctggactctgccccacatatctcttcccttggctgatttgaatttgtatcctttcactgtgataaaccacaaccagattattacagctgtcagcaagttcttctattgaattgttgaaactgagggtggtcttgggaacccctgaactctactgttggtgtcaggagtgagggaagtcttgtggactgtactccctgacctcacaggtgcattttccaactttatttggacattccccaacaacatcatccccttcttcaaatatgtttctgctacaaacattgtcctttagatggttcctttgctgccattatgactatggcgtaatctgtagtaaagcaccattaagatgttaatacagatgtatgtgtgaattaaaaagtgatgctaaatgcatagtaaccaatttacttcgcattaataatttagctatttttatttgtttctaaacaaaaagcaaagaggatccagtccagagagcagttgcaacagtgtgcacaatttttattaaaccgaaataaaagttcttgggctatggaagtcacctaaattcacttctcttttcctatgaactttcactttttttccttccaactctagttagaagctgacagctgacacgcccttcctttgtgcattttatcctgggacaaaatgagaagacatccttcagttccc

SEQ ID NO: 2411 - DNA, 71028 bp, Homo sapiens
aagggagaagggaacagggaccacgggtgcgcctggggacacgccccgagagccccctttgtggcttcatttcccgtccctgctgaacttcgctcgccccccttgggtttgaagttttctcgtaccccctctgggcagagtcggtgtccttctggctgtttgttaggctggaaagaggggagccaagttctttagggaaaattattttgtttttccttatctcctttctcttctcttcaggaatggtactagatattttgaactaaaatagctcagattggggggaaatggcccagcgactgtatttcatctttctggtcccaagaggacgctggaatggagagtcgtgcgtgagtgtgtgcgcgcgcgtgagggtgtgtaagtaaaatgccaaaaattaaaccacccttcatggtgcccctgaaaccaaccagtggaaagggaggtgacagtttgtaaacaacatgttttactttgccctgaaagtgtagacacttttcaagaaggccttttcgaagagtttagctacgcaaccgttttccattaatgttaccatcttgtgactcgggtgacctgtgcgacttgggtcgtgaattctcaggtcggccttcccaatgcttgagaaggttgggggtggttaataagccccgagaggctctttcagcccgtttgaggaacatacaagtaaaaacagtgatgctttgtattgtttgttcttttgagatttcgtgtgaccgtttaaggcctagaatgttggtttatttgaaggatctctgctctcctaagggtttacccagtttgtaatgaagtcttcaaaactagtttaataagtgtaggaaagtgaatgatgcgcacctctgcgaaactgacaacactaaataaatacacgcaagtacagcaaaatttacccttatggaacacagcagaggttttctgctgctccgctgatgctttgagtcctgtaaatttaataaaacttagtaacagaaagaaccagtgatgggtgtaaatggaagtaaatagcagttaagtatttattgttttgaagactgatttatctaatagaaagaattgtgaaaattcaagtttaacattagaaaacgctggtatcatatttcagaacaaaatggttccctatgttgactggtggaatactgagtctccacttgtgacaactttttgctttaattggatattttatataactttcaactacaaacagtttccaactattccaaaatgaaaatatttcatattattcttttctattgttttgcaaattattcagccaatactaaatatgattgacaatttatgtacatcaatacttaaaatttctctttattccttaatataaatgtaaagcaacagagaaaaactatttaaaatttaaagtttacttagtgaaaaatccaatttggccaattattaatttggaaacatctgatgtgcttcgtacggagccagtgtcttgcggcttgaaatcaggctgcatatgaagttaattgaaattgcttcggtattgtaattaccctgcacttttctattacttacttttaagtagaagaaaactgggaactttatattcacagaaaagtctttgtagaagggcgtctgattatgaaatactgccaggttgaaaataaatatcattttatggaaatggatcatttaaagtatattttatttgcctcacataataaataatttaccctctaaattcatcccccattttgaaaatcccatctttggaatatctaattttaaaagaaaagactcagcttttcaaagatggccccttctacttgaagggcaggatggagacctcaagaagcgcctcatggctttgcttgctttacattggtgacggatcagtgttcagggaccaggtcccagggctgtgaatgtgcccataggatttgatgtttgcgcactgacgtttcagtctttctttacaaggatgatttggagcttgtgctctccttagtacccactgaaattccgctggaaccagatataatgtcgcaaacgctttgtaggtccatcttcaatgcgccgaaatttgagcaggttattttgaaactgcatttgcataagtccatctgagcaaacatttttatggagttatgaggtgtggtttgcatcagccatctttgagaaaatatagtggagctactgtgctcggctgcaaaacaagttgtctgcctgttgatttggggaattttgtgagctacagctttggatgaaattctcctctggtggaacacatattaaatattattagagaacctctattttttctagttattttagtgaggtcgttatgtaactggtaagaggagaagttttgattgctttcaaaatgatggcgacatcaatcttcttcatgttgcatagtgcgtttgaagattacaaacatttttccacttactgtctatgtttactgatttttattagtaatggcttttattttagatcaaagtcaatgactttggaaaaaccatagtaacaattataataaaaatcagttcctgttcacgttatatttggtgtttagagaactgccgtatactacatttacaaagataaacacatgaagcgtgatgactaataatgagactgattttgtttgttttatggacccagtcttagtacttatgaagattgcatctagagttaatttctctggagtacaatgatttcatttccttgtcattgtatttttagcttccattaagaatcatccataccttttctgctcttgtttactgtaaagattatcagccatgtatagacacagataattaatattttataagatttttattttaaatatgcattctccaaattggctaatatagaggcattattgtatataaaacacgatttaggctatttaggaaacaagaaatataaataataccctaagaggagatttgggataagttaggaaatcagaataatttgagaacttaacaaatatatattttttccatactagcagaaataagaaaacattgacattctggtgaatgttttataaggatttatctcctccaacatttacaatgttttatttttaaaattattttgttttaatcgtgagctttaaagtcaaacctaatcctttatttataagaagttatttattaaccttgatgaacgtcagaaatttaagttttaggttgccagttttaaagcactcattagaatgaaaacagagccactcaattccgtgtgaaatgttgaagttagctgtcagatggaaccacgaagtataccactagccatggaggaaagaaaccaaacacgtgcacccctcttatgaagtgaatgtagaggtgattttcctaacttatttgatttgcagcaaaatattcctgggtaatgcgtggcatcaggttgcatatttaatttgagtatagatgacacttttttctgtattattttttaagcagtgaataaaaataattataaacaatagaaaaagttttggtttagcatttgatggctagtgttacctgcgtgtaaatgcttgtagttaatgaaaacatgaatccagctttgatctctttgatctatagtcttccgtatagcattagaacactggctgtctatattttcagagcaaagtgctcccctcactcggaatagaaaatgttgtaagtagcaactccgatttacagactctaattttacagacattctgcagaaggatctccgtgtaactgttagggagtcattcgcaggcaagttgtgtatgatgttcacccactttgatgggtatgctgacaattacatccagagtcagagagaagaaataagaatttgctaaaaagggacattccctttcattcatacttggtcctttctggaaagaggatggaatttctaacatctgtgccagttaacatcagtttgagcccaattttaggggaaataggaatacacttgtagaaggaattttgaaaattttaaataccatcttaaactgcacataagacaagcattcagcagggaaaacatctgagaggattaagcctttaccccaacagggaagaaaaggggggggtgctattttcttagcagcctgaatgattcttttgcttatctagaaagctttccaaagttttatcagaaaaagaaattttgcttgagggtttgttgtgataagtatttttagatagtatgtataatcatttagttgtgaatttttctcaaattgccaaagagatcagtattatgaaatgtagtacattattcccattagtcacagtaaaggactatgcatatggtgcacacagagctgttctaatgccagtgctgtaggggggaaaagaagaagaagaagaatttgatcaccctttttatttttctatccatgtattcttttgctacctccttcgcagtttatctaattaataatttaaaaagcccaaatctgtccattggaatgtgaactctgatctgttaagatctctttgccagtcctaatagtcaccagggggcagaaaaaaaccaaccaggattgactcacagtgaaatgattccacattatccagtttctttctttccttctgatttatttatttatttatatatttatttatttatttttgtggctttaagttcttgactccagtttaaactaatattcttccccgcccacaacagccggtcctcaagtgaacaaattgatatagctcaattcacaggtttgataaacaagaatacacaaaatgttgggaactggggtttaatcaagggatagaaattaaaatggactgaactaaatatggaaagtaagaattgaggaagcttgagatactggagttaaaacccaaaagagaagttcagaagtaggacacccctctcccttcatctgtcctggtctccctgccagacaaaagcttgaatggtctcctacaccacaaaatcctacttaatctgatttttatttcctgccacagtgattatttaattggggatggtctaaatgatattatttggtatattttaacagggaaaattgctgtggatctgcagctagtgtgagtgactggtagctgcgtttagagtgttgaaaagttttgcattaagtaaaatgatccatattacagaatcatggcaaagatggtaattagtggtttgcagaaaggagcacacggcagttccctttctgtttaaagaacctggctggatcttgagaatatgcgtgttatcctggatgcctaatactgcatgttcccaccagtgagtagactggcagattctgatcctaattaagaagacatgtttttgaatcaggaatgtgaatttggtttgcaacaccaccacgggggtattgttggtgagctgatagtttgactggctccatgggtggtcactgtttaaattccacccaactaaagagctgtacaagattttagtcttcaaagtttacacacagcaagtgtggggagaagttatcactgccagctgttgggggaggaagtgaaagtgagaaggacccctccccccaaataacttgtgtgtgttttggatatgttgcatatatccatttaatatgataaactctttaccgcggtggaagttacagtcaagttgattgatcttcctcttccccacagctcctgatggattttataagataagtaagtcccctgatggtttctaaggcaacttttccaacttgctgacagcagatctgtaggggagatggcacatattggtgctgatgtactttatgggcaaaaagggagcagttaagcaacttgcatgaggatgtgttcataactcacagctcagttggacaaatcaatctttccatgtgttcagaaacaaaaggcaggggggtcatgcatgtgtttgggagtggttatcaccccatgaagatagtttccacgccaattttgccttctttaatgtggtatttgctttaaggctgtaccagggccacttgcttctgccttttctttgcacctgctttctcttgatcacactaatgacccatcagttctcagttaccacttcccactctgacccaaacctggaaacctccaattgctgctgtctggacatcttaaatactttttggttttgcaacttgtctgtggactccttcccgaatatgtttttaagttttgttaggcctgcccttcaacctgccctccagtgtcaggagtagactaggtaatatatattttaaagatgcattggtttcactaaatctcctcctttggtttattttgaattaattattgaacagaatgatttaagatcagtctgatattttcaggtgtaaaatgagcatctttgctctaagttaattactgggcttctgtcgaggagtgccacagaggaaaaaactctggactgggagtcagtgacctggacaagccaattaacctttctaatctagcctctccagggattggaaatgatcaattgcagtttcttccaagaataaaattaggtggctcttgtgcaaatcttagcaaaattgtggagtgatacccaatgtagaatgcctccctccatctacttcctccatcacctgatacggaatatgtcccacatcaattaaatttagccatggacacaggtacatatttgtgacactgatcacccatgaatacaacaataaccacaaaaagagaatgaaatactttctctagcattcacaaagaatatttggatcagtgacataattttaaaagtcagaaaaataaacactaatgtcagtgaacaggaaaaggttttatactgttcttcaatctctaaaaatgtttttggtataagaataattttttggaatgttaaagtaagtactttaacatttactttaacaaactgaaagtagcactttcagcttgggagacagagataataattttcatgtgtctgaattggattgtgttaaacacaggccaacaggagtgtgtttggtgacatcgatggtttcagagtcagagaatgtaaacataggacccacaaacgttttacaggagcacggctgtggctactgcagggactcctgaaccgtgacgcacagtcagttggccgcagagaccagcctggagctcgccctaaaacctctttgcagccttgcagatgtcatagttgtcccaaagctgggcctcatgcttccgtgtagcctcactgaatcaggagaccgagtgtttccagagccaggatgtgggcgctgtggggccagtgctgcatcctcctgcgctggcaatagcagagttgtggagaaactttatttggtatttgaaatgatcaatattttaaccttctgcataaaaagagagagaagtctgtgattaaatcttgatttaaagtcttcaaatatgtacatacatgaggatgaacataagcatatttatttcaacactgtctagaaaagtgaaaattagaaaccacttaaatgtttctcagttggaaacataaaccatgtgtaggtataaggtcatgtactactcagccattagaatgatgctgctattttgcattgattgatatggaaggagaaccatataatattaactaaaaaaattacaaacagcatgtatgcaaagatctcatgtttgtttttgaaaagatgtgtatgagtgtgtgctggtgcctgccagccttaaaaaacatctgaagaacaaatgtaaagaacattaacagtagttctaactctgggtggggcaattagactggtttgtctttttttcttcctttttaatatggtctatttttttaaaattcagtgagcatgtattacttttacaataaaagaaaacaataaaactatttttttctttatctatttcttttcctaaccgtctgtacctgcgagtatttcatttttaaaaacagcaacagaaggagtagacatttcacattggtattgcactgtcttgaagactgagctgccctttagcatcttacattttagtcctggaaggtagctgagagctgttttagcccagccttcctgtttttctaggtaagacaaatgagcatcagagaagtcaagtgaattgttgaaggtcacacagcgagggagtcatcaggctgtgatgagaatccctgtatttctgtcttatattttctgctaagccaccattttgtcatcctgggaatggaggagagagaaatggaggcattcataaattaaccgtgtatgtaccagccttagtctactcacttcccctaagagggttgagaaaagcatccttggttgtgttatctcctctcaccccatcctgctcacccacccacacgggacttttatgggagtggcagtagactgggtctctcctgggcatctcatgctctgttccttcctgccaaacagaagccaaccatcacattttcttctctgctcttctttgttcaaggttactctttttccccagatccttaatagaggaaaaacccagtacctaccttcctttcatacccagaaacgtcctcttaacaccttcaagctgtggtttaaagatgaaccttttgagatgtaaaagcataactaatatttaaaggaaacaaaacacattttacttcttactcccaagccagttataggaatgcccattattatttctgccaccccaattcccactctgcttcaaatttgtttcaaccaaggatataatttggactgtatttttaaaaagtaaaccttgctttgcggggactatatttgcattcttgcttgcccttgagtgtgctctctcttgctttttcttttcctgaactatttgaaagtaatttgcataactataattttgttatcatagctcaggaaattagtcttatttaatttttttctaataaacactaggtttttaactttcatttgtcagataatctctcatatagctgatttttttttttttgcatttgtttataatgtctttctctttttttgagacagggtctcactctgtcactgaggctggagtacagggtgcaatcacagctcactgcagccttgacctccctggctcaagcaatctcccacctcaaccttccaagtagctggtactgtagacgtgcaccaccacgctctcctaatttttgtattttttgtagagatggggtttcaccatgttgcccaggttggtctcgaactcctggacttgagcaatcctcctgcctcagcctcccaaagtgctgggattacaggcatgagccactgcaccagccatttcttctttttaatctaccaagtatacccacctctttctactttccaatactgaagattacaggctagttgtcttggagaatgaaccatgatatggctgtgactgttgtttcttcatgaccagatccaggttaaacattttggcaaagataggctaagagtttgaccccttgtttaacatggcggccaccggattgctccattgtagacagacatttttctgtttgtgataagtagtaagttgtctgcagaggtgctaccatgagaccctctgaatatctatgttccaacagactttcatctggtggctttgtcttttaatttgattaaatatttaaggagcaattgtaatgaaatatgtggatcactttagaatgcatgagtttggacacacagtttatatcaaacagccttgcaaatatgtttgcgttgtatcaccccatagatattatctagagcctctggatttttctagtcctgacttcataggacttgatccatgggtcagctacttcccatttaactctataagagacattccatctcttgagttgcagtgcttttaatgtccattttaatgctaatggaaataagtggatactgatgtaatttgtactgctcatcagatttttttgggtatcctcttgaagttatgttggttctttgcagaagccttttaactctgttttcaaaatcactgtatgaagcaggctttaaaaatgactgatgacttgccctggtgcctaaactgggtgagtcttggggctggtcagtgactagcagtttgttcatgttttttagatttaagttacacagctatttttgcctgttccactttggtactcctattttcatacacaaaatatgtatgggtgaaaaaggtggtgtggagtagtgaaaaggagcaggagcaggcatgatctatgttctggattcagctttgccactactaaccctgagcatcagtgttcttatctgttaaaggaagcagtaataataaagtgaataacaactaactcgtacagagtgctttctgtgtgccagccactattctaaacagttgaggtattttcaatccatttacttcaacaataatcctgtgaggtaagtgttgttattctccccatcatgcagatgaggaaactgaggcacaaccttactaggacccaggaaagctaagaaaaatagtatttatgaaaacatggtggaatggggcttggaataaagaatgttatactaattcaagcaatcctgtcttctctgtgtaaatatctgtttccttaatttatagaaaatccatcacttacaagaaaatattatagaaaaaaatgactaaaataaatctgaaagtaggtcaaatttaagacaaactaagcaatccaattaaaacttttttttcctgtttccgtcccccacccccgcccttttttttccccttaaaactttaagtacagctttggtttaaagtgaaatctatatcccaatttaaattccatgaacaaatctgactctggcatttgattcactgtcttactctgcttgttatgcatgttaaacaagacctaaatttgatgctcacagagagcacataaacacttataatcctctcagcatgtgctaaaataataacagacacgatagtttgatttgcaaagtgtgtctgccaacttccaccagaccatttttgaaccaattcagaaaaccaggattctgcaatgattaaagtgtccaaggctcctattcatagcaaaaggaattcctgacttgaaacaagtacacatgaagctcagctagtctctgccagacatactttttgaaccatctttgcagacattgttacaagtgttcttttgctttaagaaaccatggtctgtaacaaccagactgaacagaatccataaactggggaaggattgtgccttttgatctgcgacagggtttacagtaaaaatcctttaaaccatgagtttctcagtgtatttcaaatagcaattcaataatgctaacaattcagaggtctaataataaaatttaaaactttttttggtcttttttttttcaattttaagaggtataattgaagtgtggtaagctgcacatgtttaaagcatccatcaggatccattaaaccattaaacaattgagataataataaacattgttggctgggtgtggtggctcacgcctataatcccagcactttgggaggccgaggcacgtggatcacctgtggtcaggagttcgagaccagcctggccaacatggtgaaactccatctttactaaaaatacaaaaaatttgccgggcgtggtggtgggcgcctgaaatcccagctactctggaggctgaggcaggagaatcgtttgaactcgggaggcagaggttacaacagtgagctgtggagatagcgccattgcactccagcctgggcaacaagagcaaaactccatctcgaaaaaaaaaattatcaccccacaatgtttcttcatacttcttataatttatctttccctcttctccttatccccctcacattcagggaaccactgatctgctttctttgtttgcgtttcctagaattttatacaaatgaaatccaagtatgtactcatgtgtgtgtgtgtgtgtgtgtcttctttcactattttaaagtgcataatttagtgacatcaagtacgttcacagtgttatgcaaccatcaccactctccagtaccaaaatggttgcattgcctcaaaaggaaacttcatacctactaagcagttgcttcccattcccacctctccccagtccctggaaaccaatctgctttccatccctatggatttgcctattcgggagatttcatataaatgggatcacataatatgtggctttttgtgtctggcttctttcacatggcatcatgctttcaaggttcatccatactgtgtcatgtgtcagcacttcatgccttttcactgccgaataatactccattgtataggtaccgaaaacgttttctttgtccattcatctattgatagacatttgggtttttccacctttttactattgtgaatagtgctactgtgaacatttttgtacaagtttttgtttgaacatctgtttttggttcttttgggtatatatcttggagtggaattggtgggtcatatggtaattctttttttttttttgagatggaatcttgctctggcacccaggctggagtgcattggcgtgatctcgattcactgcaacctcttcctcccgggttcaagcgattctcctgtctcagcctcccaagtagctgggactacaggcccatgccaccacgcctggctaatttttgtatttttagtagagatgggatttcaccatgttagccaggatcatctcgatctcctgacctcgtgatccacctgccttgacctcccaaggtgctgggattacaggcatgagccaccatgcccggcctgttcttttttttttttaatggccatcctagtgggtgtatgaagtactatctcaatgtggttttgatttgtatttcagtaatgactaatgatattgagcttcttttcatgttggcttgttggccatttgtatatcttcttttgaggaatgtctactcaaatctatcatccattttaaaactgggttttttacattcttgttttggaatggtaagagtctttgaaaattctggagagtaggcccttatcaggtgtataatttgcaaatatgttctcctattttatgggtttgcttagcataatgattttgaggttcatctatgttgtttcttgtatcaaaactttgggccttttactttgctaagtagtattctgttttgtggatatagtgcaaactctttatccatctgttgatggacatttaggttgtttccaggttttggctattacaaatgaagctcgtatgaacattcctttgcaagtctttatctggacatatctttcagcttctcttgggtaaatttctaggccaatgatattttaaccttttaggatcacaaatattgtacataagaatcattgtttgggtgaaacgtcttcaaatttttattagtatgtcattgaatggagcatgttaatgtaaccctttaaggtgtttaaagaatatacactttttcatctttgttttcagaatcaatcactcattagtttttttttcttctgttgatgaatcttccttcaatagtttttcatttggcaagtaattatgaccatggaagtcgggacacaagatgaaaaagacaacaaaactgcagaacttcaaactgaaagaaaccctaaaaatcacctgagtcagctcttttattttacagaaaaggtgatgaggtccagaaaggagactggatttaccaaaggccagccgagtattagagcagttcggtggagcaggggaaacttacacacctgtgagggtaatttgacgtctcctagccatgatgcaacagtgctggggggtgagtgaatggcgctgtgttttacagtctgtagcattcacagggcactttgtttccttctaggttatcccagttaatcctccaacaaccctgtgaagtaggtagggactaagtaactaggagtagctcagggtcacctagccaatgatcggagatcccgggctcagagccaggccttctgactccttccaagttgcgtgccctcctctttttcgtttgaatttcctcctccttgtccctgcccactgccgtccccttagttcaggcctcccagctctacccccggcctcctgctggattgggctccactccttctttctctgcagcagcacagtcttgaccttgtcctctgcttgctggaagccctgctgtggcttctcctggcctttaggttaaggttcagactgcatggaaggcctttccagatctgccccactcagccctccagctccagaacttcctgtcctctcttggctgccctctttccctctcctcaactagaacattctgaattctgcttagacctcacctcttccagggagctttccccaaccctaagcaggaaggagggctgagtgaccctcttcctgtaattgtctgtggctcccatagtagcatttgtccgtgctctcctcttgcttgtctcccataaagaccatgcaaagtccttgcagtcaaggccactgccactcacctttgctatcctcatcacctagcagagcccctggcacatagtgtgttgaatatctgggaatgaggaacttaactgcaactgaactttcaatctaactgacttggtgatgagaaatactagtcaggatgctctcatgggtgagacctgatgtgacgccaaagcttggttttctccagcttatgttttatttggactgcctgtctgaaagggctagacagacatttatgttcagagaggccatataagaagaatataaatgcggaaagtcataaacttcagctctgctctgggctccactctcaagccactgtgtgaccagaggtagcacttagcttcttagagtccacatgggttaaagggggaccagggtatggggcttgttcaaacagtcaatgagatgacaggtgaacatgccttggtaggaaagcagtactgaatacatgtgtcctcatgtaagccagctttttgtctcatgctgtcatctccagccagaggccagattgtgtgcaggcaatttccaggctgaatttctgagagatttgatccaaataggataaatggtggaaatgaccactaggaacactccttaaaacctgcttgcatcaatgctttcaatgatacatttctgcatctcaaaaaaaagtttctaagccctaagctagcatctgcctatttcaagcaatttctgttcttttttttcttttcttttctttcctttcctcttcctcttcttcttcctcttcctcttcttcctcttcctcctcctcttcctcccgttccccttccccttcctcttcttcctcttcctcttccacttcttcttcttcttcctcttcttttttttttaattttttttttgacagggccttactctcacccagactagagtgcatactgatcctcccacctcaacctcccaaggagctggggctacaggtgtgcaccaccatgcctggctaattttttttgtatttttttgtagagtccggttttcaccatgttgctcagtctggtctcaaacttctgggctcaagcgatcattctgcctcagcctcctaatgtgctgggattataggtgtgagtgaccatgcttggcctcaagcaatttctaaaataacacaaatcaagacaacagcaacaccaagatactgctttattattgccttgacatttgcaataatgacagtttaactatagcagtaataatgacagtcgacttgtggcagcttaaaaaaaaaagaagctgcctggaaaataagtgattgctcacgattcctcagggagacttactccaaccaccctatttaaattgcatcttgaacccatctcttcccatccaggctgtcttattttgctttatttcttccacttgttgtcttctagcataaggatccccaacccccaggccatggacgggtaccaggctgtggcctgttaggaacgaggccacacagcaggaggtgagcggtgggcgagcaagcgaagcttcatctgtatttacagctgctctccatcactcgcattactgcctgagctccgcctcctgtcagatcagtggtggcattagattctcataggagggcaaatcctattgtgaactgcacataggagggatctaggttgcatgctccttatgagaacctaatgcctgatgatctgtcactgtctcccatcaccccgagataggaccatctagttgcaggaaaataagctcagggctcccactgattctatattatggtgagttgtataattatttccttatatattacaataaataataaagtacacaataaatgtgatatgctggaatcatccctaaaccatcccttgccaccatagtccatggaaaaattgtcttccaaaaaactggtccctggtgccgaaaaggttggggaccgctgttctgacaaattatataatttactcatttattatgttcttactgtctattatggctcctttcaccctgcccccaccacataagctctccaatggcaggagagttgtactcagtgatttaccccccagggcctaggagcaattcctgacacctggaagatgctcactaaatatttgttgaatgactaagtgaactataggtaaaaatactgactttagtgattgttatgtggtggcatttgttccctctctgagcccacctaggatatgaactatatgggcttcagggtctgagttttgtgattcaggaaactgaaagtggaaggtgttagaagattgtagcctctgctcctgtggggttcttggaagtaagactctccctgggcacccgtgacttggtgctcttctcatggcccagctccagcagttgccagtgtagccagaaccccttaggctgggatctgacttgtgtatttggtgggatcttgatggtggagggagagcagcaggcctgggctcagtccctagacatagaggccaaaaaagattggaacaaccgtgtgtccagcaataggggattcgtgaataacacttggctacatcctcccaatactattcggaccatctctgggtacggatacagagaagtctcaagaatatattactaagggcaaaaatcagggtgtggaaggtatatacagttggctgccttctctgtaagaaagcagggtgagaggaaggtgaatatgtattcatatttgcttcagtgaccagagggtgagatttgagagatgttgaaagtaggggccaggcacggtggctcacacctgtaatcccagcattttgggaggccgaggtgggtggatcacctgaggtcaggagtttgagatcagcctgaccaacatggcaaaaccccgtctctactaaaaatacaaaaaattagccaggcatggtggtgggcacctgtaatccaagctacttgggaggctgaggcaggagaatcgcttgaacccaggaggcggaagctgcagtgagctgagatcatgccattgcactccagcctgggtgacagagcaagactggtctcaggaaaaaaaaaaaagatagtagcattgagtggcagagtctatatgctgtctaatcccagctgctgggaggacgctcaagggagatgatcttcagtggtgttggtgtggataggagccagcacttgaatggtaccattaaattccaaatagatctgtgctttgttagaagggctgtgaagggatgaggaaagaaaaaagcactgagaagctctccttccccagtaaactttcatttccaattcaggaagccacttgcggttcacaaagaccaaaactaatctatcatattttcaaaccgaatatttaacactgtgctgacttctctgacatcactaggggagacagagattatgtgtaaagtgccaaactgggtcaggcagttccttgagaacatcactgccctttctcaaagaaatttcctcggtctaaaatgtagagaattgaatcagatggctttcattcacatttctctcagaggtttttaattaaagctcccaagattttggaaggattaaagaaaacttgtcagcatgtaaaacatatcactttttggtagggaacatgaaatgatacaacctttatggagaagttggcaatatctagcaaaagtacatgtgggttaccttttgaccaatcaatcctattataggatctatcccaagatacacacacaaaaattttttaaaagacataggcacaagcttctccatcatgtcactatttgcaatagcaaaagactggagacaacccagatgtccatcaccagggaatgggttgagtaaaggatcgccctccttcctctatactgatgtgtagaacacagtgtctgagattaggcagcctgtaggctctgatcttcctgttcatccctacattggacatccctcaaatctggcccctctggtcactgaagcaaatacaaatatatattcaccttcctctcaccctgctttctttctttcttttttttttaagacagagtctcacactgtcgcccaggctggagttcaatggcacgattttgtctcactgcaacctccgcctcccaggttcaagcaattctcctgcctcagcctcccaagtaactgggattactgatgcacactgccacacccagctaatttttttgtattttagtagagtcggggcgttgcccagactggtctcgacctcctgagctcaggcaatccacctgcctcagcctcccaaagggctaggattacaggcgtgagccaccacacccagccatcaccctgctttcttacagagaagatagccagttgtatacacattccacaccctgatacgtagaacacagtattctatgtatcaatgacagggaagggggacgatctccgtgtactgctatggaatgatctccagggcgtactattaaatgaaaaagcagagtgcagaaaaagcggatggcatgctatctattatttaagaaatatacatgtacttgcttatacttttttaaaaatggaagaataaaccaataaaaatatttacctgtatgtgtaggtaggaaatggaagagtgggtcagaggtagaagctagacttctccaaatgtgttttgttttgtagatttgactttggaagcttatagatgtttgtcttaattataaaaaaattaaattcacatggacaaaagtaatccccaaaaatcaagactaaagtgaaacaaacttatgtatcaagttggtggtttaaccacacaattatttcagataacttgaaaacacaattaatttaattatacatccctagtgtatatcttaccgtcaacgtgaatgccaaattaatcttgagctgttttcagtaatattgtaagtaaaaatgttgatagaactgtactgacactaatatatatccacacacacccacataaacatatgagtatacataataagagcaattatgttgcaatcattagaaaccaaaattttcagtatacaaaaacagtgacaattttaccatcaagatattaaatgaaaatcctgtaattctaaatttgaattggaaatattagtaagaactcctgatgtattttcttttaaacaaataaaaaaatttttctaaccttgtctactgaacagcctagaaataatgacaaacctagtagcagtaagcacctgtaacatccagattatggcctctaagtacattttttctgctaaaaagaaactaagaatccttagaaaaatgttgattccaggcctggggcagaaagtgtacaagatgagctggaatatcttgttgtatcagaaagcaaagaagctatcaaagaccacggtgtcctgtgagaagtactcagaagctaattgaaggggctccccctgtccaaatattgaacaatttgggcattaaaaataataactatagtggatttacatacatcaaatatattaacatgtgcaaaatctataagttaaaaaaattcagtagtttcggccgggcttggtggctcatgcctgtaatcccagcactttgggaggctgagagggaggaatcacctgaggtcaggagtttgagaccagcctgaccaacgtggtgaaaacccgtctctactaaaaatacaaaaattagctgggtgtggtggctaacccctgtagtcccagctactctggagattgaggcatgagaatcgcttgaacctgggaggtggaggttgcagtgagccgagatggtgccactgcactttagcctgggcaacagagtgagactctgtctcaaaaaaattttttaaaaaagaaaataaataaaaataaaaaaataaaaattcagtagtttccactatagggtgctggggaaccaactttcatcccctttgtcttcctcctgtcctccttcttcagtctctctctctctctctttttagagacagggtccttgctctgttacccaggctggagtgcagtggcaccatcatacctcactgtaacctggaccccctgggctcaagccatcctcccacctcagcctcctgagtatctgggactacaggcacatgtcaccatgcctggctacttttttttttcttttgtagagataggctcttcctatattgcccaagcttgtctcaagctcctggcttcggtgatcttcccgcctcagcctcgcaaagtgttggattacaggcatgagtcaccatgaccagtcagaaaattcttcatagaagaatgccgtctaataaatacagaaggaatgaatattagcattttgcaacccctggtgaataatgagtttagacaatgtggttgttaatggctactaagctgttaggtgcagctgatggcgttctttataatggagggatcaggctgataatattcaaacccactgatcgatcttaatgtcttggcaggcttgagatttaactaccagtttatagaaaatacaagggatgcaggaacatgtacaaatgatatcgggcagatgaatcaggtaatcagaaaatgggacatgctgcaggcctggtttccttaacaaataaattttaagaatcaaaatagcaggaggggttatctgtagattaaaaaggacttaaaatacttatcagcaaaatgtagtatataattcttgtttgggtcctagctcaaaacaaatctaactgtaacatgtatacatgcatgcatatacatatatatgataatctatgatatatatgataactaagatattatatttgaatagtgaggttaaagaattatttattcatgtattatttatttgattatgtgaacattaaaaagaatattatttattagttacttatttatagctgtggtaatggtattttgattatgttaaaatacagaagttggctgggtgttgtggctcatggtcgtccagcactttgggaggccaagatgggcagatcacttgaatccaggggttcgagaccagcctggacaacatggtgaaactgtctctacaaataatacaaaaaattagcccagtgtgatggcacaaagaaagaaagagagagagagagagagagaggggaaggaaggaaggaaggaaagaaagaaagcagttatactctagggttgtatactaaagtatagattaaatatgatatgtctgggattagcttcaaaataatgaaggggggtgcaaaataaacaagattggccatagattgataatttttgaagctgggtggtgagtacatggaaatcattatattattctctctacctttgtataatttgaaagtttccgtaataaaaagttaaacagaacaagacatcagctcagccacttggccagttctgttttcagatgtccttaaatttaatattgggctgtggagccgacagacccttcttaaaaatcacctgggggctgggtgcagtggctcatgcctgtaatctcagcactttgggaggctgaggcaggacgattgcctgaggccaatagtttgagactagcctgggcaatatagccagaccccatgtctacagaaagtttttaaaaaattagctggctgtggtggtacatgcctgtagccccagctactcaggagactgaggtaggaggatcatttgagcccaggaatttgaggctgcagtgagctatgattataccactgcactccagcctgggtgacagagagagaccctgtctcagaaaaaaataaaaaacaaaaatcacctggccagcaagtaggaggctgagatcctaactcacatctgtctggctccaaagctcacagtctttccatcttaccttacagaatttatgtctctcttggggctcaaactattgtaggattgtttagattgaggattatagggttttacaagcagctgtaatataaacatgggaaaattggggcaaggcaaatcaagaacaaaaactgccaccaaaacatcagagtcggtcttcctttgagggcgggaaatttatccaaggataagggaagaaaatggaaatagaccgcattcctcccactgtggccttattgggccctttctgttgccaccatcctgggctttggattgagagagatctgggttaggtagcacagcctgttacttaggatgtgtgtggtcttactgttctgtgccacagttgtttcaaccaacctcatttggctgttgtgaggatgacatgagattgtccatatgatgcttaccacagtgcctggcaagaggtgaggtctctgatgttcatttagaaaagaagactgcagtgcattcaccaagatcctaagaatcccaaggctgggccggagcttatgtgtttggacatccctgtgacgtgggtacccccactgaaccccatgatattctccagcactttcttggggaccttgggccaccttgcctaagtttgggatgatcatttagcctgaatgaggaggctcagtgctctaaggatggcattttttctacctggctccattttattttgtcatgtggcttgatgggcatggacagtggggaagatcctgcctcggtgggtgaatgaaagggactgttggttgatatctggcacagacagataggaagtgaagaatgtggcacatccttagactgcccgttggtgagatctgaaactaagtttctcatgactggactgtatttctttagctgctgggtgtgaaaagccccagacattggcttctgcttctttcaccatcattatgatttgtgggcattgatgctaggcctggaatccctgcagcattcatctctgctggggttctctaatacagcggctgagaacggtgctaattccagctgccagcatgatcctccttccctggcaagagggagccccgctcagagaacatttaaataccgtagaaccatccctgttacaggtttcctttgggatgctcttgacgcaggaaatatggcttattctcataaatactttgagatgtacttcagtttctccaaactttatgcataacaacacgactgtaacaacaaaaagggaaattcttgaaagaaaaaatattagcagtaatctctttgtcagattgttatttttctcttttgtgttccttccttttatttttggtcatgtgcatatattttaaagtatcacacatggttttacattctattttcctgttaacattatgatgtaaaaagacttttcttgcagttgcatcctcttcataatttaatttttcatgatggcattggcgctgccaaagaaagtcactttcccatgccaggagaaaagaccatctctcctgtggctgcctcgaagcccccaggcctagaaacgtctccaatcaggaaacagaagcctccagtggatcatcttcagggatcgctggagaaccacgtgggcatgtacacatacctcctcactgagctgacttacccaaagttattattcacctactgatggacaatgatggttctagtttttctgtcttatcaatactatagtaatggctttcttcatgcatgtcattttggaatattttctcagaatgggattattatttctaagcgtatgaatatttttattgcttttgatatattagccacattgctttacaataaagttgtacctgtttaaaaagttagcagtaacataggaggatattggtctcacaataactaagcggaaccactctgcccagctttgaattccagcttgacacttggcatttaccagctgtgtgaacttctgcaaagtatttaacctacctgtgcctcagttactgcctctttaaagtgggagtgacacagtacccacctcataggtctattattgggaatgagtatttgtatattgctcagaacagtgtctaccaaagtattatgcattgtgcgctcgtgaaacaaacacctctccagctcaagattttttttaaaaaactaatttaatagaagtaaaatgacactgtttaagatatatatatatatgtatatatatcgacatgcttattaaccgtatttacaagaaacactccctttaaatctctttattggtaaagatatcttttaaaatgttaatttacagaagagatccattctggtgtgattattgatattatgtaggaattctttttcagcttttacagagttgctatccctttagggtggagtctcatcaccaaaatatcacctgggacccgaggtgctgaggctcataatcagccacttagctctgaagacttcaaattcaccccagagggacaaacttagggggtattttagggccctattagggactcttcttcctatcttgtccgatgacggctctcggaggctcctggttttgatgtctggcattgcttttacccggtgggcttcagggagccgtccctgccgcgctttgcgtttctccgcgcacttggacagggttctgccacgagggaggcgatgcctggcgccgcgggtgggggcagtggtgagacttcggcccctggtggccggagaggtcgcagcacttgtcagtttatggctccctcggctttccccttcttaatccgctttctgctgagctctccgaataattcaaccctcgtgtttgaaaactagaagcctgagaggtctcagcgagacagtcaaaggggaggctcccctcgccgagtgtcacccgggaccctgcgtccccgctctgcagagaccttctctccgggctgctgccgtcctccctcgcccggcggagcttccgtgatcgtcagccaaagcccccggggcggtgcgccgcaggcggtcttcccgggtgttcgcggaagctgcgcgctcgcgcccccacggttctccagcgacccctgaagatgcttccgtccgcggataggggacgtttcagacctggggtgggcacagcggtccccggtgagatggtcttttctcctggagtgggaaggcaactttcttttggagtgccagtgcccccagagtgctaggttgtaccgtggacttgtacttgagtttttcaaataaagcttgacacatacttagtatagagcagtagaaagcagggaggaaaaactcgtcatgggtccactatctaaaatcaactgatatttggaatagttcctttgcttttttgtctatacatacgttagatttattttttctagtttttaattgtactatgaagctcaactttgaactttgcattttttctcttattattattttacaaacatacatactggctgcataatattctgtcatgccatatacagccactctacttttgaatatttaggtgtttttttattttcattaaaaaattctgcagtaaacatctttctggctaaaacttgtttccgtattaggttatagtctcattatcatagggcagagtgagaatgtttttaaggttcttgatacatattcctgaatggcttttctttcttttttcttttttctttttttttccttttttctgagacggagtcttgttctgttgcccaggctggagtaccatggtgcaatctcagctcacagcaacctctgcttcttgggttcgagcaattctcctgcctcagcttcccaagtagctgggattacaggcacacaccaccatgcctggctaatttttttatttttagtagagacagggtttcactatgttggccaggctggtctcaaactcctgacctcgtgatccacccagctcggcctcccaaagtgctgggatcacaggcgtgagccaccatgcccagcatccaaatggcttttcaaaaaatttgtataaatgtttactcctgctagctgtgcttaagtgtttatttccggccagcctcaccagcaccaggaattatgagaatactcttaagataatgtcactaaggccacaggcgaggagagcttagaaggtactggctgctgaagtctgtgtgatctgaaacctagatgtatattctgcaatctgcttgtttccaactccccacattctgaggacagtggcctatattgaaactggaggaatgaggtttacttgtgtttcagggattgaagtggtactagaggttgtgttggattgctaagttcagagagccatcagaaattgttatgagcttgagtcacataaaaatggaatatcctttactgtgggtggcatagctttttagggttggcttcctaaacattttggggagaatgaatctaccagcagagaagctttcctttggcagtctgagggtgtatcttcctgaggcaaggccagacttgaggatattctaatcctccttcctgcatttttatattgcaatttcttgccaaacttgctgcctgaagagagacgatatctctttaagggtgcattttagttcatttgtgtgtcaggtgggtgggaagtaatataaaactcatttatggctactcagtctgcaaacatattggaaggaagggctgggctttaatatctgtgtaggatggaagtcatttttgagttatagtcaattcttatgttctgtaaaatccattagaaaacctgtacccgtatcagttcacatattctgcacctggctctcctgttcatggggaattgcttacaacagggaactcttaaaaccaagactgctgtttttgccccactactttcaggttagagcaggattccagtgtcctgaagtttaaacacattctgagcatcctctgagaatcattcccaattccaagcccatttccagacgatgagcagacttgaattacataacctgtagctgcacatttttgtcgtgaccacgcaagctcaataatgtctcccaagtcttgtagatcactttgaagctcactggattaatggtgttgaatctgtttaatccaaataatttgaattgcatcaggaaacctgcatattaacaagctggtaataagtgcaggcgttaagattgatcactgcttaagtcttcaagatcacatacaaggtctggtgtttttgaggctgtcgatgtactatattttttagattctttcttgatttcattctgcactcttgacatttaaaataatttaaatcaataacttcagaattctcccaccggaggatatgcctatttgatgtgattgtgtgtctgtgtgtgtgcacacactagctctgtattattgcctatggaggacatagaaatatatcatatactgtcctcaaggagcttgcaaccaagttgtggggataaggcaaacaaagtcaaaatatctaatacacgttccaaggcaggatgcaattctgtatccatggtacattgctgattgctgatgatgctctaaatgctgactctaaatggtggactgcaatttgtctggaagaagaacaatggatcatctgtgtttgggggagacttcatggaggtgggatttgggggagccttgaagaagtgagcaagttttggataggtggaagtgaacttactggctatacccggaaaagagcaggatgggaataaaggaaaagagagcctgttttggtgaataagtttaatattgaattgtgatagtcaaaaaaataggtaggatgatgggctaggtttgggaggaggctccaaagttaagaagcgaggcttatccttgagatcatggcctttaccacaaccagcaccatcatcattatgagcagctgtgtcttgcattcttataatgtggttctgaggactttacatgtagtatcttatttaatccccaaacaaccttatggaacagataacaattgttatgtccactttatagcagaggaactgggatataaagaagtcaaccaacttccagcgggtaaggtatgtgggcaagcaggggttcagatgaactgaatcaggcagcttgctttcagagtctgttcttcaccactgtataatactgtctcttggtgcttgttgaaagcccctgttgagattaacatagtccccctcaagttctaagggagccccgcctttcaagtcagacagacctgggctcacattctggctctaccacttaccagctgtgaccttggaaattacttctctgagccttgatttgctcatttatgaaaaaggaagaatatttacctcaggttgttgggagcattaaatgtgataatatatataatcatttagcagaatgcctagcagagagtaagcaggcaggaaatgatagctgctatggcttatatttcacagatatatgtagggttataatgcagtctctgagaatgagaagcagtgagggtggacatgatttaggtagagtttacttggtagtcacctgcaatgataattagctaacggatagtgggcgctggatttcttcttctggagcatcccaggaatggactatgaattccagatgtggttctgctttgctccaagaactgactgcatttccttttgtcttctaaaacccagagggtgaaaccaggacatttccattgtactgaaatttggcataaaatctggtgccaattgtacatcccaggggctgaaatcaggatatgctgaaattcccagtgtcctcgctctgctggttcccacttcctgacggcgctgacagataagtgccctgcatctcacagagagagaaaaatagatatttggaagtggtatcttttattgcctataaagttaaacaatgcacgaaacaattataaccaaggcagagacgtttagacaacatgcataaaaggaaaaaaacagtggaagagaaactttgctctaagatgaaatgctaattctaactatcgctctcagaatttatggggcaacatcacttagtacttcttacacttgcgttcctgcacatttcaaactgttcatatggtagtttttcttctgtatgacattctgcaattgtagagtttttctttatattacttcattcacaaatttcaaaattcacaaagtgtctatcaattaggaagaacaacttcttgtacttttctgatttgcagtctccttggttgtgacaaacctatttgttcttgtccctgtatcgttgatataatccaacttggcttctttggaagcaacaaatgctattttttttgcttcaaatccaatattggtttttaaatttgtggatgcaagaggctataaagaggtttaaaatatatgtagcttgaaaatattaatgtttttaaaaaatctcagagtcactttagaattttaaaattttcaagtaaggctgcaatcagatagatacttgtagactgtcttaggctgttttctgttgcttttaacagaattcctaaaacaggataatttttaaagaaaccaaaatttatttattatagttatgggggctgagaagtccaaggtcaaggggctgcatctggtaagggccttcttgctggtgggaactctgtagaatcccgaggtggcatagggtatcacatggtggaggaggctaagcgtgctagctcaggcctctctcctcttataaagccaccagtcccactctcataataacccattaatccattaactatgaatatgttaacctataaatggattaatccagagcccttatgacccagtcacctcttaaaggccctatctttttttcttttttctttttttttttgagacacagtctagctctgtcaccaaggctggagtacagtggctccatctctgctcactgcaagctctgcctcctgggttcacgccattctcctgccgcagcctcccgagtagctgggactacgggtgcccaccaccacgcccagctaattttttgtatttttagtagagatggggtttcaccgtgttagccaggatggtccctatctcctgacctcgtgatctgcctgccttggcctcccaaagtgctgggattacaggcgtgagccaccgcgcccagccaaaggcctcatcttaaaggggacaaatattcaaaccatagcacagaactatttggtgctaaatggtattttgggaaaactggagtgttacatattgtttaatttttccaaatttctgataaaacggaagatcttagatagttggtgtgttcgatgggcatgtatctcatgttacttgtcttcatgttgtagacatctctctaaaaataatgataccaaccaggctggtaaaatggctttctgaattgttttactcgagtcagaggggatttgcaccctctagatgttgctccttcacagcttaaccctcggggaacttcatttttaattcattcaactgaaagaagtatttactgaacacctattatgtgctaggtgctgtcttaggtgctgagtgatgaatggaataggtaattcttatggatggagcttcctgtctagtgaggaaaactaacataaaccaaaaaaataggtaactataaaacataaactgggataaataatattaaggaaaagaaaggatttctttcaaccttatctttcttatagacaatgtggggaaatagagctatgggagtactcaaaagtttatccacacaaaacaaatccctataaaaacctaaccaaagagcaaagattaaatgtaattatgcaaaaaaatgtttaggtgtcaaggcatttaaatacattactttgccattaagtggctatgagggtgtcactaaatggaattctgtttcaagacgtacttgagctcatagcatgttgagaccatgatcttctcataatttggttcactttgattaaagcagcatcatgcccactgcagcatcatcagagaaaggatctcctgagttaaggacacccatggaaagcatcctattgtgtgatttctcccttattgttcatttctgggaaggtacagtttggttttggaaagcactcttgagtgtgcaaggccgggggagtctggggtctactcttcatcctgccacccactcccttgatcaatgaacttggcttctctgagacttggagatttggtttccacatctggaatataaaggtgttgagcctgatgaccttgaaagatttttctaggtctaaattttattacagaagcagtgggcaataggagaatgtttggtggtagattcacttcatatctaatgaagatgtgacattttcatgatatgctgcagtagagggagcactggtccaggagtctgaaagttcaagctcagcaatacagagacttttggaatgacttggtttatgttcattcaggcctggagcacagatgggttcatgctttgctgcaacccacacttggagataaagaggctctgcagtggtttaatatgcaggttctcggttcaaatccaggatactctgctgaggagccatggagacctgggcaggaaacttggcctcctggagcctcaggcttgaatatatgaaatggagcctctgcttcttatttataagtactcctgtcttcctcccaaggttggcactaggatgaaggctgtataaagtgattagcacagtatctggcacatagtaagtacccaataaatgctcattgtcctttttcttcttttttttatttttaattttttttagagatagagtcttgctctgttgcccaagttggaatgcagtggtgtgatcatagctcactgcggccttgaacgcctcggctcaagtgatcctcttgcctcagcctcacgagtagctgggactataggcacgagccaccatgcccagctaatttttattttttgtagagacagggtctcactatgttgcccaggtgatctcaaactagtggcctcaagcaatcctcctgcctcaccctcctaaagcactgggattagaggcatgagccaccgtgcccagcctcttcttgttaataattatcatagttcctgttattgcagttcttaagctgggcacatcatgtaagcccctatgttttggtttcctgcttatggtgtctgcctcatggggttgttttgaaaatcaggtgtgactttatgcaagggctttgcgagcccctggatcctctctgaagggctgggcaggcaaagccacaggctggcagtctgtctgtctgcagcgtggctgtttcctgagagagggcttggctgagggctgggaggcaggtccgccttcctctagccctgatggactggggcacatgcagacgcacttcccagccaggcagacagacccagcacacagatggccacagcggcattcacttggtgattgtcattcacagctcatgccatctggtgccagagacggtcggcgggcacctcaatctcagtttcatccctggactgacactgccccttttaacctgctcttctcatattttgagataagggcacagtaggacagcactgtttctaaatgactttaagaacaattatttaggctaattaaaaacaatgaaacccagaaactgtgagtggtggcattagagccgggagccgggcacctgttgtcatgcaggctgtcctgggggagagcaattagtttgtttggcaaaaccactggaatgttcttggtgggggcggaagttcaagtttggagtgggtggtgggtttgctccttggatgtgttgcctccttcggagcagatggagtcgaaagaattttcagagtggggaggggtggcactggccagggaaggcccacagggctgttttccctgtctgaatggtccattcataaaattgcctcctctttcttctcctgatggcactggccactgcctggtttcccccatctcaggggttcggttctctcaaagctgggggaggaggagctcggtcagctaaaaaggtggtaggagcctccttctccaagtctcatctgttctcctgggctggcatgatggatggcctcgggctgctgggttgtgtgttcagtggcgagccaggatttgccaagggtgtttggctagctcggggactgacacatacggctaactagcgtgggctgtggtgcgctgtcacgcaatgcgtgtcacctgggggcggggagggtgcacgcctgggggaggctgtgacccacctttcatagtggggcttggcaggaccttctccttcaccccagctttgatgcacctataccaggtttgatcagtaaggttggaggaagacaggtgcttctcgagggtccgtttgctcagctgcttcttgctggggacagctgcacctccatatttccttcctgtttctctcgtgtgctcccctctccccactcatttccatttacttctctttcttttccacttctttcttcttcagtctgtctcttattctctctctgtatttttgcgtaattacagacatgacttgttacattcgtgaaaaatcttaagtctgcctggatggtttctgtctagggggcacttgcttgatagaagagaaacaggggcaccttcttctcgcacattcctcactgaccatgcagggacagcctttgagcaaacaagggagagacctctgcagaaggcatttcactcccttgtcagggctgtgcgagaagctggtgacagaactggcccggaatcccagggacacactgtctccccctgctgttagaccacgtctcctcgcaatagggtctgcaccaaacctcctcctgccaacacttccaagaaaatcttcacatccacctatctttaagggttagtttaagctttgagaaatggcacaagagagatttagatgtctaatttcatcctcttgtttagtactttatatttaagtacatgaaaccctaaactgtaaggtatttgtaaaggcagtattggttgaggcatgctctctgctaatcttttctgccttcaggtcactggcttgaagtgtcagtgaccttggaattatttttgcagttgcttttaagccctgtaaagacaccattggaaggttgaggctggcctagaaatggcagctgctgctgctccccgttagcctgaggtcgggtgaggagttcatcacaattactgtttaactttttattttaaaatgattttagacctacagaaaatttgcaaaaatagtgcagagagttcctgtatgctttttacccagctgcacctagcgttaacatcttggataagccatgatacatttatcacaaccaagaaaagaatattggcacactattaataaccacactacagacatttttcagatttcaacagtcttttcattaatgtttcctttttcttttccttttcttttctgcttttttttttgttgttgttgttgagacaaagtttcgctcttgttgctcaggttgcagtgcaatggcatgatcttggctcactgcaacctctgcctcccgggttcagatgattctcctgcctcagcctcctgagtagctgggattacagttgcccatcaccatgcccggctaatttttttgtatttttagtagggatggggtttcaccatgctggcaaggctgatctcgaactcctgacctcaggtgatccacccgcctcggcctcccaaagtgctgggattacaggcgtgagccatcacatctggccttcactaatgtgtttttctatttcaggatgcaatccaggatcccacctggcattcgttgtcatgtctccattagcatcctccagaatatgacagtacctcagtcttttcttgtttttcatgaccttgacatttttgaagagtattggtcacttattttgtagaacacagatggagccaactttttctatctagggccagatagtaaagagttttcgctttgcaggccacatgttctctgttgcaactacccacctttactgttgtggcacagatcagcctcagacaatatgtaaataaatgaacatggctgggtctcggtatgacttcatttatggaaacgggcaaaggttcacatttggtccttgggctgtaatctgccaactcctgttgtgaaagattcctggatttgagtttgcctgatgtgtcctgatgattagattgaggttatgtgtgttggaagaagattcccaaagaggggatgtgcccttctcagagcatcacttaattgcttgcttaaggtggtgttaactgtaaagttaaaagctgctattttttctttgtaattaagaatatttcaggggagctactgtaggattatgcaaatatcctgtttcttttcaaactttcacctgctaattttggcattcatctgtggagcttgcctataatagttatcattgtcatattctaacagtgattttccatttcagtcattccttctccatttattatttggaattcttctgtaaggaagagctgttgttccttcttcctcgcttgtttatttatcaagtatttatgtcagtatggagtcagatatttcttttactttttgggttatgatgatcacaatttttgattgtgtcattgatcacaatttttgattgtgtctaattcttgtgatcaagaattagatgagagcaaaaaatccaaaagtggttgctaagtgttgggctttttttgttctcatcgaattcttgaccaccttcttgatttcatagtcagctttattctaattacaactttgtgggcagccggtgccctaagacctaataggtctgaatttcatgaacttgttaatggcagaaggcagttttattttttggctcaaagcactggtcagatttacaatttcaatctacaacacagctggtgctggttgagttgcagtaagagtgtccgcattagagcgattggagctggtaattggttttcattaattttgtgtgcaagaggagattggtaatgttttctcgtaaatgctaggtcaggtttgcattttgagagtggttccagttattatctctccctatcctcttattccttaagagcttcctttttgttctgttatttgttggggaaggttatttaagagtttaaaaccttgcttcagtgaagagttaaagcgaattgagttttgtaacttttacttgctcatttctagattaaattaaaatgtcagtctaaatgattttgcctcaattggagagccaatcaagacttccaattcaactttcaaaagctatttgacctgttttaaaaaacaaaatgaatatgttgagtcagttttttaaaataggagaaacttctatttctatctacagttgaaattattcttaaggtaactgtatggaagattagtgaaatgattgatgaatgtggcttttatgtttttgtgggttctttagatgatttcagaaacttgtagctctttgctggaagataatggaagaaaaagaaaaatcaagttatatcctgtgactaagaacagagttgtatgcctcactctgaaatatttttaattaactatattttggggcggcgggagatgagtaaattcattcagctcttaaagaaagtcatggaaataatttttctacagtgtcaaggaaaacattgacagacaagaattgtcatttgggatgggcgcagtggctcatgcctgtaatcccagcactttgggaggccgaggcaggtggatcgcctgaggtcaggagttcgagaccagcctggccagcatgatgaaaccctttctctactaaaaatacaaaaattagccgggtgtggtggagcacacctgtagtcccactactcaggaggctgaggcaggagaatcgtttgaacccgggaggcagaggttgcagtgagccaagattgtgccattgcactccagcctgggtgacagagtgagactccatcttaaaaacaaaacaaaacaaaacaaaacaaaacaaaagaaaaagaaaaagaaaacagaaattgtcatttgcccaagatattgttagaacaaaaccaaaccaaaacaacacaaaaaacaacaaccaaaaaataatatggggagtttctgatttgtcttggtacagaattaaaagcctcataaactacagcttaatttccaccctctttaactaaagaagtatgtgctacaaaacactgtagaagttcaggccagtttccactcataatgggaaattgcatgcaaaattcaggcatgctgttcctacttaacttgttcatcttgctccattgcagcactggatgaaaagtgaggattttaatactttaaaaaaatttacaagagaaaatcgtagactttgtcaccatgtgtttatttcactatctgggatgcagcctaaataaagttatgagtcagatgtagacctcttgaagcttgggagcactccgccggccctgccctgccaccacgcacacacaaaatgtgaaggagacaagtaaagagaactgctggtgaaacagctggatgattgcggtggatcctaacatcttgagaagtgaatctgtttgcaaaagctttagcacaaggagagcgatctgcctgaattgcggtagagagtgttgtttgcgcatttgtaaaacgaggcgaatgacccagctgttggccgtaggggcctttgctgtccttcctggggtttgtggtcgctgccgaggatcagcactttcacacgcgaccttacgcattccttgtcatcttgtccttggcgggcctgtcaaaaagaagttattttgaaagcgtatcgctgattgcacattttattccataagtgctcagcgcgtttcatgtaactcctggaggcctctgagataagagtggaaaagtgccctgtgcccttctgagtggtgggtgatctattttcgacttggagactggtgacaaagctgtcttctgtcaggtcagactcgcagggactttcttgttttctgttcctctgttgacagctgtgcctgtgttcagaatggtcatggggtagctggaagatagctctggcatttaaacacctagataggaaggagacgatggaatgtatttttctttgctattttggttagcaagtccctagtagtccatactgagaggggaagaagcagagagacctttgggagggcgggcaggaaaagatgtccaacttcaggtttagaaggcacagagggagttctaccgttggtatatggtataggtatttttaatgcctagaaagggaatggctggaaggaacatgaaaaataaaggttggaattgaggtagccttgggcgggagggtcgggaggtgggttcgggctaacgtgagtaacaagatcagggcaagactttttttttcggtatgctttgtgaaacaaattgaaactaacacactgaaaattgcatttttataatgcttttacataatgcaggatctttgttttaaaagcacagtgacgcaggctgacatgataggagaacttttaagagaccctttaaatcctcacaggtatttaacgtaagcctgagcgtatagctcggatggggatcagtttaaatgctatatgtattcccagcatcttgcatccacattgaatagctgtggagctttgacaagttctttaatctcacggaccttacttttctcatccgcaaaatggagcccagtccattcctgcttcaaagggctcttgtgagggcccaaggtacagcgctacatgacaatgtcgtcatgactctttaaatatcctatgaaacctgtgatagaaacttgggctctcactcccagatcttactttccttactctttattattactatttatttatagtagctagtgactaatgatgaatgattcttccgcttggcccccctatagttaaggtcatggcttccttcaagaatctgatggaagtatgagcctccttcccccgatcccacccccacacaatttagcacagaatgccagtaattcagtctgaagcccagttaaaactctctgattttaatgtgctttttaaaaatggaaattacacatggtagcgcacgcctgtagtcccagctacttgggaggctgagacgggaaggttgcttgagcccaggagttcaaaggctgcagtgagctaggatcccaccactgcatccagcctaggtgatggagccagatgctgtctctaaaaaaaaataataaaatataaatggaaattacaattttatctaagagatatttttacagatgtctggaatttggaaatttctgcttataggcatttctatccatcatttatttttacagtaaaagaaataggccgggtgcagtgactcatgcctgtaatcctagcactttgggaggctgaggcaggcagatcatttgaggtcaggagttcgagaccagcctgaccaacacggtgaaaccccgcctctactaaaaatataaaaattagccgggtgtggtggtgcatgcctgtagtcccagctactcgagaggctgaggcaggagaattgcttgaacccaggaggcggaggttgcagtgagccaagatcatgccactgcactacagcctgggtaacagagcgagactgtctcaaaaagaaaaaaaaaaaaaaagaaaaaatttgtgttccttgtataagcacagtgcttttctagtactgtcccagttcagctgcctatggcaagattgtaaactatgaaaagtaagaatgtaaattaaacacagtgaaaagctgagtcatatggtaatgtctagaaaagtagtaagatactaaaagtatgtaagtcaaagaggcccaaattatattttcctttccatccttaaaatgtcatagctaactagagggttaacattttttaagtgctgagtccaatcaatgtgatttaaatcatccatgatatattcatagctgaatgattaagttggatgatgtgacaaaacacttaacttgtatttatggtcattgatgattttacgcattattagagagaagcatagttacacccaattaaatatagacatctgatccagacatcagttctgtaatttcatgggaaaaagtaaatctaaacgagcaaaaaatgtctgggtattaactccagtctgatggtattacaagttttcccagttaattagtaacacatattatagaacaaatgtttgaaacagaaatctcgtgattttgcgtaacaaaccaggagttgagctggaagtctctgttctcccactgcgttgctgtgtgaccttgggcaagtcacttgaccattgtccacctgtgatacaggggatgtgactacatatctcgaatgagaaaagacttcttcccatgttaacatgttttgactttacatcaattgtgtcattgctgcttttttaaaaatgttgcatcaacatttacgatacatataaaaaaggtacacaaattttaagtgcatagctcattgaatgtttactcttctaaccagctcctagattaagaaataaaacatcaacatcctagaagtcctccttgtccttcctctgggtcatgagtgctactcctaaatggttttgtgtgtgtgtgtgtgtgtgtgtgtgtgtgtgtgtgtgtgtatgtgtgtgtatgtgttttaaaaaggagagagagaaataatgagttgataatttttagaaatttggtggtctaacaaattaaaaatcaaatattattcatttggaatcctaataatccagtccacaattccttatctgcagttttgaaatacaaatagctctgaaaacagagaggtttttcttaaagttttgagcaaaagtatttggcaacaaaatctgacttgataggatgagaggctgtttgcagtctttatttttaatctcacatagtgtgactatttatgcattttactcaagaaatgttcatgtgtttaatgctatggttctggcctggactctactgggttcaaagtctagcacatgcatcatacttgtttgtttttcaaaataaaaaagattctaaatttcaccaaatttggccctaaggatttcggattcataccacaacataattgtttacacgttgatgtcccaacatttttactgcttagatttgtatgatttttatctgaaaagtaaagcagatatagttctagttaactgcttggtgcattatcaaacatccttcttccaatcctgcatttaaaaaaaaagcactgttactttgcaataattttagatttactaaaaaagctacaaatcaagcacatagagtttccctaacttcccctaatgtcaataccttacataaccatggtacatttttcaaaactaaaacattattaatgttggtacaatactattaacaaactatggacattattcagatttcttcagttttcccaccaatgtcctttttctgtttcatgatcctacccaggatccaacatggcatttagttatcatttcttcttagtcttccccagcctataatagcttctctgtctttcctgtttttttttttaatctcctttacagttttgaagaataataggatcttatagaatggcttttaggcatttttttgtttgtttgcatgtattttaaagtttttaaaaattaaactttgtattttgaaataattctacattcacctgctgttgtatgaaataatatagaaggaccctgtgtaccctttattccgtttcccccaatggcaacatcttgaaaaccatcacctgatatcataaccaggatattgacattgatagaatcaagatcagtagatcctccaaccaactcaactcttgcactcccttggttcagcacgtgctgactggggcctcccatgagtcaggctctgctggaggcctggggacacaggggtgagtgagagacaaaacctgccctcatggagcttagcttctaggaaacagacatagcaagtaaacacatgcacaaacagtataatgtcagctaatgagtgctatgaggaaaaatcaatcagactaaggactcagagaaagttggaaatccatgggccagccttccctttcagctctattggccggagctcaggggcaggtgcctgcttttgatgggagaaaatatcagtaacagtttaattggtgttttacagttccatcatgtataactattttatatctttgttggaaatccacacggttgttctgtgctggtagtgcgggtctttaaaaatctagggagtttgtttgttgggaaattccgtggaaagccttgtttccgatgcttctagtcccacagtgtagagtccctcctgttggtgatggcattttgtacatttagtgacaattggcatagagtataaagccttttacaagtctaaagtagcagtgtttctatttcttggtattcttcatatcatcaagaagctgtgacaaaatcagagaggtagaagccagggaagattctggattgcatatatttagatgggcttttcatctgattgtcaatttgtgtcactcataaaagagatatcttaattttaagtgcttccagaaaatgggaatgaaacaatgcttaaatagggccttcagatcaatttatggaatgatatcagttatcttaaaaaccctggaaatgagtgatttaaaataaacaactatggcctttttttattgtggttaaatagatacataacctaactatttttaattgtacaatttgactaggcatggtggcacacacctgtaatcccagcactttgggaagctgaggctggaggattgcttgacgctgggagttttagaccagcctgggcaacacagtgagccctcctgtctactaaaaaaatttaaattagctgggtgtggtggtgtgtgcctgtagttccagctacttgagaggctgaggcaggaggatcgcttaagcctaggaatttgaggttgcagtgagctgtgatagtgccactgcattccaggttgtgcaatagagcaagaccctgtctcaaaaaaaaacaaaaaaacaaaacctgtacaattcactgacattaaataggttcacaaagttgtttaaccacccacactatttccttaactttttcatcacccaaacagaaactctctacccattaaacaaaactccccatgtccctcttcccccagctcctgctaacctctaggctactttctgtctctatgaatttgcctattttaggtatctcatataagtaaaaccatacaatatttgtcctttttgtctggcttatttcatttagcatcgtgttttcaaggatcattcatactgtagcatgtatcaaaattgtattcctttttatggctgaataaaatatactttgtaagtacaatatacgtatatatcacattttagttatccattcatctgttgatggccagaagcatcgttttcaccttttggctattgtgaataatgcttccatgaatgttggtgtacaaatatttgagtccttgctggacttgaaagacctgagtcaatacttttgggcatatacctaggaacagaattgctggatcttatgtgttatggactgaatgtttatgtcccctcaaaattcatatgttgagatactaaccccccatgtgatggtattaggagatgaggtctttgggaggctgtggagccctcttgaatgggattagtatccttatgagaagagacacgaaagagcttgctcttgctcttgctctctacccataccatgtgaggatagtaggagaatacagtcccaagttagaaggagtgctttcaccagacaccagatctgccagtgccctgatcttggacttcccagccttcagaactgtaagaagtaaatgtgcgtgttcaagcaacctggtctatggcaatttgttatagcacctcgaattgactaagaaaatatgataattctgtggttagcttttgaggaactgccaaactgtttcccacagtggctgaaccattttatgttcccaccagcaatgcaagaggattccaatatctctacattctcaaacacacttgttattttgtttgtttttattatggccatcctagtaggtgtgaagtagtatctcattgtagttttgatttgcattgctctaatgaccaatgaggttgagcatcttttcatgtgcttattggacacttgtatatcttctttagagaaatatctgttcaagtcctttacctgtttttgaattgaattttttgttgttgttgaactgtagaatttctttatgtattcagaatataaccctttatcaagcatatgatttgcatatattttcttccactctgtgtgttgtctttttactctcttgatagtgtcctttaatgcatgaaagtttttaatttttatgaacttcaatttatttcttttttcttttattgcctgcgccttttgtgtcatacccaagaagtcattgccaaatccaatgttacgaagcattccccatatgttttcttctaagaattttatcgtgtaaactgtagtttataatctcaagttctggtctttgattcctttttgcatattgtgtaaggatccaacttcattattttgcatgtggatacccagttttcccagcaccatttgttgaaaagactgtgctttccccattgaatggccttggtacacctgttgaaaattgatcatatatgtaaagatttttttttctgggttctctattgtattctactgctctatgtctgtccttatgccagtaccacactcttttgattactgtagctttgtagttagttttgaaatcaggaggtatacatttcccaactttgttcctctttttcaagatttctttggctatttgggatttgtcccttaagattccatgtgaagtttaggataaatttttctatttctgaaaataatgttattgggattttgataggaattacattcaatttgtaggtcacttacaatattaagtctaccaatccatgaacatggaatgtctttccacttattttatcttctttgagtttattcagcaatgctttgtagttttcagtgtagaagcctttcatctccttgctttattcctagtttattctttttgatgctattataaatgaaattgttttcataattttctttatggattgttaattactagtgtgtaaaaatgcaactgattttatgagttgatattgtatcctgcatctttgctatttgtttatgagctataaccattgtgtgtgtgtgtgtaacttgagggttttctacatataaaaccatgtcatttgcaaacagaaatagtttgacttcttccttctcaatttgaatgcttttcatttctttgtcttgcctaattgccctgtttagaacttctagtattatgttgaatagaagtggagaaagcaagcattcttatcttgcttctggtattaggagaaaacttgcagttttttgttttgttttgttttgttttaccattgagtatgatgttagctgtaggtttgttgtatctaacctttatcatgctgaggaagttttttcttccattcctagtttattgagtgttattgtcataaaaaggtgttgaattttgtcaaatgcttttttgacatcgattagatgctcatgaggttttcctttttattttgttaatgtggtatattacattgactaatttttttatattgaactatctttgcattctgtgaatgaatcccacttggtcatagtgtataattctttaaatatgctgctgaatttggtttgcaagtattttgttgaggatttttgcatcatattcataatggatgttgttctatcatttttcttttcttgtactgtttttgtcatgctttggtatcaggattatattagcctcatagaatatgtaggaaatgttttcttctcatcaaatttttggaagagtttgagaaagattggtgttaattcttctttaaatgtttggtagaatttaccagtgaagctatctggtccagggattttctttgttaggaggtttttgattactgattcaatctccttatttgttatcggtcttttcatattttctacttcttcatgggtcagttttggtagattgtatctttctaggcattcgtccatttcaaacgtgaccattctaaactaaactgttggcaaatttgttactactgtctgttttattgaattactttcttgtcttagagtgaaactctcattttaaatgacatgttatttctttccaaggtaaagtaccaaggaacatgaggcttttgcttgtatatatgattgttaatgtgtattcaatttttgccaaatatttaataaaatattttactatatgtcttttgactcattaaaagtgggaaatctcatttgtgtataagattatcaggctatataaaaatgattccaacataccagagacatagtttagattacagggcctctgtggagtttttggtaaaatatcattattgactcacaattatcctcactcttggtaaactgactgcttttatatggtccttagcccatttaatttgtgtagcagaatgaaccagtgttatatttggctcaaatttaaatttctccattttcttatcagacactgggtcagagagagctaagagaagcaaccagcatcagtggggcacaagagctttgtgactttcctgtgtgcttctacctggtcttcaggatgggtgtttcctggtagacagtcattcatgcaacaagcatttgctgccctctaccaagcaccgtcttaaccataggtatcccaaccatgcagaacacagaagcgcacaaagcagacaactccctgtgctttgggagaaccaatgaacccaatgaaccgaatgaaaccaaagccaaaaggcagccttgatcccccaaaagaaattgattctgtaacccaaattgtaaagtttagagctttgtatttttgtcctattaaagaactgaattcattctcaggcactgccatctttgttggggctgggctagctcttatgtcaaaagcttgagcagccacttttaagaggaaggggactacgatgatgcagtcagtaaatttgtgcatggccttggaaaccttccagaattgtaagtgaaagctgatattctctccacagaagaaaatatagcaaaatgggaatctaaccatttcattggaacaggagattggactcaagttactaatacaggaaaaggcaagtagagaagggttgaggtttgaattctgagcagttctgcttgaggtgcagagctgatgatggtttgggttaagatagcaatttccaaaccacagccctcttgctaacagcaaactggattataccataagaaggcaactagttcagttagaacataccttagtattacattttaatcagacaccacaaggagctgactgacgtttaactccagagttgtaacaattttgaattgttgaattcaaaattcaacaattttgaattttgcccaaatttaggaaagaattggagtaagtcaggctagtggcctcctatagcaagtcaggaaagatatactagcagagtatagtgtcatgtctgtggttcaaaggttgtgtccttacctcttgagttacattttgattgacagggcaaaactgaatttttcagatattgtcacttcaaaggattcttaaaactctgccacaggattgatttttgttacgatatcgtcaggcagtgagtgagatgacatcctgaggtgctgaaatccttaagttttctggcccctgctgagtggatgacccaaagacccctgcagtttaactgaggtgtttattcatctgcagactggaagccaaggattggaaatttaacatgaaataaataattaaacctcacttccacaggtgcagagggcataaataatctaactgcatgctgcccaggcattccatagcatgggccatttagatttaatgcccaggcactcacttgtaactgaatatgtcggaaggtggctcctgcctgggatgggaacgggtgctatttcagagcagtgtgtttgtctgtctgctggaaagctgcctccaccctcagactcttctggagaccctttgctgtcttggactccaggggaaatgtgtccgccccttgcccagcccagagtacgaaatctacaaccaactcctcttctggttaaacaaaggaggtgatgtattgaagagaggcccaagagaaatgattcatttcatcagaaatgtttggagaaacagatgagttcgctgatgggagtggacttcacacactttgttctcagagtcatgagtttgaacctgagatcatttgagcattgggaagtggctgaaagtgggtgtcattttctgctttaacagcaaatcttgtgacaggcactgagaggtagcaatccattttctggtgaccaagggtaaggatgcaactactagttctaattatgtctgcatcacttacatggctttgcacacagtacaaatgtaataaaaatttgttaaacgagtcactgaaagaacactgatgcattgtgatattttgttcttcctaatagtggtcttgcctgagccagtgtcactcacagtggaggtccctggaccagcagcatcagcatctacttaggaatgcaaattctcaggccctgttccagagccaatcagtctccttagtgggcccaggaatctgtttttaacaaagcctctggtgattctgatgcctgcggaagcgtgagccacactgggctagagtttctttggccagggaagtgatttaagaattgtacgcatccttatttcctctcctcagtaggaagtcaccatagctggttgcaagagaatcgcattttaaatctttagatgtacatgtccccaaccctactcccccaggacttcttacccaggactcagctagtcccctggcttttttttctctccagatctcatgtttccagattctgtgctcagtcacttcttgggaaatacagatggggttgggagggaggcatcctcccctttgctgattgctggaggggattgagctgtcacgtcagacctctgctgaatgcccactgtgtgcaatgcctgcaccacagtgagcagtgcacagtcctcatccccaggacctcagaaactccaagggtggcagaccttggaagtgatgaaggtggggatgaagtggcactcactgggctggatctaggagcacccagatgggccaagcgcaaccgtgggctggggtggagtaggagggcttcctggaggaagtactgcctgggccatggctgatagggcaagtgagtggcagcagggtaaagagagggagagccaaagggaatttgaggctgaaggagcagcacagcttaaagcacactctggagagggtttcgtccaactctgggggaccttttttgctttttatgttactagatatagtaaagtctgcaactcttacttttacagcttgatgaattctcaaatgtgtgctcatccctgttaccaccacacagaccaaaagactggagatttccagcctcccaaaagggagcccatccacagctccctgccaccaaaggcaacccccattcttacctctgtcatcatagattagttttgttggggacttttttagactatccacttcttaaggaaaaaaacttatcctgtagagccaaagatggctcaggcttgatatgactttgagttatgtgttttgtttggtctatgcagaattttttttttaagctcattgctcagatttaaaagttgggggatttcacacaacaaaagcccaacaacactgggctcgtgaacctcagcagcagtgctgggctgtagtcaggtaggaaccgtccccctgaagatgggtgtccatgcgtcagtatccctggctgttccccactgctcactcctagccagctgcacttttgttacttgcctggcccacttgggcttggcccatgagttttcaatccctgcctttaaatatggttttgtttcttagtttggggcctcctgcatgactgagggtgcttagtaatttccttggttcactcttcagtgtgtattgagcactaactatgagccaggcccatgccaagagctgggatacagaggtgtgcccaggcagagggattgaggtattgtttgttgtttgccatgcaggcagccagaaatgtggcacagtcctacctgcatgagttcacttctcaccacctccttggatgccacccatgctggttgtttcctggcccctgagcccaccttgtttcatgatcatcacacatccactgtcactatcccttcatttcctccctgtctggtcctcatccttccctcaagcttttgctcaagtctcacctcttccaagaagtcttcactgaccagccctttctcttgtgatgcctccctcccctgattttatcagcgtattccccacaccacaatcccatcaattctcaattatttattccctcacattgaagaaacaggggccttgtttctttttttttttcttttttttttttgagactgagtctcactctgtcgcccgggctggagtgcagtggtgcgatgtcggctcactgcaagctccacctcccggcttcacgccattctcctgcctcagcctcccgagtagctgggactacaggcgcccaccaacacgcccggctaatttttttgtatttttagtagagacggggttttactgtgttagccaggatagtctcgatctcctgacctcatgatccgcccacctcggcctcccaaagtgctgggattacaggcgtgagccaccgcgcccggcccttgtttcttatattagttatcacaggccctatgggcaaagacttcccctatacttcccagcattgctccagcatgccctgcacagttctgagcttatggcagatacccaggacacacaggaggtgggctgggaagggcaggggagcaccggaaaaagaggctgtgatggcggcccctggggaggccagaaggagagcaccaggagttgccctcgctggcaggagcctggcaggaaccctgcctgtccttgagggcccatcttccttgcaagagtgttgacaccctgtgaggagggtgcagaaactccagccacagggccacagacgttctggacagtgtcatgtgaggtggcattggagcttctcctcttacagcctgacagagtgtcccttggggtggcaggttcattgaagacagcgtggaactggatacagaaggtgtcattttgatggccattccttcagctttatgccatgctccatagacagcctagggtacccctctctgtcccacttttagttcctcagtgatacagattgctaaaggcaactcaattgcaaatagccccgcaccatgtgacactgcctccttgaaaagtacttcagatgctggcagaggatggtgacctttcagtggtatatgcctgctctcagcccagccagacagaccactgccacagaggtgggagaggcaagaagagcctttaacttaagggcacttggcaaagggctgtctcatttgctagggttctgttatatgtcacttggtgtgcaagcttccaagaactacttggcttcctgacagggaacatgatagaatgtcaggacctaagctaatgtaaaatatgctttggccagccaagtcatgcacaggcaatgcaagaagccattggtcgttcacacgtctgcgccatgttagacgggggctccactgatggacttaacctttccagacccacgtgatgatggagatccggcaggcagtggcttcttactcaaggcatgctgattttgaaaagtatgagggcatctttaaaaaaaaaaagtgcattctttttttttttttttttcctgagacggagtcttactcttgctctgtctcccaggctggagtgcagtggtgcaatctcggctcactgcaatgtttgcctcctcctgggttcaagtgattctcatgcctgagtctcccaaatagctgagattacaggcgctgaccaccacgcctggctaatttttgtatttttagtagagatggggtttcaccatgttggtcaagctagttttgaactcctgacctcagatgatctgcctacctcagccacaaaaagtgctgagattacaggtgtgagccactgcacacagccgtttaaaaaaacaaaacaacaacaaaaaacaaaaaaaaccaaacctgcattcttaaagggtacttgtttcctgtcgctcttttttcctttatacggtggtccccccttatccatggaggatatgttccaagaccctcagtggatacctgaaactgcaaatagtactgaaccctatatatatatactatgtttttttcctatacataacatgcctatgataaggtttaatttataaattaggcacagtactcttgtgcgttggggccattatgaagcgaaataaggatgtcttgatcacacgcactgccgtatcatcaccgtttatcctatcattgaggtggctactaaatgacttgcgggtgggaagtatagacagcatgtatatgctggacaaaaaggtgattcacgtcccgggtggacagagcaggatggcccaagacttcatcagactactcagatcagtgtgtaatttaaaacttacgaattatttatttctggaattttccatgtaatatttttggaccacgcttgactgtgggtaactgaaagtttggaaagcgaaactgtgggtaaggggggactactgtattcccctcttcctgtttttcacctctcccatgcctccccctagtccctcccatttctgtgtctttgtgtttatctgttgagcctttggcatgaacaccagacaaggttggctgggtttataggtgctacattttttcacttgggcgcttcagatttagataataggatacagagacctagaggtttcatccaagtttcagccttgggccagttagggagtgtggaattggcaaccttttatgactgttaagcaaaatctttgcagaggagctgtaccaattaagaaatccttggctgccaacaggaaccccaacagtggcttaaaccagagggacatttctcatctcaacatgaaacctggaggcagaggcctaggtttggtttggtggctcaacagggtctttagggacccaaagtctttccatcccctaccttgccacgttccatgatgtttttgttcttatgcctatggcctcctcttcacaggacagtgacagaggccccaggattacctacttacatgccagcaaccaaagcaggaaatgggatgggcaacaaataaaaaccctctttgggccaggcacggtggctcacccctgtcatcctagcactttgggaggctgaggcgggcggatcacctgaggtcaggagttcaagaccagtctggccaacatggtgaaagcctgtctctactaaaataaaaaaattagccagccatgatagcgggtgcctgtaatcccagctacttgggaggctgagacgggagaatcgcttgaacccgggagatggaggttgcagtgagccgagttcatgccactgcattccagcctgggtggctgagaaagactccgtctcaaaaaaacaaaacaaagcaaacaaacaaacaaaaacctctctttgcttctgccttatctgggaggggaaattttcagactcattgcaaaggaaatgtcatttaaatgtgaaaactgatgcacagagctgagtcattttgggatacctgtgtgagccgggggttccattttcctggtgacccttctcaactccgttcccagtggttctttctcaaaattacagattgtgaagaatttttttttttcctcctagtttcttccagcctggagttcacagtggggcttacttctcacctggtcagccaaagcttaactgaaaatctccaagagttcctgtctttagaaacccataaagtccggtcctactccctggtactgattctcctttttttctgaatggtactcgcatcagcctggaccacggggaacatgctgttcccatcatttaccccgtgtatgagccggagatttcactgttagtgttaagttacagtgccttgctggttgggagcttgccttttgaaaagttcaggtccagccctcctttgccttatcttgggaaatgactttctgctaaaataatttcggtttgtacatatgcatgtccatgcacacaccccagctccacaccatccagtgggaaagggagtcagggatttcatggtagctgtcattttgatgaatgtccctgtgtccacccacagaggccgtgacattcctgcctttcccacttgataatctgaaaatctcccaagcctgattgccttgctataggcctgcaacctggaatgctgcataggttctgagtttcaatccccagggtccgcactggccaggatctgtaagagcctgtgggcttgatgctgataaggcagagagctaacgggggattatcagagagggagagtgccagacaaggtgcattcctctggggatagagcagcaggactttgggagctgggacaattgtgtgaagcaggacgtgattgcgtggtcttgtttcagccagcctcagctatccccttttatctgcccccagaggcactgtgctttttaggcctcctcaccttccctctgaaatgtgctccccaatgtgcccacctcttctttctgttttccagcctctgctgggcaaaagtgggaagttgctctcaagtgttaaacgtgttcactctcaccaagtggaagattttacattagaattcaatcattctgtttacttcctttaaagtcgagagcgtatcagctgagtgtggtggctcacacctgtaatcccaacattttgctaggcctaggtgggaggatcacctgagggcaggagttcaaaagtgagacccccccatctctaccaaacaaacaaacaaacaaacaaatttgctgagtgagatggtacacacctgtagtcccagctagtctggaggctgaggcaggaagattacttgagcccaggagtttggggctgtaatgggctcggatggcgaccgtgcactgcagcccggggcgacacaatgaggccctgtctctaaaaaatacataaatgaagttgaaagcatgtgaagtttatgattggctttgtgatcggaaggatgtgtcatgctttcccctgggtgttgggaaccttctgaaagaactgctgtcggaattcagggtcttctgtgcctgtccacccactagccctcatgggcgtaatgcagagatctcagaagggagagctctggatccagactgcttatgttggaatcatcttccacccacttactcactgtgtgccctttggacagttatttaaccactctgcacctcagtttcttcatctgtaaaatggaaattatggtacataccacatatgattgttagaaggagtcaatgagttaacctttaagtacttaaaatggtatctggcaattagtgagcaccatgtaagtgtttgcttaataaatattaagagtttggggtttggggtgggttttttttcttgtttttttttttgtttttttttttggttggcttaatacctttctaactgaaatttttgttgagataattgtagattcagatgcacttgtaggaaataatttaggccaggtatggtggctcatgcctgcaataaagcctcactttgggaggccaaggcgggtggatcacctgaggtcaggagttcgagaccagcctggtcaacatggtgaaacaccatctctactaaaaatacaaaaaatgagccaggcatggtggcaggcacctgtaattccagctactcgggaggctgaggcaggacaatcgcttgaccccaggaggcggaggttgcagtgagctcagattgcgccattgcactctagcctggacaacaacggtgaaactctgtctcaaaaaaaaaaaagaaagaaagaaagaaagaatttagaatgtatcagttaaaaataaaactaaaaaaggaaataatgatgagatttcccatgtaccatttatccagttcccccagtgataacagtttgcaaaactgtagaagagtatcacagccaggatattaacattgttacaatctacctctcttatttatcttataaaagatttcccattttacttctactcctttgtatgtgtgtatatatttagccctatacaattttatcacacatgtaggttcatgtttccagcactacagtcgagatactaaatagttccatcacaaggatctcttgctttgccttttacaaccacatccacctcccgccctttgacgaaacacctggcagggactaatctgttctccatttctaaaattttgtcgtttttaaaatgttatataaatgaaatcaggccaggcatggtggctcatgcctataatcccagcattttgggaggccacggtgggtggatcacttgaggccaggagttcgagaccagcctggccaatatggcgaaacaccatctctcctaaaaatacaaaaattagccagttgtggtggtgtgcacctgtagtcccagctcctcaggaggctgaggcaggagaatcacttgaaccagcaaagtggaggttgcagtaagctgagatcacactaccacactccagcctgggcaacaaagcaagactctgtctcaaaaaataaaataaaataaaagcaataatacagtgtgtaaccttttgggacaagcctttccactcagcataatttcctggagatttatctaagtttttgagtgtatcaatggtgcattatttttccttgctgaatagtattccagggtatatatgtaccacagtttgtttaaccattcacctattgaaggatatctggcatctttccagtttttggctattacaaagaaagctgctatgaacatttgtgtacaggtttttgtgtgaacataagttttcatttctctgggaaaaatgcctaaaatgcctaagagtgcaattgctgggttatatggtaattacatgtttaggtttactactttaataattataaaaaacactttgttatttaaatttgtacctcccaacagtaaatggatgttccactttttgacttgcagctaacattgtattagtatttgttaaataaattaaaacagaccactggcttttacaatgtatccaggactgtgtaagaggaaagggagaggaggggattcagatggtttggtgacagttcttgtctttaagacatgtgtcatcttagctctgggaattgagtggctggaaagaagagccattagactgtgtgcaggcaaattatagaaggcctgaaacagcccagaggacagccatgtgggaggtgggagatgaggacagagtggaggtttggagaagccttgtcaatgttggtgccaccgatggctgagtttggaaattttatggtcttttgtatttgacaaaaaattggaaatatttgaatttgaagaaaagccattgatttttcatggaatattatatgtttttggttaaaggtaaggattattgcagtgataaatccctttgaaagggtatacttttcttacaagaagaaaacagaagcatggccttgctggaaaatggctggttttagtgactcaccattgtgaacaaaaagttcgattgttggccaagtcacagagtggttttcccggcctccagcacgatgctggttctttctgtggattgggtcattttgatggagtgcagtgaaagttcacataatgtgtttgacgcctggaacagataatttttcacattactgtcctctatatgacaacattattttcaataaaaaccatgcagtcagcaataattttcttgatttttttcttcagtttgtaaacaatgaatgattgaagaagaatggatataagttttaaatatactactcagatccaataaaatatttcacatctgaattagcatctgatttttcatttttataatcactgtgctatcactgtttataccaaatctgttttaaccagtgaatcgataatactgcagggattggagatacaaactgtgttggaaatggaattgaaaatgaattgattctaaactagtatgaatttattttctaaatctgtgtgtgtaggtgagtctggatttgcatgagcaactacaaatccaagagttctccaaataaatttcatgtaaataccatgcttatgaaagcgtaagtaatacacatatgctaatttgaaacttacatatatattaatctcaacagtggttgcaataattgtttggaacctaaaccaacaaaacaattgtttttgtgaaggagtagcttctcattgacattgtttagactactgacgcttggccggatgcagtggctcatgcttctaatcccagcactttgggaggccaaggtgggtggatcacttgaggtcaggagtttgagaccatcctggccaacatggtgaaacccccatctctactaaaaatacaaaaattggccgggtgtgatggcagagtcttgtaatcccagctacttgggaggctgaggtgggagaatcgcttgacctgggaggtggcgtttgcagtgagccagaatcacaccactgtactccagcctgggtgacagagtgagactccatctcaaaaaaaaaaagaaaaaataaaagaactgctgatgcagatgacttttagtagttttattcctgttgtaaaaatctctagagacaacatcctaccttattgcctgcactggggtagcagtttggttgtgtagctgtgtgactttgagcaagttgccttcatagctatagtcatcttccttatctgcaaaatggtaaagctttctgtgggttaataatatgatccacacaaagtgtctggagtggcattggcatacaataggttcttaagaaatgtgagttgtcttcacttctccacctggaatgggcaatatctgtgtgtctctgggacagccctggaccttgaggttggagctcagcgtgaccagtcacagagctgcctcccttttcattctctttctgatatccgccaggaaatgcaacggttctgtttaagcagcattcattgagtgactacattgaactccaaaggaagcttgaataaattctagagtttctttgctgtgtccatgcaagcttggatgggagagctattctggtctctcttgggatgaaagggtgggaaatttcaggacggagtggtgggctgtctgtctggagggtgaacctcaaaaccaatggcgattctccttggcttgagggtaaagaggctctgcagctgtttctcctaatcaaagagggttggttgtagtcaggccatttacaaatcactttccttttctttctctgtcttggtcttgcctcctcctcatactgataattgccaaagaatgtggtccaggcctttttgtggcttttgtgagccttttatagcagtaagaaggaattctcggtattctcatcgtgtataaaagatcaagctattcttatgcatgacatagctcatgttgaacgtggaaaaacgcttaaatgacccagggaggctctaggatggctactttacatagcaattgtgtgctgtaaaatgaacctgttgcattttaaaggggctaaagagaattcttaattttgtacagtttaatctgccaagtgataaggctttcttttccctttttaaaggaaaatctatttagtgatggctatagggaatattgggaaggaagctcatatttttaatttaaacaattagaagtgtattagaaaatctatcctagaaaaacatctcatgttgtaaataagctcagatgtagattgttggatataaaatggagcttaagattttatttttgctaacctgatattccagagtgtatattgtatttttacaatattggctgcatagccaattcatttcaactggaaaatacatcaaaaagcatataagttaatcaagatcaagctaaaatacactttaaaaaaatgttttttctggttttattgcctgccattctgctgatttatttcctagagaaagttaaacatttttaaaacacagaatgaatggttttaaaaggcaaagagcatagatctgaagccttaaaaatattactcagctataaaaaggagtgaaatcctgccatttgcaataacatgaatgaaactggaagacattatttgtgttaagtgaaataaggtaggcacagaaagacaaattttgcatgttttcactcatatgtgggagctaaaaattaaaacaactgaactcatagagagtaaaatgatggttaccagaggctgggaagagagggtagaaagtggggatggttaatgggtacaaaatatagtaagatagaatgaataagacccagtattggatagtgccgcgggatgacgatagtcaacaataacttattgtacatttaaaaataaccagaagagtggaattgtaatgttcctaacacaaataaatgacaaatgcatgagttacctgatatgattattatatgttgtacctctgtgtcaagacaccacatgtactccacaaagaggtacacctattatgtacctataacaataaaaaattaaagaaaacatatgaagtaaacactcggttataaaaaggttggatgaatgagcattggcagggctagcttcactggcaggtgatctgtgctgtcacatagggccccatgcttaaaggggctctgtgcttgggcgtgatgctctggtaatcaccattttgaaattcttactaatttctgaacaagggccccacattttcattttgcagtgtgccctgcaaattatgagctggtcctatatatcagctacccaataattcagctcaaactagctttggacttttgaattttaatcctaatcttaactaacgtttatcagattgtttttttctgtatgtgaatttgtgaggaccagcgtgatgaactttcatgtagataatttttttcaactattttcaaagggctaagtattagataagtggtgtttttaaacatttttatcttgtttcatacagtataaagctaaatcccacttatttactagtttctggtaaaatacgtaggttctatatatttttgctagataaaaacaggtgaaataaaaccttatttctcaaattattaataaagtattaatagtggctattgctgaaagctgggatttcaaatgattttcactttctaagttttatagctctgagttcaagtttttacaacaaggcggaattatttttgtatttcaggggaaacaagaaacaataaagaattttttgaaagtctgttcattgtttcccattctggaaggtggtgttggggcattgaggatcctggggttcctattcctgagggcaaccacagaaaatttagtgaagttcaagaaatggcttggaatgattgagagtgtggctggggtggcaggactgtggcagaaacgtccagtggggtttgtaaacttaggaataatctgggcctggcgtccaatttcacgaggcagtgatgcaattttattttattttgagtccttggctatcaattgtagtgtgtctttgtttctcatttctttttctttttaaatgttctcctcacctcatccctcaatagcaggtcagacgtgttgctgtgagccaaagctgcatgttgcctttgaaccaggacagagctatcctgatgcagggtcaggttcaatgtgagacaaacagctttggattctaaacccttgttgacatctcagccccgctgtacaatgtggcatggctaatgccctcctgctgcttgtgaaatggccaggatttaaatgctgggatcgggagtcaaagacccaggggatgaccctggcattttgatgctggacgcttgcctaggagagggcaaccccgcaggcatgctgggaacactggagcagacagcaggccattctgggagcagcccacactggccagcattgctgcctgtctgttagagggagtgtctgccctgaccctgggaggagggaccatctcttacttttctgtctgtaggcagaaatgttttcactaaaggccctggcacatcttaaacatgattttaaagatcagtgataatttcttttttttttttttttttaattgggatgggatcttgctttgttgcccaggctggagtgcagtgttatgatcgtagctcactgcagccttgaactcctgagctcaggtgatcctcccttctcagccttctgagtagctgagactacaggcgtgtgccaccatgcctggctattttgtttttttaattttgtagagatggggggtctcattttgttgccaggcgggtctcaaactcctggactcaagcaattctcccaccttggcctcccaaagttgggattacaggcatgagcagtggtgcccagcctcaattatgatttcaaaaatcataaagttcaactaaaaaagtcagaacccattagagatgaacagaatgtttgtttttttaaaacctttgtcccttggagccccagggactccaagacatgtgccctcctacacgtcctccagaccagctttgctcacatcagcgttctgttttaggctttcacctagtatttcatatgaagaaagagttcatgtctaaaaagcagtaccactgaattcgatcaacttttttttatcatgctatttgatccttagtgtccaaggtccctttagtgctgacgagtgaaaacagataccaatagttggactatgatcatattgggcagtttcctttgtatttgaggtgggttttcgcgcaacaagctggtggtcatgctgaactggatattccgcaataatctggaaatgtagccaagactgcaaattatgatgacaataatcagacacttctgtagcatatactgtgtgctcgcacttgcctgagcacttcccatgtgattgctatttaatcctctcaacagccaggaggtaggccctgctgccagccccatctcatggtgcctccggttctcaggttggagaacaactgaatattggggctgccccactgggcctcctcagagagccacttttccatcttcagttctctgcctcccagttaaactcccagccccagtaggaaggactgaggcgggagaaggagctcacagtttggagaatgcagttttcttggagagaagctggtccttccctcccccttcccctttgggggcaaatgatggggcttcctttttccaaagttttctgtgcagatagggcaccctggcatccagttttccagctagacacgtgcgtcatcaggaacagctgcctgccctgggctcctggcacaggagaaggagaagtgaggtcaggaacccttatcccaaagacaggcttcatgtgagtcccaggctctggacttgtggagccgggcaggtgacgtgaaggccacagttggctgggactgcttttgcttggggaaccagaaggctcctacatgtggaggttgtcatgagacacacccctagaagggaatccggatttctccagggtcatctagaggagtggtttgggaggaggctcttgttactgtcccccagcccaagaccatggaggacttgtggggtgcgtgtgtgattagactccagccgggcgattgtggccacccctatccagtggtgcaggaaagaggccaggaaaaccagcctggctaacatggtgaaatcccgtctctactaaaaatacaaaaattagctgggcgtggtggtgggcacctgtaatcccagctgctcgggaggctgagataggagaattgcttgaacctgggaggcggaggctgcagtgagctgagactgtgccacttcactccagcctgggagacagagtgagactccatctcaaaaaaaaaaaaaaaaaaaaaaaaaaaagagtccaggagaggggaggtgtgggaaggacaggccactgccacctttaccccaagctaccaccactgcaatagctcttgcctggctgggaggaggggacaaaaagaatgtggaatcagctatgagactgaagttttgaaatgaactgagctgagtcttagaaatctaaatgagactggataattgcaagtgactgaaaagtcaacggatgactttaaggaagtccccactaatggggaaagtcagagaaggggttgacattgcccagatggggtagttatgtaaaaaacgaaggcattctatgtttgtactctgtgaactgagactgccgcataagccagcctcctttatctatcagtctgatccagaagaattattgatttattcatgcatttatcccacaatgcttagtatcatctgcgtacaatgctaggtactaggaaaacaggacttcagggttttgcaaatgtgctctcttcctacccactaggattctgaattcctacacagggattgtatcctttttttttctctgtccctcacctctgtttattgttgttactcatttaatattgtaaggtaatgtgttgttgatctacagtgggaaagtgctagcattgtttcagattcaggaagcttattcacattagtaatggtaatttcttattagaatcagtaatagtaagaagtgataagatccaagtatggaagtagcattttattttcttttttctccaattgaattatcatatattttaattaagatcatgttttatattattttgtgtcattcttcagtaggaaatgatgcatcagaccaaacaaggtgctcagttacagttagttaattgtgagttcatgtatggttttcaggtaagtcatatgccagctctggccctcatttttgtcatccctaagatattgtgtatgtttgattgtgtggttgtgtatagcagtagcaataatagtggtggtatcagtagtaatcattgtgaacagagatgattcttttaaaattaaaagctactgcaatttaatagctactgccatagtctgagcatgacatgaggaggttggctagaatatttcaatctttattgattgaggccaataaaaactgatctagaggctgggtgcggtggctcacccctgtaatcccagcattttgggaggccaaggcgggtggatcacttgaggtcaggagtttgagaccagcctggccaaaatggtgaaaccccatctctaccaaaaatacaaaaattagcagggcgtggcagtgcctgcctttaatcccagctactcgggaggctgaggcaggagaatcgcttgaacctgggaagcagagattgcagtgagctgagatcgcaccactgcactccagcctgggtgtcagaacaagattctgtgccctgcccccaaaaaactgatctagagaccccaataattacctttcagttatgtcatgagtgtgtacttaatcacctggactccactatataatctgtttggcataaactgtttttgctcttttctgtgattccccaacacatctattacaccctctgtagagtatcttaaaatggttgccgtcatcctgggtcacccctaactttggcgtccatatttgtaaagtgtcttttccttcctctttgactgcctcagtttcccccagaatacctcttgtgatgcttcttttgttctgtccactccctcagtgcttgctctattctccctgctctttagggcttttagtgtgagaatcacagaagataagtcattgacatacatacaggcttgactaacggggcagatgcagagaagtggatttttatggaaaatatatggaaagaaacctggccaaagagccatcactaggattccaggtctggcgtggccacagatctgctgtgtggtcctaaacaagtctgctacacagagtaacgtgcactaggcttagctagtattataactgttgctggttattagataatctttcctggcctcagtttccttgctgttaagtaaggaacatggcttgagtgatatcctgagtcctctccactctcattttaggtgcaatacgattataaccctgactaggataaatcactagggaacaaagatgaggccctaaatctcctgtgtcccttatgacactttgcacgctacaggggcagagtagtcatttaataattcagtactgcaactgggtttttagggcattgctgaggaattttttattatctaaatatatgcattactggcaaattaaagaataaatggacaaattctactcagcatttgtacagtgttttgaaagagactcacattcatcaatttaatgtcagcctcgcaaccattccctaaagtaggtagagcacatctgacctcaatttatggataaagaaatggaagcttagagaggggattatttttttcaggtttcccagctagtaagtggcaagtctggaaccacaatcccgggctccttatccctgtgccagtgcgttttccagcctactaaggactacgtttttgggctagttgggaacagtaagaaatacttcattgtgaagactgataatattcagatgtattaatccctagaagatacatggcccaaaggatcatcacccaggaatgttattagaatgaagcttacccatctcctgtgaggacctggctaagcagatctgtgcctggagttacagtcatggcagtgctcctgattctgaagatgggctatgggaagaggactttgggacatgctaagcctcctgagtagacacttgagccttggcatagttgggattagggaatggtaggagaccctcttaagaaagaaaagagtgttccctgactcaagagcctcatgaacctgggtcttgcccatgctgggtagctagaaatgtaaccatatctgcagttcttggaggtcaatgaaaaggttgtgtaaaggagtattgtttggcagatgtctctagtaccattgctgcaacaaataaagctggcttagcactggcctgtctgaagctgtgctctgcagtggttgtagtcatactgagctgaccacctgaccatctaggctcctaggaactgctagaagggccagacaatgaggacccaagagcttccaacccaaggtactcctagaagatcccattacttgacagcagcaacttctgcttctagaacttgctgagagacctgctgatgagagcagctgctgtcagctgtcaggaggagctgctgccccaagagagcaggaacagcctctgggagctgtgggtggcccatgcccaacaggagtcaccagtaggagcagcagatagagtaccaggtgaggcagtccttcctggttgtcctcagccccttagaattgttgagaaggggcaacatggtccatcttccaagaagaatccttccctagtagttgacctggttggagacccagcagctcagggtggaggctccagctggcttgaattgtctcctggtcttcaagtcacttgttggaggggtggcccagggaaaaaggattgccttcccaaatgatgttgatgaaaataatatctgtaatccaaaaggtttttaaaatgtaatttattgcctgggagcattggttcaagcctgtaatcccagcactttgggaggtcgaggcaggcagatcacgtgaggtcaggagttcgagaccatcctggtcaacatggtgaaaccccaactctactaaaaatacaaaaattagctgggcatgatggcagactcctgtaatcccagctacttgggaggctgaattgggagaatcgcttgaaccagggaggcagaggctgcagtgagtcaagatcgcaccactgcactccagcctgtgcgacacagtgagactctgtccaaaaacaaaaacaaacaaacaaaacaaacaaagaaaaaacccataatttgtgaatattcgtacttctatactccatcactctttactgactaactcccaagtggaagtgaatgtttccatcttgtgtcatcacactgtctgcagcactttcatatcagccatgcatgtactccttcatcagatgttggttgagtactgtagatggctcaggccatcaaatgtcagttttcctttgctgcattgtacttatgtacatatcttagccctccactagactaaagtcttttttgttaagtcctgataggttaggtttatgctgtagccacaaaaccccagaggtttaatacaacaaaaattttatttctcactcattcacaaatcctacatgatttggttgggtgaatattgaggggctgctccatatgattcctcagggactcaggatgactggggttccaccatcttatagctgagctaactggaacatgtggccttgatcactgagatggggaagagagagtactgaagggtctcacccctgcaattacattgcaattacaattacagtactgaagggtctcaccccagcctggagatagcatcacgtctactcacagcccattggccataactaatcacatggtccccacttaactacaagggaggcagaaagcgtaatccccctgtgtgcccagaagaaaagaactagatgagcatgagcactagaagtctctccacaagcttttgattatgttcttggttccctcactcacttgcagcaaagttgtctcaggaagtatcacattcttcatttgtaaaaaggggataatgtaagtgatgaaaagtcaagtatgtattgccaattttccagtttggaaaagactaatcaataatttaggcatcctctgtgtgaaggtcttggtcttttctctttcctagtaatgaggaggtagaatggtaggtgcgtaattaggggcagaagcagtccccttagaaggccccagatgtctccctccagggcaaggcttagcctcatttcctgccatagaacaactcctgcaactgcataccaccctcaccccagagcctcagggcacctggcttctcctgctctgtaggcctatatggaggcccattgaccaggtctcaattatgtaacatctggcctaattaaacgtgtactgtttacctttattcatgcaattgccattgaaagagtaggatttgggattggggtgatctgggtgatctaatattgcaagttattatgtcctaacttggagtcagtgtacaagaaacaatgatcagagttcagaagacagtgggtatttcagtatgcatattcatggggaataaatgactggagtatagagtaaaagaattatggctgggcgtggtggctgatgcctgtaatcccagcactttgggagaccgaggtgggcagatcctgaggtcaggagatcaagatcatcctggctaacaaggtgaaaccctgtctctactaaaaatacaaaaaaaaaattagccaggtgtggtggtgggcgcctgtagtcccagctacttgagaggctgaggcagaagaatggcgggaacctgggaggtggagcttgcagtgagccgagatcgtgcccctgcactcccgcctcagtgacacaactccgtctcaaaaaaaaaaagaaaaaaaaaaaagatttaaaacatggaaaatttgaatttacaactgtgcttgttatccttcctgtaattgtgttttaaacatcggttgattgagtttttttcattgtttgtttggtttttgcataaagaaatgtttgatatcacatttgtcttgtccgtgtttcttgtgacaggccccagcactagtgtggcaatcctcaactgcaggcttctgaggacagaactgtgtgctgcctgcttcactctctctccaagctccttttgcaatgcaaaataaggtgtttaataaatgatgaggctggtgaaggtggtctgcagtgacagccttcatatttaattcactacaccctcattctttcctattctttagaagtactgttgggaccttcaaatctcataaatattctactgccctcctccccctcctcctccctcctctccagaaaaattccatctgtgcaaatcccattttgttccaagggtgataatcttcagggaaacttatggaatgtgatgggtttactggagttcctgggtgacaggcccccaagaacccccttcagttctgcagagcttactgtagagatgacatcaatgtcccctggccatctggaatgaactgagtgtgaggtggagagagtgtgggctttgaagtgtctcccacctgatttgaatcccacccctgccgttgactggttgtgcgacattgggtctcagttcagatcttgttcacttgtgttctgtagtggatcctggcatctgttgctccatctgcctgccacagtttcccatccctcttcctctggttttgattccttgaggggaattcctcatccacctcacatggtcctactgtggctatcagtcatggaatcacaaagggatcttcctcactcactggagtgggcaggtgacccaaagcgctccattgcactggccccactcactgtgcgagggaggagcctcattctcaagcaaccccagttagcatttctcctgggactagtgcatggagagaaacaatcccttttgcacatgggctgcctagaaagaatgtgagtctggggcttcgggcatctgttctgtttgacatgtggcaatatcctttgagaatgaagaaaaacagacaagcagcctgagagctagggcgggggacagaggcttggccacatggcttccacccttgcatgcagtgggcctggagtcagcaccacccctgacttcccaaggacagaagccagcacttcccctttttgtttcagcaactttgggttgggtttctgtcacatgcacttaaaagagtttgaatacaaatacctttatcatcctctagtttttaaaacacattacattttataagcaatatataaattcataattacagacattcaggcatcttagtttttccttagaagaccaagtactcagaggagggctccatgcttccccacctctgcccaactggactctcccttgcaaaacatgtgtcaccactgacagctgtttggggtataaacttctagccctttttctggtatttctatctgtatgtttgtatacatgcatagatagtttgttttattttttagcatat

SEQ ID NO: 2412 - DNA, 663 bp, Homo sapiens
agcaggcagaggtttagaggcagcagaaccatgggtaagcaatgaaagggtttggatgtttgtgcccccaaatctcagattgaaaggtaatccccaatgttggaggtgtggcctggtgcggggtgagtggatcatgggggtggacttttaacaccatccgcttggtgccttctttgcaatagtgagtgagttcttgtgagatccggttgtttaaaagtgtgtggcacctccccttgttctcttgctcctgctctcaccacgtgatacatcagctcccccttcaccttctgccatgattgtaagcttcctgaggtcatccaaaagctgagcagatgccaaccatgcttcctgtatgtacagcctgcagaactgaggccaaggtggtaggatcacttgaagttgggagttcaagaccagcctgaccaacatggtgaaacctcgcctccactgaaaatacaaaaattagctgggcatggtggcaggcacctgtaatcctagctactcgctaagactgaggcaggagaatcgcttgaacccaggagacggaagttgcagtgagccgagatcatgccactgcactccagcctgggcaacagggcgagactccacctcaaaaaaaaaaaaaatgtgtaattaactgttccccatgtcaataaatattct

SEQ ID NO: 2413 - DNA, 755 bp, Homo sapiens
cagggcctggctgacacggatgcagcctctctgcttggagttgcgtctccatgaatattttatgctgggggctgccgcacccgctccgggcagctgccagcacttcccggtctcggtctcgtattagaagaggccaactcagcgcgtagaggcaggcctccccgtggcagtgccctctgaccttgggccgaagggggctggagaagtggcttgtggggagggacagcaggacgcaggcggcagcagacagatgtgggaaggcttttcagcctgcaggagggtcagagccgtgtgtctgctgaagcggaggacgtccctggcacctcagcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaccc

SEQ ID NO: 2414 - DNA, 8467 bp, Homo sapiens
gcccaggctgcagtgtagtggtgtgatcttggctcactgcaacctctgcctcctgggttcaaatgattctcctgcctcagcctcccaagtagctgggattacaggtgtgcaccataacatccggctaatttttgtatttttagtagagacggggtttcaccatgttggccaggctggtcttgaacttttgaccacaagtgatccgcctgcctcggcatcccaaagtgctgggattacaggcgtgagccaccatgcctggcctactttttgatcaacatctatattgtctgagacttttttttcccatgcaaaagactggatattacaaaattcacccatggagttgtgtctgggtccccaatctgttctgccttcatttataaaagaatttaaatttttatcctagtgaattagtatggtggtccatatggaaattagggtaagcatttcatcaaagcctcgtagagtctgccacttaccgaagacagtctgaagattagttccaattataaagactctccattcatgggcctgccctgggcttaaagctatttggacacatagcttatttagggaacaagttgagagctattttatatttcataaaactttataactggtgttttattcacaaaagtctccttcctttaagacatcaaaacattcccaaatacatcacactgaaaacttagtggcagcagtctatctgtgactttcttcatttctgcagaaccacatgtaatttggaaaatgagcaatatggaatgtgtctgcctgagataaaatagttaatctgggttcaagcaaatcagtcattcaataaatatgtattgattacctaataggtgtgcttttcaaagctgtgaggatattgcaataaataaaatatgcaatgatgcctgttcaaagacagtttatattctttggtggaagagaaacaatcaataataacccctccaaataagtaaattattgtgtgtgtcagaaggtcatatgtgtcatagagaaaagtatatccctgattctcaagggaaatagagaagggatggtgtcacaagttatgttggggtattgggataggtttctttgagaatgtaacatccaaggaggtgatactccttaagagagtatagtgaggaagatgctctgaggccagagagtgcttgacaggtacaaagaacacattctgggctagcagtgaggaacaggatgttgaggttgtcagagggagatgtagctgggagccggatcctgtaggagggtcttgtgggccactctttagtctttgatttttactttaagtaagacaggaagtctttggagggtttcaaatagataagtgaccatcttaactatctcactgctaaataagaatagaccatgagagggtgaaagtttaagctgggagaacttagaagtctattgctaccatctaggtgagtgatgatggtggctatggtcaagttatagcagtgaaggtgaagataagatttccattatgttttgtaggcagagtaacaaacattcaccaaacatcagagccactacgtgaaatgaaaaaaacaacaacaacaaaaaaaaaacgctgaaactagccttatgtgctttcttattttgtttttctctttttatctcactgtcatttactccactcccttcacaaagttcttgagaatccttgactttccaggcttctttcagctatgctatctgtcactcggcctctatactgaccagttctgtgtaccactcctgtgcttctctccagctagcctctctgaattgatcctagtaacggttcgcactcaggtgttcaatgattgacaaaagcttgtcttcctctctaaccccgcactccctggggggatttgctttttttttttttttttgaggtgtagtttcgctcttggcgtccaggctggagtgcaatggcgcaatctcggctcactgcaacctctgcctcccaggttcaattgattctcctgcctcagctgggattacagtcacctgccaccacacccagctaagttttgtatttttagtagagacggggtttcaccacattggccaggctggtcttgaactcctgacctcaggtgatccgcctgccttggccccccaaactgttagaattataggcatgaaccaccacactggccaggatttgcattttaattgaggggagtgtgcagtttaactcaaacaagagaattgtcaaaggaaaaaacagggatcaagataatgcagcaaatgttacaggtttacgtcatgaagaaaaatgacttcaaaaatctgtattagaaatgttctcagggcatgcttggagtggtggaaggaggtctttaattagccaggcttgtctaggacttgaaccatagacgaagaactaaaaatttgtgttttttcatgtccttgaatcttattgtaattttcaattagatatttcaagtcaacaaatatttgctgaacatcttttctctgccaggtttgtattaggtgttgaaaataaatgaacaaataatataaaatctctcctctaaaagatctagcaggcagatagggatggcaaaatattataataaaatgaaacaaaattatgcatttaaggtgttagaggaatgaaaagataaatgagggatgcagtggggtcctgggaagggacctgtcctgggaggttttctcagttgctacctcgcccatctgctttgccaggcagtttttgacagttgtatcctccacctctagcttttccattatcaggatcattatagattgtgctctgccagtaatccagatataaggaagtgtctgggcaatccctatgaacgggatcagggcttggttgagctttcatctcaggactgatgtcagggagattctgactcaggtaagacagacgtgatcaccgaggagcagaaagtgtacatgtagagtgatgctctcatctctgcccaggaatgcttctggaagaagttggacatggtggtagtgaggcccttcaccatggtttcctcatcctattgtttatataacccaagtttcttgcatttactgcaccggtccccaacctttttggcaccagggaccagttttatggaagacagtttttccatggattgagggtttggggatggttttgggatgaaactgttccacctcagatcatcaagcattagattcttataagggacacacaacctagatcctttgcctgtgcagtcacaatagggtttgcactcctatgagaatctaatgctgctgctgatctggtaggaggcagagcttaggcagtcatacacgctcacctgctgttcacttcttgctgtttggcccaattcctaacaggtaccagtttatggtctgggggttaggggcccctgatttaccacacttaaagtgtaactgtgagtccaaacccctgatcctcaaagcaactaacatagttcactttgtgacctcatggatctttattactagagcctgtggtgaaattttagacatcagcaacaggatatatgactttagtggaaaatattttctgaaggggcagaatgtgttcttgctatccttaccttcaaacccagaatttatattgcagctggcaactagcattgcccataaacaggattagctctggtaaacataagtaataaaatgccattttgttttccaaacctaaactttgacctgcaccatgcagaggatatttaagaaatattttttaaatgtttactgaaagcatagattacaaattggagagaaccaataggtattattgccttgtttgccagattcaggtttaggccaatcatttttacctcctatgattagctaatgtttactctaaccctgtaattccacattagaatgattagtaattttaagccaaagaggaaaataaatgaatttggtttagcacctggaagccttgaaatgcttaagaggaggtgtgtttcaaattagaataaaaaattcatatttagatcgagtacatattgttaagagaacccagaggaaaaacagtggactcaaaatgtgtctttttttgggcaataaataggatttttatactgaaaaggaaagggtatgtatgtcttagaggagtagtgcatgtcatgtagtaggtactcaataaatatttcttggccaggcatggtggctcacgcctgtaatcccagcactttgggaggctaaggcaggaggaggccttaaacctaagaattcaagacaagcctggacaccatggtaagaacccatctctacaaaaaaaataaaaaaaaattagctgggtatgctgccacatgcctgtattaccagatgctctggaggctgaggtggaagaattgcttgagctcaggagttagaggctgtagtgagttgtgatcgcaccatggctctccagcctaggcaacagagaaagactctgtcccccaccaccccctcccccacaaaaaaaaaaagaaaaagaaagagaaaaaatttcttgaataaatacgttagttgaacaaccataaatagatttacaggatcagttaatgtccaccaagttgggagaccccagtggcaggagttcctagtccttagtatatgatttgagtgaagataaaaatgacacacctaacaaaatgtttcatgaaataatctaaaatttcttgtcttcattgcttacaatgacaaacccaatctaatcagataaaacttgataaagataatgcctaaagccctgtttttgggtataaaaaggtataaataagcataaatataggatggaattattagtaaatgttttgaaaaaagatgaaaggattaggaatttaggtgatagcctactcagtgtgatccaacagtatgaagtaattccaacctcctttcttgcatatttttaaactctccacaaaaactaaggagatgatcccaattattatcttcattacattaattgagtttatcatcaatatcatggaggtgatgatttgatgattatattttactatgtgctaaaaacacatctattaaacgctttttataattttaaggaatattatcagaggagagcaatgagggtagtggaattcttcacttgagtatcagggagttggtgaaggaagcaatataattatgcagaagagagctcttggcatgagccatgatttcaagaggggggaaataggaccaatgagataagttagcaggaagcatattttggctcaatgtaggggagaattttgtactaattctaacacttagacctgaatgttctgccttgggaggcaagcaagtgttcatttggctactaaacagaacagagattcatgtgtcagatgagggagttgaaccaaatgaccttctatatcacttcttatggtaagattctttgacattttgtgtgcaataacaagatatgtctctgtacaggctttcccagctatattctttagggaagttgaggataggagaacaagcactgtaaatgattacacatcctgaaatgagaagcaagggcatttgtagatatgtgcatagttgttgggataaagtgcctgtgtccaaattccagccaggactgacatgcactatctggtgaccttcgattagttatttaacatttctgtacctcagtttccatatataaaatggggatagtatagtatctacctaatagctttgttgtgacaattgagtgagttaattcactcaagcttttagaatggtacctggctcatagtgattgttagatattgttattatgattgcaactataactacaattaactattcataaaaccatcatagagtgagatggtatattttattctgcattacatgtaggcttaggtattctttggaagaaaatattatagagaaagcacgtatattggacacaggcaggctctttatgggctgcgtggtcttggacaagtcatttgacctctgcttttcttaataactgtctagttataggacttctgtaaaattaaatgagtaatagtaataaatgtcaacgtagtaataaatgtcagctcccatggaaagatagtatttcaatttccgtcctttttcaaatatcttgttgtctagagaccacagcagtgcagggttaatgtagcaacttagggcttgaagtgacctgagacatcttctagcaattgccgctcatgtaggagatgggagtgtaggttccttaagagttaagagacttgcagaaagcgacgtagcttcttcctatgagggagaagagctatatggaggagagaaagtggaagataagtaaacattcagagtacttttttgggaaaaagtgtgcagcttcggagctcttgtgcacgttttgctgagtgcgtgtttctgaatgattgtgtgtgtgtctgtatgtgagtacatatgtatatatgtatatattcatgtgtatgaatcagagtgtgtaagtgagcatgtatttgtgggtgactgattatcttgctagtgtgactttctatgacacttgctggcatgcaggccttgggttgctaattccttttcattatctaactcagtataccaagaaaagaaagaaaacagtgaaaaagagaatgcattctgctgttagctggatgctgactttcttcttctgggtctggcactttgattcctcatgacttcaactttttcctaaggaaaataaatgtgctagcctcttaccttcaccaccccactttaatgaagcttccttcaattacatctataaaacccaaggtttaattttatttgatgacactgtcttctgcagacactttgttttgcttttgaagacactaagatagcctggagctctgtgccaatttcctcactggtactggccactggggaagctgcctgagacaagggcatctgaagtgacaggagccttgaactcagttcatcagctggagacccagagcagtatcaaaactgagtttttgattatgcatatttatcctgatttctacagcttcctcatgctcacccatctccctcagatattctacaacactgaactgtattattctgagttgtacttaacacttaggaaattttaacatttgcttcattaacataactgttagaaggtgcagggggtgatgaggtttaaaaaatgagtttaagatcaagagtgtgtactttttgtttttctttatggagttacattgctgatattatttatgttcaaattattgactactttgctgcttgtataaaaaatggctgctaatttttatgtattttgatctctgtttttacggatgatgcaagaaaatgatcaagagctcaattacacttattggcataatatttgttaattgtgacactgtagaaaagaaacattcctttgaggatcaagcagagccatctcctgtcctcatgtatagaatagtactcccattagggaatgctgccaatgaaaaatttatatataactttgtgtaaaggaagtttttaagctctgaaatggagtggcatatagttgcctgtaatctctaggctgatattttactgtggcatttcttcgcttctcattctaataaaatattaacatggtaagctaattgtttctgtcagaaacaagttgttcagcataataacccttttcttcatttgataacgtatcatttaacttggtagaactgtctgaaaattatgtcatattctttcccattttcatctctactcttgctttctggttgcccattctagcaatacaagaccaagtcaagctacaaggcttttgcagcaatccctacaaacacattgcttttggaacagaaggcactagatgaaccagccaagactgaaagtgtctccaaggacaacacattagaaccaccagtggaggtccccaaagacattgttgggttctgacacagtcaaaactcctacaactcttccaagagcagctggtcgagaaaccaaatatgcaaatctctcctcaccatcttctacagtatctgagagtcagctggtatgtatcttctaagtcacagatctactgcaaattctgatctctcaagagagctttacctgagtaaaagtgaaaaaaagaatacatttactatatatatttttattcacttacttgtctaataacattttactgatattttccaaaagctccatggtggttgttttgcaggtgacaaacatacgtaaaactatacatagaccttacttgctagtaacttacatccaagtagaggcattagaagagattgtgaggtcagatgaaagatgccattagaatttagagaagagagcacactctttaaaggaagagatctaaaaagagtttaaggagaaggtcatgattgagtaggatagtttttggatttgaggaaataagaaatagatatgtcacacaggagaattagcatgcaaatggtctagatcagtgctgagcaatacaaacacaacgtgaatgacaaatgtaagccacatatgtaattttaaaacttct

SEQ ID NO: 2415 - DNA, 10339 bp, Homo sapiens
gggcgggcctcgcctcgcctagggaggatgtggcgggtataaaagccccacccaggccagccggctctgctcagcatttggggacgctctcagctctcggcgcacggcccagcttccttcaaaatgtctactgttcacgaaatcctgtgcaagctcagcttggagggtgatgtaagtatatcactttcactttatataatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgcatcttttggatttcttacagtgtccaggaagttattccagatgaagacttatacttttattttatttattaatttattcattttttgagatggagtctcactctgttgccaggctggagtgcagtggcgtgatctcggctcactgcaacctccacctcctgggttcaagcaattctcctgcctcagcctccccagtagctgggactacaggtgtgcaccactacacccagctaatttttgtatttttagttgagactgggtttcaccatgttggccaggatggttttgatctcttgacttcgtgatctgcctgccttggcctcccaaagtgctgggattacaggtgggagccaccatgcctggctcgaggacctatactttaaaaaatttcacacctggaaaatattttctctaaaaaagctaggatatttcttttaaaaaaccaagaatataatgaaattattgtaattcatctgtttcctttttttctgtggctattagggaatttagaactaaactgaattttctttcataggaaatatgtgaacctagaaattctgttgcatttgtttcttttttttacaaataaaaaatttaagctatatgtgaagttaaaattatttcaaatacttttagaatcaagtggaatataaattatgaatatgtaaaatagctaatggtactatacatcttccaggtcatcctggcagaaatggcttttacgcagactcagcactgatactggtttgtagccatatccgacagatctttcaaaatattctttgattgaaattaaaatgcaatgaatcactcaacagagggttgacagtgacttgggtcacatggtgcaagaccctctgtattgttcatggtacttgccatcaaaatgttcaaattaatggagcctgtgaaagcacaggttgtatggagtataaagcctatagagtttttttaaaatcttttttcttcttgaaacgtgtgcatgctgtttttgggaacaatacaaactgcatgttgaagtcagacaaattcaggtgctaaataatttgtttctctaatggacttagattgtatttgctatcaggttttataagagggctttttgtgtagcctctgaagttactctagtatatttcttatgtgtggagaggtggggcagaaatagaaaatgtcacatgttccccattattttaaggaaagaaaagataactttgtctcactaatttcatttcagacaagtggattttataggtaataggttcaattctcgatttaatttcatttccagagacactataaaatgacacaaaacttttccccctcactgttgtttttggaacaagacgacatatctcctggtaaatgcagtcatacatgatatggctcaatgcctggactgcctgccttgtaaataaccgatggcactcttaataaatgggaaaatgtttttccttagatttcatccacattttatagctaccatagcaaacacactgagtatttcaaaatagcactttgcctttttcctgaatgtgtgctccatgtcatcaagttcatcttactggaaagtttaagtggtgaaattagatggaacatactttgataatgcattgcatgtcaggttataaatatgaactggatttaatatttggccaagatagtcctcacaagtgcgtttggaaacatttgtcaaatgctgaacttagatttctggcctctcctgggagtcatctagatataggaaggcatcttagatgctcacctatacagtctcagtgctaataaaatggaatggcgtgggtgctgggtggtttataatgtgatgcctgtgggtggagaagtaactcacggatcttggccttttcactcttcacagaaactgcgccaaggccaagtcatcacattatacgggcattatgtgctgggggggttggggtgggttgcaggatgggagccttgatgatgaggatgggcagtgatgctgcctccaccagccatcagccaaccacaaccacaatgtacatcctctttgtctgcccttagctttgggactgggtagcagggagagggaaaactataagagcatttcaaagaaggagggaagttaataccttgaaaggagaactgacgtagaagcactccattgtccttacctcaatctggaatgggagattcccatctgtcagatcaggaaggataatgagctttgaaaagcactgaaaggctgggcgtgagccaccacgcctgtaatcccagcactttgggaggccaagatgggaggatcactagagcccaggagttcaagagcagcctgggcaacacggcgaaatcctgtctctacaaaaaatatgaaaaaattagcccggtgtggtggcaggtgcctgtaatcccagatactcaggaggctgatgtgggaggatcatctgagcccaggaggttgaggctgcactgagccatgatcacaccattgcattccagcatgggcaacagagtgagaccctacctaagaaaagaaagaaaagaaaagaaaagcattgggaaaggaagagggtatggtttagaaggcaataagaaatcttaggaagagtggagggtggtaggcacaagggatggtattaataaaggcagagggaaggatacagaggagagggggggaaacacaaggaggatgtgggccgtctggccagaccaccttggtgccacagtggtgaccaaagtaaagaggtgggagaagctgcttccctcatttatctgaattgtaagctcagcaacactggcccagtagaaattcatgtacctgtagcagaaacttagctaaacacccttgtccttgaggcatttccacattttcagcttatttcgaattgttgccagcccagtttaatggtcttcagagccatcctgagtaaatgctggcttcaggtctccagctttgcattgtctacttttgatctctcactaaaagtaagatgagaagttgaaattgagacagcatattctaaactagctgagcctttgaagaattcttattagaaaaaatgaaattgcttgcgtgaagtgtgatggtgtgttaatacctacctagttacctagtatgagaatgatctgaattgttaaaagaaacaataggaaaacatattaggcattgttatttcaacaagaggattttaaatgtgtgtcatttgagtatgtttatcttttaacctcagcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggtaaatgcatgtgagatgtcatctctgtcaaatctgctattaattttgtgaattacagctttctgagtgtaatttggtgattttcagttttgttgaattctcatttggaaccattttttaaaaatgaactgaagttatatgtctcaggatttgtaccaaaaatatttcaattacttgttttaagactgtaaagaaatttcatgatgctgagaagtcagttaccagctgctactactcagcacctgggcaattggaataccatttgggaaaactacttccttgattacacttcctcctttaaaaagatatgttgtgatattaaggcaagaaaaaaaaactcatagcttttgttaagtgaagcttgcaaattctgcccatcctttcgtgggtgtttcttcctcccatactctctctgtcagtaccatttgtttcaaattcaggcagaatcagaacatcatagtgcatataaggggtaattctggatgaagaatcgtacctgaatcgtacctgtgagaaagtaactgtgaagtctcaatgcacgttatcttttatgtttttcttttgtaaagttcttttgaacctggaattttaggttaaattaagtaaaaactgtagattggaaacctcctgaactttgtgcatacttaaaatatcaagttttttgttttgttttgttttgttttttgagatggatttcgctcttgttgcccaggctggagtgcaatggcgcgatctcagttcactgcaacctctgcctcccgggttcaagagattctcctgcctcagcatcccgagtagctgggattacaggcatgcgccactacgcccagctaattttgtatttttagtagagacgggatttctccatgttggtcaggctggtctcaaactcccgacctcaggtgatctgcccaccttggcctcccaaagtgctaggattacaggcgtgagccaccgcgcctggccaacatcaagttttatataaatgcaatagatgcacacacattaatgtatgttgtactgcaacacatttggacccttttcttagtgtgggtctgcagcatttgaacagtccgacactgccctctgctgatatacatgggtaaagtctgcgctgtagatgagggaaaccattggtcttgattttttattccgagtctgttttctctgatgccactgttcctgaattatgaacagtctgagctgtaagcctgtcaccagagctaatgtcacagttcagttgtcatccttttcccagagaacacaagagtgagggtgcttcggacactgggcatctccaaagcctggaatttgatagctcagggctgctgtaagatttgttgttaagtctctttcttcctttagttcttcagcttagcccaagctgtgctcagtttattttagcggacttgtctgagtttcctaagtagactgtactgcagaaaagacgtcattaagaatgataaaatgtcgacaacatttcatgatcctggttgataaaaatagcgctcctgaaaaccgagtctgtggacctttggaggcagggatgagtcagcctctcctaggtttcttctgaccatcaacacttcagatcagtttgtcttattttcatcaagaatctatttagttgtgattcgagtggctttactggtatctattactaggtattagggacttgaaacagacctttttgagctgtcagtcactgttgtaatctatgtaattgggcccaatggaaggtgctttaactgctgaagctttgaccctgtgccagctcttccattagctatcacagttgaatacccgtccaaaatccataaagcttgaagtgacattaactgaactatgcttaaaaaaaaatctgttttgacttctggcagtaccggtggcagtatctgccatatgttacagtagaatttgcccttgtgataggaattgtggacagtctgtggagagtttgggccgggctttggaaattgccaaggtcacctttgaatgtagacataaaaacactattggaattctcagatattaccactggtatatcagtgatggaaggaaacacatcttacattattctgcctgtcttgcaattctacaatgtcaggatataacatttctcccactgtgtgttatttttagactatatttctatcatccttgagattgaacaactgcctctcaaaatattcaaagatactcggtagtcatttaataacatttgtgtagaatgctgtatggaccttttgctaacaaggggagaatttttggctttgctggaacctctacaaatcatgattaaaaactcagaaagaagagccattggctcaaaggttagatgaagaataaaattcaaaattaaccattaacctgaggcttagcttatattatacaaactactttttcggggcatataaacgctaataagtttaattaatagctgacacgcttttcatgtgggtaagtttcttattgtattaacaccttataattgatttacattttaaacagttgtaattctacttagttcaaagtgatagttccatattcggaaagacaagtattaaagaatcctgattattaaatcttgactttgatcatgaagccagctttgaaatacatgtttcattgagtcctttcaagctatctgacatgctcaaaagtgtatatattaaatttgaatacatcacccatcaaattcttattccttaataaagtgttggtgtctaggtttatttggcacttcattatttctttttgcttccctaaagtgcctgaagagtgcataattatcaagcaaaaatggaaggacaagaatgaaatttttaacattaacccaattttacatttcaaagagtgcagctaaaaattttttcttaactatacctttgcctggtaaaaagacttactctaacaatgctggctgcaagtgacaacataaaatttctgtattcctttattttagcgagaattgtttaacaaagaaatttctaatctgttaaaatagtgagtggttattgtagaaagtgaaaaataataataagaaaaagttactttatctacccacagcaaaaggcaattgccagttttagtattttggcatattctattgctgcctcttcctattcactacttttttttttttttgagatggggtcttactctgtcgtccaggctggagtgcagtggcgcgatctcggctcactgcaagctccacctcccaggttcacgccattctcctgcctcagcctcccagggtagctgggactacaggcgcccgctaccatgcccagctaattttttgtatttttagtagagatggggtttcactgtgttagccagaatggtcttgatctcttgacctcgtgatctgcctgccttggcctcccaaagtgctgggattacaggcgtgagccactgtgcccagcccctattcactacttaaaaaaaaaaaccatattaacagttgaactccaacatgccagttccaccatcttgtgctctggtgaagcattttttaaaggaatagaaaatgccattactttgtgctaaggggtaggagtatagattcttcagaaggaatgtagaaagcaggatgctaacagacccaatccatgtttgcaatttacttgatggagatcagagaagtaggctaatggtggggaagcatttccctgctgatgttcgtgcttcctggttcacaggggctgggaaccgacgaggactctctcattgagatcatctgctccagaaccaaccaggagctgcaggaaattaacagagtctacaaggaaagtgagtagcttgatttctgtgattcatcctctcagcccaatttatgtgactctatcatggccactggggttagggttcgggctaagatgcctgcattagtgatgtgcagaagtgcctgccaccttgactatgcaggcaaggttggctgtggtccaagtttctctccttcacctcctcattgcctgcattttgattattacattccactagaacttctgtgttagaagaagggtagacaggagggaaaggagagaaaacaaaacttgtttttaaacaagatcggatgaggagaagtagcaagtattatatatggattccacttattgggcgctgttcagtgtctgctcaagaggttgccaactctggactgtggataattgaagaattacagcaagagacccctgtggactggtgcacacttagcagtatagaaggctatgaggggaataaacaatgcaacttacatcgctactgcatttcttttttgttttactttttaaagttattatcatagttttacatattttgggggtacatgtgatattttggtacatgtattatatataatatgtaattatcaagtcagggtaattgagatatccatcacctcacacatttatctttttttttgtatcaggaacattacagttcttctctagctactgtatttcaatatagatgctattttgaatattgaaatatactttcattcaaaagcattgtttaattcttagtagtttttgccgctgtgcattttctcagtggacagtaaagcacaattgtgtgtgtgtgtgtgcgtgtgtagacctccaatttttttgatgttcagaacaagtactcacagtcaggagggctgggagccagtatttaaactacacgagaggtcaccaatcaacggtgagcctgaggatccctgatttgatctagccctgctgccccctgttatggataataactctggctctgatttcatgagggcgaaaatcattctagtgaatccttcctctgtttggggttaaggagaatggatatgtccagctgacgtagctgttctgcttctcagagtcttagtgggaaatggggagattggggtggatggttggctacacaggcagaaagcataaaaccagatgtattttcctccaagtgtacaagactgatctggagaaggacattatttcggacacatctggtgacttccgcaagctgatggttgccctggcaaaggttggtttcccagtttctttctttgcccttgcttcctcccaaggcaagtcacatacctcattttatacttggagtgaattaactaaatcccctgtgcctgcatcagaaattcagctgcatttttgaaagtgggtttgcactgtcactgcagagttgtcaattttgtataataggatttcttatcctgcaaaacctcatggacaagtggactttgggagccagagaagggatgggcggctctcaagtcctggcctggatttatgtgccagagccttggccgtgtgacttagggaaggtcactttgcctctatctgtggtcatgcaggacccagtgggaagtgaccttctggtttctttttcactgcgtttacttctcatggaagaatttgcccatatagtcctttgtctggggtggagttgtctttgtggagctgattgctaatattaacacattaacatggaggaaggggcatttcccctgtgaatccctagttctggccagcgtgtagcttaatacttatgtgccaggggagggacgagagaccctgggaaccctgatgacaaatgacagatagtgcgtccggcccactcacatctccattactgcaacaactcctatgccattctccctcgctctcctctcttcgctaccacctgccccatgtaccaccatccacggatctctgtgaaatacactttcaccattttactcctctgttcaaaccccatttctgctgcatcaaatttaaactcctaactgctgtgaaaggtcctctaaaccctccctgcatcttctttgctcatctttcccgctcagctctgctctgacagggcagctccttacttacctgagagcgtgctgtgccatcccttgtgtgccagctggctctcccgctctgcttggctagctgcatctgactgacccttgaagtttcagcttaagcccaggcccatcgttcacactctttgctgactctgccctctgagagttcttcctccgcccgcattttgtgtctttctagtgctgtgggttcccgggctgctttacatttgtttccacatattcctccatctgcattgcaagctctctgtgagaaagagctaaatctcatcagctttttgtgggggatggggacagggattctgtaaggtgtgtaggccaggactgggtatcaagggggggattgttgatggcaaggcacagcccccacttccttgctcaatgattttaccactccttggctggtctag

SEQ ID NO: 2416 - DNA, 1840 bp, Homo sapiens
ggtactaaagtaccctgagcgattctcttgatcttcagccctacatctgttgttcaagtgcttaggttaataacaaaatgtaaaatacctaccatggtttcacatagttatgtgtgtctgatgtaggggccataaccgtgtgtgtgtgccttgagaaaacttaagatctacttcttggcaaattttaaatatataatacattgttagcaactatagtcaccatgctataccttaggtttccagaacttactcgtaactacaagtttgcatcctttgaccaatgtctttccaatttctcctacctccagcccctggttaccacctttccattttgtttctgtgagttcagcttttatatcaaaacatcatgctgcacaccttgagtatatacaatttgcatttgtgaattatacctcaaagctgaaaaaagaccccaaaaaacccggcatggttcctaaccaaaggagacacttgtaaggctttgtatcctcctacagtttgcattttgtatcttctgaaattctctcttcccctagaattcatactgataaagcttatacgcatttcaaaatatatgtttgaggctcctccgcgcctgcctggcaaatgactgtgtttctatagaaatgaagagcttagacgtgcctggatggctccagataacacccagctgagccttacggctcctaatgggtcccatcctccactgaaatgagatcagaacaacccatggggcctgacttagtactggccagtagaactggacaatctgttgatgggtgtattctcaaactggtactgttctgttgggtagcccctagccactggtagcaagtgccactgaggaattagaccttaaccttgacttcatgttaattagtcagaattgcagtggccccttttgttggacagcacaggaccagaggaagtggatttgcactttgcatctgctgataggaactgaaaaactgccatgcattgcctattgacctatccatgtaatttgtcatacttggatagcagaggaaaaatctaaaatactgtgtttttcaaaagaaatggaagcttattgtattaggggaaaatttcctggggattccttatttctttcacatatacacacacccagtgcaagcatgcacacacacacactcgcacacacactggatacagttttgtaggttctttgtgtcccgaaaacataaaatgttcatttctgcattttgaattatggatttgaagatccatgctgtgcaatctcagcatcactaataacgcttgagttgaatgctccaagctcacttcacaaggcagctctcgcttagggagcggtttgcatggaggtgctttgaattccgggacagagtggtttggggaactagggggattgcagtctctgttgacaacgtgtcctttggctgcttggttgttctttcctacgtttgtgtttcggtttaaggtcatggtgttgttctgggagacattagcttaaatagcgttttgtttgtttttgctttcgacgtgtttaaacgtatggatggaaactaaagttgtcctctgggaaccagggctgtgatgtgcatgattagatctttctgtgttgatggcttgtgtgagatcttgtgattacccagcgaactgtgccaaagtttcattatttattcattccttccaatgattttggagtacctgctgtggctactaaggatatcatgtattttcctcccaaatgtctgcaactcataaacctctgacagtttagaatgtgtgtggagccgggcgggatgatcataagaagagatggtgcgcttgtcacctgtacaagccacttagattccca

SEQ ID NO: 2417 - DNA, 1109 bp, Homo sapiens
aggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaaggtgcagaaacataaagaagggaagtgattttctcaaggtctac

SEQ ID NO: 2418 - DNA, 2291 bp, Homo sapiens
gccacttcagtgcttgtgagttgatgtatgtgtcaagagaactgagccaggtcccggctgtgccgcaaatcattcacgtggtgcagatggacacacgttctgttagtcaaataagcatattagattcaatgactatgaaactctccttccaggtcaaatagcctgttatttgtgcattccagtatgatcattgccatttatttaaagtatttctacctatacagatattagttactagcgactcaagtacacgttagaattaattgtttaaaagagcaaataaacctctcaccgcaatggcaattaaagacacccagtcctgctgtgtgcttcctccatttgcttctagtggcagtttcgtgtgcatttttggtgatgatgctccacggaacatctgcagatgtgctgtcaatttggacagctctgactaccgagtgaatgggaagtactaacgagaactgtctgcttgggaactccatgaagttcgtggcttttgtgattgaaatagcatcaataaaaggttgacactgtggaacaacacaagcctgcatggacctggttatctctgacctcgcaccactcatgagaccatacctgagccctactccactttggcagaactgttgcatggcctctcttcatataatacctctccgtacaccgtacaccgcagctcaaagaaaggatatatgctccctgtgaagactaatggaactgtccctcctgatcctcctacagacttcctctggcctaatgggtgcaccattgcattatatctgccatctatacacacatatacctttcaaccctgcactctctgagatgactggactcatgcctaaataactgatgctgtccctagtgtaaggtaagcactcaatagtttctcaggaaatgaatatgataaatattttggctgtttagaggctttccttcacttcattttctgtgtcctcttatttaaaaagaagtgctcactagaggttacctgaagacatatctgatccttgaaacctgcagtagtctaacacagaggccaagatcacaggtcttcataaaagtaatactttcctcatgacaatgaagtgccacagggccaactcaaaaattgagactgagcctgggaggccatgtgggttctcggctttgtgcgggcaggaattcgacagccagccaacagagtgaagagaaagcaagtttactaagaaagtaaaggaataacagggtggctatgccataggcagagcagccctgagtgctgctggttggctttttctatggttatttcttgattatatgctaaacaaggggtggattattcatgagttttgggggaatgggaggacagttatgggaactaatgtttcctccccctttcagactatatagggtaattcttgatgctaccatcgcatttgtaaattgccatggcattggtaggagtttctttgagcaagttaacgtattataattagcatataatgagcagtgaggacaaccagaggttgcttttgtggccatcttggttttggtgggttttggctggcttctttactgcatcctgttttatcaggttttttttgtttttttggtttgtttgttttttgagctaggtcttgtaaaacagtcctgccaacttcctatctcagaatcacatgtctctcattgtcctagctcagggtgataacacgggaggcatgccaggttacttgtcacccaatattcattctcctgttctgagtcagaaatgaatgaggggcttggctgtgatgttctcctctggacagagccctcacttcccagctgacttgaggctggtgtggccttgtgtccaggtatgtggccaacagagatgtaagtagaaatcttaccaattcttccaggaagtcttttcaaagagagactggacgaccttctctctttctctctccatcctgctgcttgggaaagggatgtgacatctggagtcctggcagccaccttggagcacaagattaagagccccagctaaggcaggcagagtggctggcggaagggagcaagggcccctggggaacttactgcttaccctgggcttctttaaagtggaaaaaaaaaaaaaaaagaaattccacttcctatcagctcttttattctggatgtctcagccaaacacacccaaacccaatactgacataagttatttgtcagtattgacaaatatttgtaaagtcttcacttttgaaattaaatatattcaccgtgctgtgtaaagtataatatgaatgcttttttaaaagttatttgtttac

SEQ ID NO: 2419 - DNA, 661 bp, Homo sapiens
aaagttgggaagactacactgtgaggtcttaacaatgatgggtattggattagatggggggaggcttttatttcctacttaattatagaaccaagggattgtgggtaatttttacttttttgtgtttttcaaataaaaaaataaataaaaacattttgatggtgatggtgcaggaatagtagtgatttgctccaccatggtaaacatagcttgatctatgaatgtggttgttgacagaaaatcttggaagaagaacacttctttgatgacgttgtcagagagaaatggatgttctcctaaatgggaagccttaattctgtgtgtaatttataaagccatggagaagaggagacagagtgtgcaagggaatgaagaaaaggaacaagactattttcaaatcacccatggcactactagaaatgtatttcagcaaaaggactggctgattttatgattcctgtgtccaccacagccctctaatttttacataggtaccccacatctctctagatttcaggaagactattatccttcgactttagctttctgatgggttcacaaaaagccattagtgtgctgttggtccagcttttttctgttgcaaatatgagagctacagttctgagatgaaaccacagatgaggaaattaaggagtcaaag

SEQ ID NO: 2420 - DNA, 1119 bp, Homo sapiens
ggccaccacgcaccctgggcgctgcctgcgccttggcccggcttcaggctcaggaaaataataataacgattttaaaactatgttgagcgagacacattttactcccggaatgataatgagaaggctcggcgtagggaggggaagaaggagccccccacttatataacgacttgaagttatatcacttttgcttggggagattccgggatttccgcccgcgccaggtctgaggctggttaaagatcttcaaacttttttcccttaagagccaataaacaaacagacgccccaggggccgacttaaactctggtagagcccgagttcgctggaattctcagattcgaagaaatgcacacgcctgcggtgctcgcagagaagtccctcggaagctaggcgggtcgctttcgcaactgggactccaatgttcccagtgggagcggagctctcaccgcggcagcccccaggttcccctaggcgccttagagcaaaggtggcgggggatcgcgctgcccttcgcccgccggctcggaaccatgaacttgtattccgggcgccgcgctcctgccacagtgctcggctaaagagctctaaggaattcgggatctgggtacacttcgggatctcaggcggcaacctgtctgcgccgcgcattcctgcccagatgtaccttgtttccccctgggctggcctgtggactcttgggcagctcccgggcggggacgaggggatgcggtctgggggctagtttagaagcttcgagcgcagcgagaaaacaaagggagcctggggctgggaggctctgcggagtccccgcccgccctgcagattagcaggcgcgtcgcgtcggggcttcccgggcagctctgctctggggaattagaacgaactctagcggccgtttgcaactcggctgtgggcgcgagggcatcaacaggtggccgtgtgcagcggagaggccaatggcgaggacccggactgggggtcctgctgccatgctgtgagaagccgaagtttcatggagaggccacatggagtgaaaacaaaggtgatagggacaatagctccacctgagatcctgattaatacacagactttagccatcttggatgctccagcc

SEQ ID NO: 2421 - DNA, 5304 bp, Homo sapiens
gcccagggtagactgtatttccaggtccctcagatgcagtgcaagaggggcatatgcctcggagactatgttccccaagcagctttgtgagccttgggagaccagctcaggatgaagccttgtcttctgttatccattgctgcctatctgtctattgtgcagatgaggaaactgaagccctatcgcaaggtgatggctctgttgaattctagagactgcaaagatgaagaaactaagaaactgtggcacaaattattaactatactgcccaaggtcatacactggaaatgggtggtgaagaaatgtgaagaataaaaagttcagaagccatttgtattcaaatagaatgcaattaaaaagtcccaggcaagcattataagctcataaacaagagagctagcaagaagaaaaaaatcaagaagcaaatcttgaagcaagttataacctgccagatgtgacaaaggtgatagaaaatcagaaaagaacaaaaaaagttatgaccgttaattagcatatggaaaaagataatcagaggcccccaaggaagctggattattaaaaatgcgacctccatttcaacaaagaaattccaggcagtgacacggttttgaatttataatgaggattgatgaatagaagagaattggatatttcaagaaacaaagaaatacatgagttgaagctacagttaacaaaaaaaaggtactggaggaaaagttttctaccaaagacagaatatatcactctactcttatactcttctttgtgtttctacaaccacttcgattcttcttttctgtattgtcagatccctgctaaatgtttctccagaaggtgctggttttttctggtcatcggggcactgccatcttctgtaatcgcacctcttcgaaaaatatactatttttaccaagagtaaaaatagtattcacttatccatggggaatacattccaagatccccattgaatgcctgaaactgtagatagtgcagaaccctatatataccatgtttttttcctatacatatatacctatgatgatgtttaatttataatgggcatagtaagagattaacaacaataactaaaaataaaataggataattataataatatactataatatgtgactatagtctctctctcaaaatgtcttactgtatgtaatattttcagaatgtggttgaccacaggtaactgaaaccaaagaaggtgaaacgaaggatgaagggtgctactgtacaagcaaagaaatcccctatggatattcattactgagatacttctgactgatctcatccatagtttgcaattatcttgatcgaggtctaatgattactgttaccataacactgaaacaaggctataaagcaaagtatcctttgaccaaaattgatcaaataaacatcagcaatacaaactgttcctaatgataaaaatagttactatttattgagtacctcgtataggcagacttagcacccctaatgtctgatttaattcttacaacaaacctgtgagttttgtatgatgatctttattttaaagatggggaaactgcagttcagaggggtttgataacttactcaagatcttctagctgataagggcagaactggacctgacccaagttcttctcacaccaaatcaaacacaggtaacatgacacaatgttcctataatttgtgagtccctttacagctttaagtgctttcatatgagcaagggcaacttccaaaatctgaagacactttgatcaaagttgctatggcaagagattcagaaaacaaagagagtaaaaatcttaagatttagattctaaagttggtgaataaaatgaaagtagacaaaattaattcttagcgcttgtgagagattaagcacagtctgccaatctctttgattacaactaaaaactagacagaatatataaagcaactatctgagaactttgaagagtaatagtaggcatattgaggagggaaataaaagcttgaagatcatgactgatacaggagcaagtttcccattattttaattttaatttttattttaaaaaagtagagatgagggtctcactttgttaccgaagctgttttcgaacttcaagcaatcctcccacctcaacatcccaaagtgctgggatttcaggcatgagccaccatgcccaccgcccacccctcctgctcccccacctttaaaaaaactctgccatatcttccggtttatactcaagagcagcctgaatgctggaagtctgcagcagttgtgaatagaaaaagctccaagaaaaacgcttactttttggacagaggaaataaagcaggaagtgggtttcttacaggacaaattgttcagtagaaatacctcctctcttcattttctctctttttattctctgagtcctgctttgaggcaagccccagtcatgaagctgacttctgcagtagcggccgaggccgtaaaggcacctaactctctgaaagactttttctccgatcagtggaccctgtggtcttgttgccctgcccttaaggtgaactcagtccttgatgtgtgtaacagtgcagggaggataaaaacccagtttttaagttatagtactgggaaaagggactctgggttctggaaagtgtgggggaaatatcacagaaagaaaggaattgacaaagaaatcccttgaatctgtgtatcaaatcttaaactcaccactgagttgcacatgcataaaacagatctgaagcagcacagcaaaggcttggagaactgaactacgtgtagaatgcctcctatatcctatacctgggtggtgctcccatggtgcagacccaaatatcaaagcaaatgttttgaaaaataaaaactgacattgaaacagaaacatgcaaaaggtggatgagaacttgcactccaacctaatcagattgattacaaaaataaaaatagacattttccagagcatttaaactagagtcagagactcaaaacaaaatttaaaatgtctaggatataatctgaaattactcaacatacaaagaaccagaaaaatctcagtaattctcacaagaaagtaagaatcaacagattgcaaccccagatgatccagatgttggaattatcagacaaagactttaaagcaattataatagctatgttccatgaagtaagggcacatactcttgaaatgaagggaaagatacaagttttcagcaaataagcaaaaactaaaagaaataaccaaatgaggattttagacctcaaattacaacaactgaaaaaaaagttccctggaattattgaatagcggaatggagataccagaggagatgagaaacgtgaaaatagataaataaaaattatccaaggaaaattttaaaacattttgaacataccaaaatttgtgggatgcaaccaaggcaatgcttataggaaaatatggaacattaaatgctcatattagacaagaaggtctgaaatcaaaatatagtattataccttaagaagctagaaagagttaaacccaaagtatgtagaaagaaggaagcaataaagagcagaaatcaatgaaatttaaaacagaaaaataatggaaaaaataatcaaaaccgaaagcttgttcattgaaaagaccagtaatatccggaatgaggtgagagagagagagaggaaaaaaaaaaaaacacaagaattacaggtatcagaaacaaaaaaggagatatctcaatagatgccacagacattaaaaatacaacaagggaatacaataaacaactatgctgataaatttaagactttagattaaatagaccaattatttgaaatacacaagttgctaaagtttatacaaaaagaaatggaaaacttgagtacttttatccgtatccaagaaacagaatttatagttaaaaaccttccagcagggagaatttcaaacctaagtgtctttacttgtgagttctaccaaatacataaggaggaaataatgccagttttacatgatctctactcatcttacaagaccaacataacttgcatgcaaaattagggaaatagaatagaagaataaaaagaaggaggaagaaaaggaagaggagtgtttatatgaaacataaagtaattagaatagctaaaataattttttaaagagaagaaaaatgttggaggatgcaaaatacctgattttaagacttcctgtaaagccacagtagtcaagagagtatgatattggtgaaagaatagaaaaatacatcaatggaacatttcaataaccctcataaacatagcaacacaggcacaaaaacctccagtaaaatattaatggtgcaaatccagctatatattaaaagtatattactaccaaagggaagagggttatcccagaaatgtaaggctggttcaacattctaaaatcaatcaatgtaacttaccttattatgttttattttcagaaatcattcattagtttgtttgataaatatttttgagcacctactgtatgtctggtatagttgtaggtccttgggaatcatcagtaaaatgcattaatacatgactttaattctgcagcatttagaaaaaaaactctctgatgtttgatgggtttttaaaatatatatacatatatttttattatactttaagttctagggtacatgtgcataatgtgtaggtttgttacgtatgtatatatgtgccatgtcggtgtgctacacccattgactcatcatttacattaggtatatctccgaatgccatctctcccctctaccccccctacaacaggccctgatgtgcgatgttccccttcctgtgtccaagtgttctcattgttcaattcccacctatgagtgagaacatgtggtgtctggttttttgtccttgtgatagtttgctgagaatgatggttttcagcttcatccatgtccctacaaaggacatgaactcatccttttttacgcctgcatagtattccatggtgtatatgtgccacattttcttaatccagtctatcattgtttgacatttgggttggttccaagtctttgctattgttagtagtgccacaataaacatacgtgtgcatgtgtcttcatagcagcatgatttattttcctttgggtatatacccagtaatgggaaggctgggtcaaatggtatttctagttctagatccctgagggattgccacactgacttccacagtggttgaactagtttacagtcccaccaacagtgtaaaagtgttcctatttctccatatcctctctagcacctgttgtttcctgactttttaatgattgcca

SEQ ID NO: 2422 - DNA, 6651 bp, Homo sapiens
ctccgccgagcctccccgcccgcgtcgtggccaatcggaggccaccaagctgcggctgtagccggccggatccgcggcagccgcccgcccccgccccgccgaagcgccccgtattttgctgcagcccgcggggggtcgccggagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctggagctcgcaccttcagctcccacccttgaggatgtactggaacagcccaagtttttgtgttcttgttttgttttcttttgtcccctctgggagtttgagagtgcatgtttgttattttatttgaaatctcccgttttctatttctattactacctgttagtggtactgttcacatttggggccaacagtttcagggtacttttaccctctcctaccacccctaacaacaatttttaaaaaagagagaaactaaaagccggaacttgagaaaataggattatataaaagataaaatgactgatacagaattctcaccacgtaaaggatttctgctggcttcctttaaggcatgaacttcaagtgcaacacagtgagagactttacaagtttgagtcacaagcatttgtggaatggagcgggggatggggagcagtttttgttttttctaattctggtgaggtaataaattttccggaaccttttttaagaaaggtttacaagtaaatagaaatatccgttttatgtaagcttttcaacacttgggagatcggtgaacttcattgcagttaatgaatattttctgcctttattgcttgcttttctgctttgggtgactgaaatattaactttatttgagtttcaagataccgatcatttaagaatctgatgatgaacctttaaaaaccagctactaatttcttgacataactgatacagcttttaataatgtactgttgctggctaggcttttaaaaatttaatattcatagggaggcttattcaattttaattaaaacataatattgtaagttttttatgaaacaaaatttttcctggattttctttcttttcaaaagaataagaaaggttatgttaattaaatttaaaagatgagatgaaacacttaatatagtaatcagaagtgcttgttcttaccctttctcttctttttttgctagatattattgtcacactattgctagtccgcctaaaagttatctttgcaatagagtatttataaattatgctttctgggagtcatgcaaaataatagtaaaaattcagttgagatatggggatatgtttgttgtattccagagtgagatgtagagatctcatctccatggctaagatttaagcttcgaccctcgtcgtggggtttcgactgtatcctcatcactcctagcagtacccattgatgtttattgccattctgattaatttaaaggtggaacaaatttcaacatgaataactctatttcttgttagtagtatttacttgaagctttaaacatgtcctttataaattaagcacttatgatttcaaaatctcctttggaatggctgtcagtcaaggaattctctgattccaacagtttttgatcctttaagtaagcacttgcagcatgttttaaaagtccaatttgcatgcctctcactcttcagtggttgtgaattgttttagcatcttgcctcactttaagttgatcacctggtcagccaaatcttgctaataataaataataggcctctgattacaagaaggaatagtctagtctaaaatcatgctgttggagactttgtgcatccatttgatgttaatgaaagtagatctggtgttgactatgatatccaaacacagctttacctcagtaataccatacctaagattagctaacggggccattcactgtcctgggcaactgatgaccaaactcgcagatttttagcccctgctcaaagcattacttgtctgaagactggttttccatcagcctgtagaactccagggatgtaggggattgtcagtgacccagagaaacaaccaggtgttattaggggttggatggatggagacaagaaaaaaatatagaataatataaaacatgactgcattcacacatcaaaaatcaacctaatccttcatttctgacctatggagtgatgcctgttgactataagaggtctgcaaaccgttatggaaacctgattaaatgatgtgctctgaacacatggcccgtttttatatatatgtagaggtcacgatgattcatttctaagcattcatttttatatatgtgtagtttttatatgtgtgtagagatcatgatttgtttctaagcattcatttcgaaaatcgtaataatttttgttctggtgtgttttgtcaggcaggagatgctaaatgtacaaattcaccatgtgggtgtttgtgtacaagggttcttgctttggacataaatgctcagcagtagtagtctaatctagagcctcctctcccccacctccccttccctaccccctatagatacacaccgcaaagacaggccctacacttgtctttgtctctgacacctagcgcagtgtccttcccaatgttgaatgaagacccccttctccactcttcctcctctccccatcttcagagcaaactaggattgtccctctcccttagaaagtacccctcaaattacattttctccataattagctttagtgtacattaaagctgactttccctgggtaatatccctttcatagagtcatagaatgttctaaatgaaacattaaagatggtctctgcaaccccttcattttacagatgggacaccctgagacttaaaaaggtacacaaggccaccagctggaaagtagggaatgcagaatgggacccaggtccccttactcccactcttacctatgctctctatcttattctgggaagttcctttaacattgaaaaattcaactatatgggatgaaagggagatttttctttttaaagaagaaaatataatgatgctagggattagtctactatttttctcaagttttttgttcttcaaagtatgtgtgaaattgaggacataactcttcactgctctcagttttcatatgcttttcttagtgtgattatcttgtgttatttattatgattttggcatttaaagatccatatatttgatacaacctggctgctaaacacaagatagccattcatctggtgctcagagaagtagtgatctgatccaatattagaagaaaaacctggttattttaaaaaaatctactcttgtttgaagatattatttacctattgtttttcagtatttgaaaatcaaaatcaacattttcatggaaaatataaccaaagaagtaacttgaagtatgtatggtcacataagtgagttataaagttgccagatgagcaactcaacagaggcgagtaattcataagcaggccctgaattacaaggaaccccaccaaacaaacaaacagaaaaagaatcccattctgactctggaatgtagaggggtatagtataataaacagatatggctataaattcaagtagacctagctctatgaccttgagtaaatttcttaacatgtctaaggctcttttatctcgaaaatgcagtatttctttataaagtctgatgggaacacaatagagcacagtagggccttagcattttatctatagtgtattaggtatgctgatttccacagaggattcagagcacagttacttaagaatctgagggaacaccctttcacctctcccagttgctgtctgcaattaaaaaaagtgcttttaatcaaaattttatttgggaggttcaaattttacaaaacaacacaaaacctctaatgtaaaaaagcaatggctaagtaaataatctacagactggtaaaagaaataaaaatttggtggctttgtaatgtgcagaaaaataagtctagacaaagtattcacaggaaacaatataatcagtattaatgtattgatttggtgtaggagaatgaattcatatttgaattaactcataaattgataataccgagaccagggctaaaactccattttgcttaggacctttcctggcttttatggtttcttgaatgctttctgcctgtgtgctcccagagtcgggtttgcatagttgatttcatgagtcttgtttaaagatcagctatatttgagaaaataagatttccatgatatccaagaaatctaccttctgcaccagaagcatggatacttacagcggaataccagcactttggatcacttaaaatacagaaagcctatttcacaagataaacaaatcttgagaaaataaaacaaatcatgctgaagactttggtaactcttggtgccaaacttttgccttcatgtccttttaaaagcaacgatctgtcttcaggaaagttctgaaacacaactgtcagtatttagaggatagcaaaacatatttactatctgaacttatatttgattgtgccctttcctccagtgaaaattgaggcaatggataaagtattggcttgggttcaggagaccagttttctcttcccaggtctatggctgactgaataatcttacgtgtgacacttaatttctctaaatgttttctaatccatagaacagaaataatgccactattctcataagaatgctgagaggactaagaaaacaatgtcagtaaaatccacttagttcttcatagagaggttctacataagtacatgttattctttaaggctgtggattcaactataagaggaatgattggtgtctaatgttaagtcacattttaatgatgtataatcaacaagccaagtgcttattaaatccttttcttattcataaattttaaaaataagttatctttctcattacaaaggcaacattcacagatatttgagaaaattatattgttaaatgcatcataaacattcatagattatgcttacccatccttatattccagtaccagctgggcagatatggtctgagttttccttttaaacagggaatgtaaaatatcaacaatattcctatttattacagaatttacaatgtatgtcactctgacccattttttacatagtaactaaaaagagctgagtgattatcacagataagcatgatctctgggaggtctattattttgactcatccttgagaaaggtttttaaagacctgtctgcaagagatggggatagtctcatttgtaaagtatttactagagccaataataaaagtgcatttgcattccaagaccagtttatccaagccatgtgaaatttccaagtcttgcaggccaggacacaggctgtctcaaattgagggaagagggctttgaggagcctgctggtcagtgctgtgagggaaaggaggtgagagacagggataaaggtcacaagtggacatcaggaaggactaaagcacttgaggtttgtattctgtcagcagaaggggctcaggatacctatggtcaaacgataggatctggggaaggtcataatcgtagcaattgctcaataaatacttgcccagatttaggagtgagtcatacaggaaaataggacatggatttggacaggagggtggggacaagtctttcggtatccagaactgataggaagctccacacaaagggagtacctgatatgtaacagttcatccaggccagttcaccctgtactgtccctagatttgcacagttcttgatgagggagagcagcttctcatgagatgcttgctggggatgtgtggggttatcctcagttctaaaattgctacttcaacaaatgtgaaatacctatttatacttctcaacttgtttttataaggatggaaatgatatgaaatggtttttgtactttacagtctttttcagtcaaaaataagcactatttgactgaaaataagtataagctttaactgaagaagatgtaagttggctttcttaattttattgcctcattttctgaacccgtttttttggatgcagaactttccggagtattgatttttaattttttgatctttcttttttctcttcctccctctttctcttcttctttccctttctggagagtttcttcacctttttttcctacctttctgttgagatgatatttttgatttccaagaggttttaatgttctctgatttattttttatagaactttgctctcatttaataaatgtaagagcttctcctaactctacatattgttcaaagttttcttctgcttctgctttatctgagtttcttctctttctctttttttgcagtgtttgtttttgtctcatgtttgaggttttcttgaggatattatttagtatgcagaatttcatttagtcctacc

SEQ ID NO: 2423 - DNA, 7558 bp, Homo sapiens
gataaagtttgattcctttctcttttgtgtatcacccttaccagtgagttttatagttttcatgctttgataatggtgattgttattttttcacttccagatgtaagactcatttgagtacttttaaaggccagtctaagggcgatgaattctcttagtttttacttatctgtgatctgtgaaatattttctttcatcttcatttctgaaagatggcttttctgggtatcattatcttggctggcagtttttttgttttatatttcaatgttttgaatatatcatgccattctttcctgtcctataagctttctgctgaaaaaatccactgttcgtctaattgagattcccttatatgtggcttgatgcttttctcttgatgattttagaattctttatttgttcttgacttacagtagtttgactttaatatgccttggatagaacctgtttgggtttaatctatttggggtctttgagcttcctggacatggatgttcatttttctgccaagacttgggaagttttcaactattatttaattaagtatgttttctatacccttttccttctcttttccttctggaatacccataatgcaaatatttgcttggtggtcttaagggtgtcccagaaagcctataggcttttttttatttttttgtttttataaatttgtttttgtctgtctgtattatttcagaagacctgtcttctggttcagaaattttttcttctcaaagtcctttcctacaccagcattctcaaagtctgtatgatttttctaacctagtgtgtcaactaaaattaagatctttgctaaattttttaaaataacccagcagaaaacaagtactgttccagtccactaataatctccctataatctctttaaatttgtaagttggtcaaatctaccaaaaagattggccaactggaaaaatttgattttcaaatatacttctaagtattcttatgaaaaagatgtaacaaggagataaagaatggaattctgggagaaagttgtctttatttacaaagacctttggaggaagggtcagctaaggacaaggaggcatgaggaggcactctaaagaagaagctggaaaactgcctcctaaataactcaccccataatgcatcctcaagggatcatcttaagcctcatcctacttgtggcagatactgtagtttttttaggtacaagtgagtagagcaataggttagcctgtcatgctaccttgcatctatgatggagaggtgtcatctatgtgctggggctgaaggatgtgccctatatttggatcctcagatgaaattgtctggattagtagatcccatgtcaccttttagaagcaaatgtgttaacgggaattacgtaccttttgaaagggaatgccttcttaactatagaaaatgcaaccgaaactgacagtggcttgtattgttgctatgttgtgcacagggggtggttcagtgacatgaaaatcaccctgtcattggagattaaaccagccaggaacacgagtattcccatgtcatctggagtctctaacctctgcttctccaatgccatcacccctgcagagccatgaaccagtagttatttcaccttctccaactcagccaatagaaacctagattacaacaacagaaacccagattacaacattacaaacaaggacaaaacccaccaaccccattgtactcttacacaacacatgggaatggcaccatgacacattcttcaaattgcctttgacataacaatcaaactcatgtccccagcacaaaatccacagatcgccaccatcactaaggggatgtctatggaaatctgtatttctgcctggtgtttctcacttttttggatgtcaacattaacataaagtatttctacatcatctgcaagatgctgcaactgcatgtggttctgttgagagaccttctgtgttagtctgttctcacactgctataaagaactgcccgagactgggtaatttataaaggaaagaggtttaattgactcacagttccttagggctggggagtcttcaggaaaattaagatccattgcagaaggggaaacaaacacatccttcttcacaccccaataggaaggagaagaatgacaggtgagcaaagaggtgagccctttataaaaccatcagatctcatgagaacttactatcatgaaaatagcatgggggaaactgcccccatgattcaattacctcccaccaggtccctcccaggacacgtggggattatggggactgcaattcaagatgagatttgggtggggacacagccaaaccatatcaccttctaattggagctttgcagagtgcaggtgaaagacaagtgcaagcagaagatgatatctatattattgaggttaatctttatgtcatggattaaaatggtgcactttgaggttttatgcccatcactgtagaagacagtgaccagatactaccatctggtctgacaagacatactttaaactccaggattatttttctatgtcagtttcatctaacatttcaagatgtcaatggtattgggtagagtgagtctctagctcaaaactctgtgtagtcagcctcattgttaatatagttctcattttttatgctaaaactgactcagtccttctgatcattgcagagttccctctccaacatgaacgctttagaattgtatgttctctttagactccacaaatcttgtgtccatcaaagacaataatcactgacaatgtaggaaatgacttctatcttggccaccaaagctgctgagaagacagaaataggatttaaaaatcaaatctgatttgagactttatttgaaagaaattcatgattatttcttatttctatattataactccaaatgttacatttcttaggttcctgcaagggttcccagtgaacccaggtttttatttcatccatggaaataaaataggaggtagtctcatttgtctgtaacaggtgtatttgttttctcatggctctggaaatatgatgcattcagtacttgatccctggatcagggtagctattttaccagtcaaaagaagtgagtatggaccaagtagaaactaggtggagaaaatcatttgccatgtgattaaacacttttatgctgtttctactatgtttgtgccacaatactaggcactacagtaaacaaccagcaggctctctcaactaatttttacagggcagaaatgaagaagacagggcagaaatgaaagggaaaagaggaaagaataggaaaaaaaaagcctttctgccttagaaaagttacattgcaagtattatagtgtttgaaactgtcactagtttcaacccaaattctaaacttgtaaatgccttcaaaccacttatatatttaaaattgtttcagaaagttgaagggtctttttcatatctaatgaattatggtgttatttttcacaattcaattgtgaggcttattgtaaagataccttcagttaccagtataattgttgagaagtatagatttgcgagggctaggtttgtcagaagagaaacatttctacatgaacagttaaagctgggcattaatttctatttcaatttgagtaaaccctgaataattcatgcttggggtttagaggtgctcccatcataatggtctaggaggacaagatgcttgctttcaaagtgaacattttcaacactgttctgcagaggtctaagaaactaatagatcctttgaatgaaggtcctatgggaaaataaaattgtgactcatggtatttcacatttcctaaatgagaccagcctgatctggcctaaatatttttttcatactacagtgttttcttaaattgatgcaacatgcataaacctgggaatttgaaattaaagctcagatttgtagcttctctgaaaagacttggctagattagtctgcattcctgtgtggtcagggccccactagatggggccacattctctagccctgcctcctcatgtttgttacctgcctggtgcctacagggctttcagtttatggcacctgccctattctctatacctttcctggatatttattatgcatgataaagcctctgggaatatggttggctttgtttaacacagcattgcccaaatttgtttgaacacatgagcacagtgactagtagcattctgtgaaacagaatatatagagacttagggtactaaacaggattaagaatagggtgagagttctaatcctaactcttaacagtaacattagggcacattgttctttatgtctaaatctttttcatctattagatgtaatcatttccataccaactatgtcatatgatggtaactccaataaaatgttacttgtgaaaaccattatagattctgaagcagtttggagaacttatttaaaaatactatagaaatgcaaagtgttttctcagtagatttcataataatagcagatctagcattagttctcagtaaatcatttcaatggtgttatattcataagtctcttgggtatctttttaatagtttatttttgaaaaagttgatgagaaattttcctgccctcttacaccgtaaaaaattgtcaataactgagagagagaatagataagagggagaaagggatagaatttacttaatatgaatttttcctataaatatattaatcttatagattgcattgagttttgttttttgtttttgattctttgagacgcagttgagattccattacctacaatctgtcttgggacattgggacattggtgtaattaagactgtatatttaaacctaagaagtttttcacatctttaagaagtagcagagccaattgttcacttatgtctataaagatgaaataattttgtgagtacataaaagtgtgagaaactcttagtggttgtctaggttcatttgtatgtgcactcatcaataacatttttttgtttttttcgttttgaaaaaaaattcttgggcctggcgcagtggctcatgcctgtaatcccagcactttgggaggccaaagcaggcagatcacgaggtcaggagatcgagcccatcctggctaacacggtgaaaccccatctctactaaaaatacaaaaaattagccaggcgtggtggcgggtgcctgtagtcccagctacttgggaggctgaggcaggagaatggcttgaacctgggaggcggagtttgcagtgagccgaggtcctgccactgcactccagcctgggcaatagagtgagactccgtctcgaaaaaaaattattctgcttggtctgttctgttattgaagctctcaattgtattttttatttcattccttgaattcttcagctgtaggatttcaatttggttcttttttgtatctatctctttaatttctcattctggatttcattgacttatctatttgtactgagttttcttaagattattatttttgaattattttctctggcattttgtgtctttccttatagtttggttccactactagaggattactgtgttccttcggaggtatcatgtttccttgctttttcatgtttgatgtgtccctacattggtttctatgcactcagtggaaaagtcacatcatccaattttatggagtaggtttcgtaagtaaaggcttactcatatgaatgagttttgggatattagttgggtggggtacatttgctgtggtcctaggtggatgcagtagtgtagtgtccacatagattcttcagatgcagtccatgctagtggcattcatgagtgtctcggtggcctaggctgagagagttgtggatagtggtggggcagctttgctaggcatggcctcactgtgctgtttctcaggttgagggtgcatgcctgcatatcatgggtcagccagcttggagctggcactggggttatggggagttactctggctgggagtacatatacacagttgcttagccagcctggggtgtggctgccaagagctgcccacagggatgtttctcaaggcctggaacaggagcgcaaggctcttcagctgacctagggcatgtcggccaggcctctccaggggagggctgcttctcaagcctgggatgtaggcacacagctacttggctggcttggaggcttgtatactggggatggtccccagagctatttctcaggcctgtgtcataggcccacagctgctcagtcagcctgggtgatcgccctccaggggcagcctgtagggctgtttttctcaaaccctgattgagtgcattgggcctttgggtagctcagcgggtgcagcaccacagggctgtttgtacatcgttggttgtgggtgtatacttcacctggcctcagagcatgtcagttgtttggaggcttcatggcctctcgccctcaggagagggcacgcagcaattttgccagttcaagggtaggtttacactagacaggactgccagactgcttttgtgtctggaagtgagttggtttctctgctgtgtaggaccagagtgacagccaatcctggacccaggccccatgcagcttaggttgtggcagtcagccacccatatgggcttggtggaatgaagatagaaccccagtggtgtagaggtagtgttactgactttcagagcagggtgcactcctgatgttactctggtcttaagatggctctgtgctgtagaagcttggcatacaaggctaggtgggagtggggagtgcgcgcattgttctcctaatctgggacaatgcagctgtgagggttcctggaagccctccaaactgggctcaccatttatgaggactatgacattctcttgtagaaaggatggtaagtgtttgtggtagcaatgggggctggtagtgttcttctgcttactttttccctgtaacaggaagtttctgctgctttggggcagatctcatccaatcagagaagatggagttacagaggctaggtgtctccaagctgcccacctggacttctaatcaccacaggtgcatctgcacttccctgctgcactccagtgctctctgttcaacactccaatcaaatctcatctgtatattcattgccttgtctctttcttgtatgggggaactggcatcaggcatctgtagtcagtcatcttgctaatgtcactttgcgttgttattttttttttccaggtatttctggtctgcagatgattaagtctgtgggtacagaacctgcagttagagaaggccagctgtatacttcttatgcgcttctgccagaaaaaattataatgaactactacgagaagtataagcctcgaatgaatgagctggaagcttttaatatgttgaaagttgtactggctccctgtatagagactttgattcttctggatcgactttgttacctgaaagagcaggtaaattatgttattttaaaatacacaacaaatatcttattaaatacagtaatatagagccacttatatctaggataagagtctttcacataaaactagtaagaaaatttttctcattatattttcatagtttaaatgttcattccatc

SEQ ID NO: 2424 - DNA, 593 bp, Homo sapiens
ccctgagaagcgggctgactcgccaccagagggctttgtcaccgcccttcaaacgatcctcaggcacacagacagacagacagacagagggagtcctggatgaatggcaaacccttcagattctaatttgtttctcaatcagttgcttcctcgtgtgaaatgaggggacagacagctgatctttctgagctgcccatggctgggaccactgcctccattcccaacaccctgctggggaccccgccttccaaagaacatgccccaggcacacaggtgagctcccgccatgcactccccgtgaaagggaagccgtctggaggcagtgtggcacctgaagacgctggagctgctgctgtcagggacacacgccctgcccattcatctgccttctgcgccgggagcccccgcagatgcggaagatgcagggaatgattcagccccagccttaagaaaaagaggcactgaagaaaatgagtaaagaggagcagagtttcttttttcctcccaagtgaatcattgaaagaagtcagatcattccagatttcctggtctccttccctcctgaagaaccactggaggaacgaggactccca

SEQ ID NO: 2425 - DNA, 1354 bp, Homo sapiens
atatgaggatgctttttgagaggcttttcttcctgaaagatggcaaatgcttcaaaaactgaacaagttgataaattataccgggacgagctcacccaccactgaagtgcaaccatctttggggtagctccctacagctgtttaccaccatgctgtggtgcctaggagcagtctgtcataaagaaaagaagaatgcacttggaatataagcaacaggcaatttgcagaagagaagatataattatctagattggaatatgaccaggacaaccataccattcccacaaaccaccaagaaggcaaaaaggagaagaatcagcctcacctctggcttcaactttcccaggaagagtagaaggggaaaatgccaactcttttttccaaagcaagaacggccagaataagatcagttatgagagaaagaaccctaatacccaaagcctcttctatcaccagtttcctttttactggtatgcctcatttgctcaaccttttctaaagtctcatgcttatcataagggatgatgtttgctacaggagacaagaactaggatcttccttccaacatgtccctgaaaaggaggagcgaagctatgatgtttccattgcttgctcccaaaccattgatctttaatttcatactacctgagaattttagcacaacacaaactccttagtgaatggcctaggtttcttgatgcaatattcaccttgaattgttttatactagcacttgggcagtaattaaagggacctagaaagaagcaggggaattgtggaggtgagctggggaaagaatagggaataaaagtaagacaaagagcacctgaaatacatcagctttgcctccccttccttctgccttgaaggcttctatcaactaccttggctacaccctcccttcctaccataatcacctctccagattcaaaaaggcctgtgaaagatttattttctctttttttttttgagatggggtctccctctgtcacccaggctggagtgcagtggcacgatttcggtttactgcaacctccacctcccaggttcatgggattctcctgcctcagcctccagagtagctgggattacaggtgcctgccaccacccccggctaatttttttgtatttttagttgaaatgaggtttcaccatattggctaggctggtcttgaactcctgacctcaggtgatcctcctgcctcaacctcccaaagtgctgggattactggcatgaggcaccctgcctggctgagagatttattttctaacctccttccaaaacaccaccaggctaaaataaaagggttctcgatttcctatctgacataagctatcccttgaaaaaactgag

SEQ ID NO: 2426 - DNA, 1609 bp, Homo sapiens
ttccagaacccccaacatctcgactaggcagcttcctgtgcattaggaacagaatctttcttccctgagaaatcttagttcccaaatgctatgagaggaaggacattgcctacacggtaggtcagagacctccactgatttatgtgtctgttcctttatcaagcaggccctcagcctagcggtgcagagaggacatggatcttcccgagatgcccacagtctatgagagagaaagaccaagaaaccgctggaggactgggtgagcagtgctctgaaccggagaggggtgtccgactcaggaaagacactgtgaaggaggcctggcaggttctatttttgaaggtctgggcagggaccaaggcccagcaagtgtagccaaatcacacagcttcatctgccttccctggccttgatcaccaccacccttcctgctccctcctcttctccctcctggaagaatgggtcctgtcttcaggccctgagcatcactccggagagtgagacagacagacagacagacagacagagaaagagaggtggaggctgagagcaagaacaactctgctggaccttggaatcagagagatttattccatctctcctaaatttgaaatatttttcctgggttctctccttgggaacgcttatgtgtaggattaatttatgactagatcccaaatgaaaacagttcctaagcccaacacccaataaagtccccattgagtttcttctcacacttcctccccacctggcaggcgaggccgctggctctggtgtgtgttctgagctcactgcaggccggccactctctggggcaccacttctgtcctgtgcctggctctgtccacagcacaggccccagtgtccgccccagcgtactgccttgctcacaaatgctcgtttgccttccgttcttaatttataaactgtttttcaaacttgttggctgtgggctttgatcctggggctgtgagtcccaagcggccaggcaccaggcatccactgaagcaggctgtgtccacagcacccaaacaggctggtcctgggactcactggcttggaagatcagaactgaaaagaccttggaaatcacctcattttacagagaaggaaactgagataagtgagttgtccatcgtcatgcttaaaacaaggttttaatactggatttctgttgtttttatgccagtcaacctcagaggcattgggcaatggaatcttctctagttgactctatcctggtgtgagagggatttggtgagtcaggctcctgacccacgctcctgagagcagcagcctatggctcaaggccacaagggaagtgatacggtttggctgtgccccatccaaaatctcatcttgaatttaatccccataatccccgtgtgtcaatggagagaccaggtggaggtaattggatcatggggtggtttcctccatgctattctcatgatagtgagtgagttctcacgagatctgatggttttataaggggctcttcccacctttgctcagcacttatccttcctgccaccttgtgaagaaggtggcttgcttgcccttcaccttccaccatgattgtaagtttcccgaggccccccgactgaac

SEQ ID NO: 2427 - DNA, 1115 bp, Homo sapiens
tgtaatcccagctactcaggaggctgaggcacgagattcacttgaacccacgaggtggagcttgcagcgagccgagatcatgtcactgcactccaccctgggtgagagagtgaaaccctgtcaaaaaaagattttttttctttgttgttctactcagaattcttaagtcaaggacagaatgtccatttttaataagctccccaagttaattcttatgatcaaacatgttttaagaattattatgctaatcggggcaaccataaggagaccctgtctctacaaagaaattaaaaaattagcccggcatggtggcatgtgtctggagtcccagctacttgggatgcttgatcccagaaggttgaggctgcagtgagccatgaacgtgccactgcactccagcctgagcaacagagggagactctgtctctaaaataaaaaaagaaattcaacaaaaataattcacagggctaacacatgaattaattattcctttacttattcccttctaggactcaagtcttccctactttggtgaatgtttgaagcctagagaaacatattccatcaagaaagaataataattaatagaacatacggggtattgctatattgcccaggccggatttgaacgcctgggctcaagagatcctcatgcctcaacctctgagtaactgggactacagaagcgaaccactgaacctggaaagccttttttttttttttttttttttttaagactgagtctcactctgttgcccagggcagtggcacgatctcagctcactgcaacctccgcctcctgggttcaagtgattctcttgcctcagcctctcgagtagctgggattacagatgcccgccaccacgcccggctaatttttatatttttagtagagaagaggtttcaccatgttggccaggctagtcttgaactcctgacctcaagtgatctgcctgcttcagcctcccaaagtgctagaactacaggtgtgagccactgtgccaggcccttttctgtttttttagggcaagaatgagactgtcactttacttgcaattacagctgtatagcagaaatttttaatgaggaggacatttttaaaaatagtatttaca

SEQ ID NO: 2428 - DNA, 488 bp, Homo sapiens
ctggaggctggaaaatctaagatcaaaatgccaacaggtttggtgtctggtgagggcccactctccacttccaagacgatgccttgaacactgcatcctccagcgtggaggaaacacagttcctcacatgtcagaagaacaaaagaggaaagagagagcccactctcaaaagcccttttgtttaaggtattaaacccaccatgagggaagagcctacatggccttaccacctgttaaaggcttcacctcccaagaccattacattggcaattacatttcaacatcaaccttcaggcctccacttaagcgagttctgacgtcagtgaatacttctgcagcatggaagtgccaggaccctcgttggcccctgatggccaaatagcctcactctccattagaagagaaagcctcactctccattagaaggccaggagagcgaaatcagggattgctttcaaaacaaacagtgtggcaataaagaatttcag

SEQ ID NO: 2429 - DNA, 1410 bp, Homo sapiens
ggcacacttactcaaagagtatagattgagaatatccttttgcaaactatgtataggatactaaatagaattatgtttcttagcccatggttctatggttgtataaaaacaaaggtttggccaggcgcggcggctcatgcctgtcccagcactttagggggctgaggcagacggatcacgaggtcaagagatcaagaccatcctggccaacatggtgaaaccctgtctctactaaaaacacaaaaattagttgggtgtggtggtgtgcacctgtagtcccagctactcgggaggctgaggcaggagaatggcatgaacctgggaggcagaggttgcagtgagctgagttcgtgccactgcactccagcctgggtgacagagtaagactccgtctcaaaaaaaaaaacaaacaaaaaacaaacaacaacaacaacaaaaaaggtttttttgtgtgtgtttttgtttataaaccaaaatctacaatgaatccaaggtctttgaagttgatcactctgcaaataattttttctgtttattaatttccttctcgtaacatttttacatgggcatctactaattttaaggcaatattcatttattttaaaaattagtctattatttgttatgtgcttgcattttacagatattacctcatttgatctttgtatacacctcattagatactgacagctattcaacaaataaagaaaaagaggcatagaaaatttggataacttactaaagtcattgagacaacagacagccaaggcattggcacagtctttggacatgaaaatcatggagaaggaagaggctgattgttatccatgattaggcagtgcagatatagctcaatattccaaatgggatgttttggccttggagttaagttccaagagcattataaaataatcacctgtataggaagtcctgacttaactctattaacaacttcgtaagtataagaacaattatcgtactatttcattttgataaatttgtattctatttttagcattttataagacatacatctcttttgttttctgataatgataaatggagataaaagtaaagaatcattttccttctcttgattacatttgcactttcccattccaacttctcctactcctgactacacctgtcttcaatatacgcctagctttttcctttaaccaaatgtaatttgttcaaattgtcctttacaaactttaagaaagcctatttggtatatatgaggcaacgcaaggctttaaaatacttagcatttctatgatacagctcattttcaatgcactttaaaaatattagctaattaattaattagttcctgattacaaggtggcagaagttcaaggagaaaattgacacatttctctacctttataaagaaaacttgtttatata

SEQ ID NO: 2430 - DNA, 9401 bp, Homo sapiens
ggctgggaggcacagcgcccgtgtgctggaggcgagttggctccgggtgggggaggctggggttccaaaccagggcaggggaatggtggccctgcgtggctcgtggacctctctcagggacccctctcagcaggggccggaaaagcaggcccacacccagtggtcattgcaggaacttcacttgagctggtctgcttgtgagcctgtggtttggagaggagaagacgcacttccccatgagaaaaaggtggtcatccccatgggctccacagatgaggacaccggccctcagctctgccccctctcagaagccttcctcacctgggggttctgggtgaagggagctccccgccagagactcatgtgggatcgtgtgtggaccgtagagccacagagcgtcatctgtaagccaggtgaaatgcgcaacctgcagcccctccctcctcagacctatgagtcacgatctgcgttttagggaggcacatgaacttgtgagaagtgtgctacccctaccctctgaccactgcatgagcccctctttcaccatttagggcttgcagggtttgaagaattaagagagggtcttccaaatgcctcctttttagggggttaaacctttatgattagagggaaaattattgcaagaagcatagggatgcatcagaggtcaatagggcgcaagcatgaaataccactaacactatgttagataacatcaggggtcaccttgatgttggctgcggaggaaagggatgtccagcccttgaggacatgagatgtttgctgagagacacatttactctgatggcgttggctcaagcccaagaggacgctatggacataagtgtggtctgcccctgcctaaccctctccagaaataggccaccagccacctcctgaagagtgaaagttagggacagcagggaggagagggaaggggccggaggacaggggtccccaggtcacctaatgatgaaactcagttaaccttgaggcagactgggtgagcctgcggttattgcaggggcttcttagactaactctgccccgctaaactgccaaggtctggatttccttaataagatgaaaatctttttataacacaattaggagagaaaatgcttaccccacaaaggctgggttgaggtaacacttaagtgtgaatgggttaaagaataaccagccaatcaatcaccaagtctcaacaaggagtgaagacacggaactctcctggttttgctggggtgcactgaacaagtgtgggaaagactcagataaaactgatcagaaggctgggtgccgagcgtgcattttgaagtctctcctcttagccaggagtctgggggcctagcttacgtcacagtgagaaaggaagcatctcagcaagggttatatttcagtcaggcagctgcaaagaccacagctcaactttgcattcttcaataaagctttttgctttttttgtttttaaacccagattatttcatacaaaggaggttggctcttagggctttattaattggagcattatatttaaatgtcttatttttccatctgatcctgtcttactcttcgtggcttcccttgtagcaagcataaccctcctcacgtaattcctgggtgatgagtgaactctgcatagatgcccagaggtaaatggcctttggaagggccaagaagaactttggtgggataatttcctctcctaggatggattttattttccttattgtgttgtcactagaacggccacatgcatccaggtctctggagtaacttacttttgttttctttccatttttaaaaagcaaagtggacatttttctcaagcgttttgaagttcaaattaacatcatcagatcatctaaacgctctcagatgggcagaagattggggatgggtcgggggagtgggatcactaattaccacattcaaatgtgtggattcaaatgctcctatttctcctatagtttagatccaggctttaacttcagtttcctgtgtgacctttgagaagccatccctccaagtgcttcctttgaagggtattgctattgccctaatttctcagagaagtaaactgaggctgagagcagtccgggggtttgttggaggccacagaaccggttagaagaggcgtggattaggatgcaggtattgtgactcattctgcagacttcccttggggttttcaatcttgtcctttctggtcatgcccatgcctgggtttagacacatgctgagggctaggcaggagtgtgttggatgttgtggggtgagtgtgggaatggagggtagctcttgcagtgctcaggctagagctggtcctaacccttccatggaggggggaggggtgatagcaattcaggccagaccgtttcttggaagggcagggtgtgagtgctgggtcaggctagtgaggcatagttctacatgattgcattcagcttgcaatagctgatggcactgatgaatggagtctctgggccactcctgaggctggccagctcccctgccttcccctccgaattcagatgccctcttttgaggttgctgttctggtcaggatagctaagctctttccttcagtaggccgttgttttattattctcagattatctgggaggggtctttagtctcctctcctcagatagatttagcacatctcaccttgatggttcctgaagaaaggactctgactttgagaggatggaaggtcggggagtgagctgagatgagacgagctggcaggagcgctggcagcgaggaaggcagctgcagggaccctatccaggtgctgtgttgggtccaggccttgaaggcaaactcctcctactccccatgtgagctgacaggagtgtctcagggagggggctgctgaggttgtcttcgggccacatggctgctgggcatggcactggattcaggaccaagactcccgggctctaatccttgctccttcagttcacgttcttctcttctctgggtcttagttttctcatctgtagcaggagccaaccaattctaaggtcactcttagattctacaggactctcactggaagagaacccaggaggggcgtctgggaggcggctgctcagggtggccaggtacgaagccaccaggcagaggcacaggaggcatccctgaatcaccgaggagtcacctgccatgagcaatctgtggtgagagagaaggaggtgcaggccagtcaggggaaggaggtgacttccaaaacgccagggaagtttacaagcaggttttgtctaagtgattggccagtaggcgctagtagcaaacaaaccagcgcagggtcccaacttggtcaggagtggaatgcttttttttttttttcttaaagataataaatccaatcaggtcttttatcttgtttagaaatcataaatttaacatgtattggggttagcagaccagttcaggggctgtttgggggcattgagtcattaggctgggagtatttacgaggcagagtttaaaggacaccatttaacaattcttggcctggggctgtcttggttgcagctttgggcatcttttgggattctgtttggaagttttgcttgttgaaatatagcttagaatgcagagaattaagtgccttttgaaaacattttcatcccatcctaggcagttaaattcccaatactttggaatcatggctataattcagtttacaaacacaaatggagtacccactatgtctttttattttagtttattttatttttgagacagagtcttactctgttgcctaaattggagtgcagtggtgtgatctcggctcactgcaacctctgcctcccaggttcaagcgattctcctgtctcagcctcccgagtagctatgatttttggtgtgcgccaccacgcccagctaatttttgtattttttagtagagacaggatttcgacacgttggccaggctggtcttgaacacctgacctcagatgatccgcccgcctctgcctcccaaagtgctgggattacagctgtgagccaccgtgcctggcccccactatgtcttactacctgcaagacacagtaccaagtgtttcaaggaaaatgacaattgaacaatactaggtccacagcaggtgactcaacatttcccaaattgtattaagtttggggaatttttattttcagataagaaggcacatcaacacacatctacatgctgacctacctgtgtctttttgttgtgggacttgggtcttggttcctgaaaactttttcataattgataggtgaaaataacaaaaatgtggtagacatgtcttggaatgaacactattaaaaagaaaaataggactctggaatacaaactggtttagacagtcaataaatgaatgtctactcagtgggcacttggcaggggtaaagaacatgctctccacttgagcaactgtgaggtgtatttcagttattcctccaagccatgtagcattattgccattttccagataaagacattggagcttaaactagttaagtggctcgataaaggtcatctagctagtacatggtaaagtcaagtctttctgactcaaaaatccatgctcttattaattaattaatttaagaaatattaattgagcctttctcatcaaacatgctgcctccacatggggcactctgtgtgctctaaggggaagaatcagacaatcaccaaacacagcacaatataacacattttgtaattaagtgctaatttaagagctatatgaattcagggaagggagaatatgtcagctggagaggcttggcaccatgtcttgagaggatctcaagctgggtctcagagcacagaaaagatttgcaggaaccatgaatagagaagagcggcagaacttgtgtctgggggcagtgagatgcagaggtaaattggagcagatgctttaactttgcaaggtcacctgctttgaggttcaattataactacctggagtggcctttcaaccctcaaatagtgaagagggtggtttcattgtctaactcccacgttcatctgccttaatagtgactagctctaagtccagaaggagaactgggaggggtgagaatatgaaatattactcattgacagcaatttccacatgcttcctaaaacaataaccaacccaaattacctacatctacacagatgacacaggtgatacaataatgaaataattgatgaaataataatgagaggagtcctaaaagtagagattttaaaagccctgtgttcccaagagccatatgctactagctgaaaagcgctcctttctgtgcgtgatcaaaaccttttctgttcccttaaaaaataatacattggtaagcaggtgtttcattggttgaagaggtcattgctcggtgtcaggttggttttcagagaacagaaatgacagttctatgaaatcaacttgaacaaggtatttaactcagcttctcagaagttgccaataaactttatttaaagagattctcagaggaggctgttgtggtgcctctaactgactgcatcctatgcccactcttccctctcttttggccttctttttcagacttgtgtaaacccaagaaggtgggatagggaaagagattacaggatggtttagtgctctgcagttggacaggagaggttggaagttgtggggtggagtcccagaagaacctggtggctccaagtggtattgtgtggcttcttagccatcacatttaatctccccgggggtggctgttgttgcgatcctctgctttgccactggtggtgactagtgggaacgtttctcatagggttttggatggatgtccatgtttatctcttgaggcccattaatttggttgcttgggcactgcagtgatgggtctatgccgtgtgttggaaagagcactagattataaaagaagacttggtcctggacagttctgctgcatggctttaggtgagttccttaaggtttctccatctcaatttccttatttgccatctggatagttactctagataatctccaagctcccttccaagtctgtgatgagaggccaaagatgtaaattcagtctcctcatggagtagacagtgctgcgttgtgccagaatcacagacagcagccctgtcctatcctcaccgtgactcctctaggtgagacggtcagtggttcagaccaaatcctttgtcttttttttttttttttttttttgacagagtttcactcttgttgcccaagctggagtacaatggtacgatctcggctcactgcaacctctgcctcccgggttcaagcgattctcctgcctcagcctcctgagtagctgggattacaggcgcccaccaccatgcccaactaattttttgtatttttagtcgagatggggtttcaccatgttggccaggctggtctcgaactcctgacctcaggtgatccacccacctcggcttcccaaagtgctgggattacaggtgtgagtcactgcgccaggccgagtctttttgattaaaatagctcccagttgatgctgtcagcaaaattatgtagacaatctagggcggcagccatgctggtatgcctgagaacaggtggcttctgtcagttttaaaaccagcaaagcactgggcaaaccagccaggcggccaccccaagaaggacagttcctaccaatttagtgttaaggtggtgccagggcaagtgacagcatcactaagaaatataaaaagattctagaaaaccctgattttccttggccattacttgacttcccttaaagtctcttcgggtccctattaagtaaatactgaaatttaaatgatgaaatgctttctcccccagcccctatgcctgtgtaactaagtcacttcctatcccagaagctagtttggacctggtctagctggtcttgcaccagatgtccctgaagtcaccttctcatcccaggcttctccttctgccttcacctgtcctagggtgggagctgaaggttcagaggagtcaggtgggaccgtggctgggcctctgccttggttctcacacggtctcccaagcccttacctcatgcctgtgaaggagcaacttttcttccgaaaagatcttttccttccaaaatggatgctctgactgggctgctaagaaatgtgtgaccacaagaaaacaagagctttaagagatgagcatggatattccatgcctgggattcttagatatcctgatttaagtgagttattcttgaagggagggatctgagagtggtcgtagagtctaaaagagcctattttataaagcacagcctataacggcttagacccatttttccttttcttctaaacctgttttgagttggggagcaaagcaagtggttccctcaagtgtcttcccttttacctcattctccttctacccctagctttgcttatgaggtgtttcctatattctctgagggcacaaaacacttagaagccgtattataattcctaaaatctatttgaatcacacaattgatataaacatgtatttttgttgtaaaatttaaaattttgtccatctgatggatgagaatgacctggtcttggtttaatacccatttccctgagtccctgaatgaccgtgtggagcaggtcctcctttactcctggccccctggctaacctgtatctaactgatataaactagaaataaagtttattgtgttaggcctttgagattggggttgttacagcagttagcctctctgactgatgcagggcatttcaaataatggcagaatacagaaatctttttgacctctaaaaaccataccacgcaggcccagccctacctgaactgtaagggaagtggactttgatttcttaatatctagcctatggtgtgaaaatccaagtaactacagagaattaaaatagccttttctccctcttctgtttctgtctccctcccattgccatctttacccattgtctttttcaacattcttttcctctctccctcttccaattcacaaaggaaaatagaaatgttcaaaggttaaaataggccaatagttctttggctatgtcaatgcataacaaattggggtagagaattttaacaattaaaaaaaatttgttctgaatcttcctttggccttaggtaccatctagaggattacagttgtagtggtgtcttttctcctctttctgggtggctaaatatttgcacctcagctccctccttctctttgtgtatgtgtatagaaataatttcaatgccctagcttaagatctggcagtgaaaaatatccttatccacttggagaaggtcatccaattctggaaaagctgtctcaagaaaggaccatacacgttttataaaagcatgattattaagtttcaggttgattatcatgcaaatgcttccatttccccccttaccccactgaatctcctcctacaaccatgagtaaaatgacatctgggatgttgggaatttaaccagccagtcaggaaggccgaacaatgtttcctcagcccatggttcacaggggttctgagggcctttgtgcggaactcaaggagttgttcctttaaacaaggtgccggcttatctcacactttaaaacaccctttcctttcaaagttaagtgtttatctccttgggaatatgaattggtacaacctttcgggaaagcaatttggcaactggcatcgggagacttaaaggcgttttctaacttgacctggcagtccctcctctagtgctctagcctaagaaaataattggagatgcgatcacagatgcatgtacaaggatgcttatcacagcataatttatgacagtaaatcacctggaaacagcttaaaggctggaaaaataagggaagggcaaatccactcaacaatggaatattatgcagcctttaaaaatagtgttttcaaaaaaagtttaatgacatggaaaaatattcatgttaatgtgttaagtgggataaaaagcatacaaaaccaataaattctaactttattgaaaatagtttgtttaggcacacagccctagaagataagaaataagcaaatacaagagagaggagttttgttctaacctcagctctgacatgtgctaactgcctaccattgactaagtggtttaaactctctggatttttttccccagggttgtggtgaggatctgaaagaatatttgcaaagttcctggcacaaagaagttgctcaaaaattggtagtagttgttattatgattcttatccctattatactggtaggagtttgtcagtgacaaaagctgggtaagaatagttttggggggcagccttcctttacccttgtaacccaaaaagtatctgagacaggtctcaattaatttagaaagtttatttttttattttttttattatactttaagttttag

SEQ ID NO: 2431 - DNA, 2959 bp, Homo sapiens
agaagtcagttcctcgtgcttataggagaaggtctgtttccttgctagctgtcagctatgggctgtcttagctattaaaggcaactctctggtccttcggttggccccctatgtctcaaaaccagcataggtgcatcaactgtttctcgtgctcagaatctcttggacttccccttctataacatctttcctgccttttcttctaccacatgtgactccagcctgagaaaatgatctgcctttaagacttacgtgattaggttgggatcacccaggattttgaaaaagcaagctgacataaatcctataatcacaaggaaatgagttttaccaacaaccagagaaagcttggaagcagattctttctacgtagagcctccagatgagaaccagctaagtcatgcctggacttctgacccacagaaactgaggataataaatgttttaagccaccaagtttgcgataatttgttacaaagcatagaaagctaacacagatgacttgaattctaaattccatgtaaaattttataacttttctctttatgtattcagataaacaatattccttacacacatttgaaaacatatcaatataagacagctaaatattttttaaagttacaacgtaatacaaatagaagatatataagaaagcaaaatcaaattatgttttcctttcagaattataaaacccccacctagcaatgctaggctcctgacataaattactgaaaaatagtcagtaatgaattttaaagccaaaacagaaagtcttagtccctttctaccaaaaaggtatttaacacatcttaaaacaaaaatcgagtaacccggggaggataaaataaatttgtgtcacaccaaaggaagatgtaaaaattgtttggtttgcagaaaaatcattcaaaatcatttcaatccttggctcataaataatgcaaacttaatgagatattctatcctaacatgtatagatgaagttcttaattatttcaaaggggattgtgcctacatacctgaaatttaaactttccctgtagaaaacaataaaaacatacacttctttatagatatatttagaatgtgttatccccaactaatattttctaaactacacacatacttaaacactgaatttaagatataaactgagatccttaccaattttgaatggagtttaatcacatcaacccacataaaagtctcacatgaacacatatttttatgtgacatatttttcttcaaataaatattgcttctcagactttttagcaactgtggcaaaaacactcattgtgaatttatttttcttacagcttgtatatgttttctttatcttgaattgtctgcccaagtagatgagagatttgaaaaattctgtcgacagtggtaacagagtcagaggtcaaaagtttccaagcatgaactaaacctaaacagcaagaaaaatatcaaaatgtatgcaaaaatacacagaaaggttattgatcttctaaaatcataccagattttagaagaaataccagaaaatagccttaaggaaataaaccttgtgtttgtctaataaaacccatcaagaagtatgtaataattacatcaaccctcttgaaatttttttaaaaaggccaagtctatagaatgaatagtatcaggccaagaaaaaaaattcaggccctgtttccaaggacaataatagtggaacagacagatagtggccagtctagcctggggaatgcaaaccaaccaagtaaaaaatttgacaactcagttttttataaaattaaaccaatgctgtgtataaaagtatccagaatgaaatgaagaactgactcatattttgataattaatgctcaaaaatgtgaaattttctgttccattatttaggtattttaagaaaaatttactttaaatttttgctttatgtgactataatagctatatttcatgtattagcatttatacatacaaaggctgtagagttttaccagactttattcgagggtccagagtacttaaagagaacaatacaggaatagaaatagcataaactatatacttcaaataatttcacagggctgtgtaagcattttaaggaattgaggctttatcctaagcctaagggaaagccatccatataaccaaatttctgtttggaaaaatgtgctctggttgtagtacagagaattagttgtcagaacaaaggtgagatggtggtgatatagatgccaaagtaagaaaatatgaatgtgctatgctatttcactcttctgtccttcaccaacctattttctctgcttccttttctctttgttcatattttcagttcaagtttcaccccttctatgaaacatttcatgaagtatcagcccattctgtacaatcaaccactcctgcctctgtgcccaaacagtatatgcttttatcatggcccatgccattgaaatgcatttagctgtatatgtatattcgtccttgtacaaatcaataaataaattcttaatgaaatttattttctgtctccagcatctaaacaatgttttgccttgtgctaatcaaaaaagttctggttgacatttgaaatggttattttgataatctctttctgtaccttccctaaagattactcttaagacattctgaaaatatccattttggcaaagttgtatgagttattcaagattactgtaatttaagttgctaacaaaatggatcctatctatttgttcaccctttatttccctgtcctatatcaatttctgccatctagtaggtattaaatatattttataaatgtttaaaaattattcatattaaactaaaatatcagcttttcccttccgttttaaagtgttgtccactgctaatatgtgcaaaacatgattcacatctactcttagggatttcatttcttttgctggtcacaatatgaaagcctatactaggatatccatcaat

SEQ ID NO: 2432 - DNA, 3886 bp, Homo sapiens
attccatctggcccctgcaggttggctcagcactggggaatcagagtcccctccatgaccaaggcaccactccactgacaggtacttggctcactctgagtgttcagagattcctagacacctacttacccctaattcttctggtctattccctccaattccctccataaaaactgacccatcctttgcatcaacaatagtggcttgatgacgctcttcagtagaggattttgcatttcatatggggaaaaatgatgttattctaagtaatataacagaccaagagaagagctttcaaattcccttaatatcatcccatatagatatttatgtcttctttctatgggtctggtgaacatttctcaactgaatgtgattttcttacatacactccattggagaggcataccagtctagtttcagctcaaccactaactccttccattaatactgaagcaatgttgtctataaggctccacaaatttcaaagtactaataatttttagcccctttcatgcctcctttccagcctttctggaggtgaataaagtcagaaagtgcattcaaaaggctgtgaacacctccagcttatctaggtcttcttactggagctgacagccaatgagtgtaatgatacaaaaaaggtaacaatccatttctttttctcctgccatccccaactcagactctgttaatcagcttgcttggctggcctccaaccataggtccaggggctgagacaaggtccttttgagctcctatgtgggaggctctggaaagcttagcaacactttccaacaactttgccaggtaagtaggtaagtctccttgttctcatttccagagaagacaactgaaacccaaagaaagacttgcccaagccatgattggctagttgatggccaagacagcattagaacacaagtttgtcgattctgtcatgccatatttggtgaccatgactgctgcttttgctgctgggtggattaggctgaattgggtaggtagaaaaggaagtgagggagtgaaagagctttagttttgagatgactgccagaacttaaattgaaggagtatgttaccttcttaacattcaattaaaagaatagagcaagaaaagacactgattgttttcttgctgaaagacaaggctgaatccctctgtcttacctgggctgggacagggctttccggcctcatgggggcagtttaccatttctggtaaccttgtgatgtttgccacttttcatgacaatatttaatgtagaccagctacctgctcacagatcaactgccacagctggtaagggcagtaatttgacaccagcaacctgggatttttagcaacaggatctgattgttgccaagggaattctcccagaagtttcagacctgaccctgctcctggcagcttccttattgccctggtggcttgtgggttcagtgatcccaaatgttgcattacaaagctattgcctgtttttgccctctttgttgatgtgtcttccctttcccagagggatatacagagaagggaggcaaaataaccaatgaggaaagctgtataaggcatactgctgaactgtaaaaaatttattgtataaactttacaagtctcctccccaacaggagcctttgttatctcatttataacctaagtgagtgagactagatgatctttaagggcactttaatagctgccattcttgagtccctatgggacaagaggatcatgttaggcaaggctgagaccacaagaaatcaatgtcacacctgtccagatcctgctaaatcaattgccaatagctctttctttcattttggtcacacaaccactactttttgagcatttgttatgtattgaatactgaaccaaaggctttacatgcattatctcctgtcattctcacaataaccttatgaggtaggtattatacttacatacattttgtgggtgtagaaaacttgagctcagagaggtgaaatgatgtatccaaggttgcctaactagctaatggaagaactaggatttaagctcatgtttaacctcaaagcctatgtgcataaccacaacactgaaaacacagcttgggagaattgagaagagggagcaaggatgctgactctagggtctggtactttcctcaagtcagggaggcaggatgatgaccaaattttcccctctctgctgcatagaggaacccactgaagcttgggacccctagaaatgccatagctacaggactcaggcctgatgagcttccagctgagcactgggtgtcactcgggctttacctgcttatcttcaggatctctcttctggttaggaaccctatgcctattttgctcacttccctattctggtgctttggttggtcctttgagcaagatccccggggctaagggtgtgacttcatcattcctttctctctctttccctctagggtcacatctcccaggaagatctcacttccccacagaagctcttggcctggcctcctgcagtgccacgctccgtgtatttgacaagctgagttggacactccatgtggtagagtgtcagtttgtcaaataccccaagtgcggcacatgcttaccagctctaggccagggcagatgggatatgacgaatggactgccagctggatacaaggatgctcaccaagcaccaagttctcacaagttattttatgtgactttgcaggaactgaggcattatatctgaggacaccaggggaaaagtgtggcatctcagggaaatacagccctgggctgtgtctacacacaccatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctccccttttccacatgtcttttcctgtaggaacactttctccatttattcctgcctatccaattcttccctatatttcctggaccagctaaagtccagtgtttccagagacttttgaaagtcaacttacactttttccttcttcattcacaaagctcttcttccctgggccctggtatgtatgcctttctctcctactgtctaatagcacctcgtaaattgtcaatgaacttttctaaggggtattcttgaattcccaactagattgtgagcttctggaagacaaggctatgtctttgattgttgtctcccctaccacagcccagtactttagttacagaaaataataaatatttactgattgattgactttcctcttgtccactagctttaggtttgggggccaaattctaccctggattttgaaaaattcaaactgtgaacaccacaatgttatagagcatatgaggtagtagccagcatgaaggatgttttcttcctgagaaacagtgtcaagggctggaggaagagggcaaaatagcagactcagagggcaaataaattttggtattacttggtcacacaaggttatacaggtgttttcttgtaggatttttcagagcctttaatagtctaatgttgcattgagaatctcaaagaggaaaccatagaatgaggcatttgccatacctatctgatcatgaattttcttttcccccacagccttctcctgtgtcaatgtccaatgaagcacgatttgggaaactgtcctagagaaactttataccttcccgctcttctggagatcttttcctcttttcattcatctactttccccaaccagccatctgcctaagaaagg

SEQ ID NO: 2433 - DNA, 965 bp, Homo sapiens
tttcagaggaagaggagggctagttgattaaattttattgggcctcctttcctaagtgggcagaattgctgtattgaaaggctgtgaggacctgccactatctttcaggtctgtgtcctcccacacaacgtttgtcttcatggacttggagtctgctctgcactttctctctctctgtctctctctgtctctttctctctctcttccaccctccctccctctccttccttcccagacatacctgagcctatggttcccatgattcatatttgcaaagaaaattctactgtagtctcaggcctaagacgaattctccatctcaaaatactgaaaatcctttattcagggagttgtgcagatttttaataaatcaatgcttaatgtctctcatttggctggtgatcttttgctggatgcagcatcagtttgaatgctggagggatcaggggtaaccagcatttagaattcctaagactcttcttgggaggctgaggcaagaggactccttgagcccgggattgcaagaccagcctgagtaacatggcaagaccccatctcagaaaagaaaaaaaaattcctaagactcattcctcttctgttcatgatttctttgggaaaaatttttcctatgttccaactgtggaagactggatacaccttgaatgcaaccttctttcatgtcttcaaggttacaaggatgaaaaaagcatgtgcctaagaaagcaaaacaacaccaagaaactgaagatgcaaacgatttgttttatgagtgtctgtgtagacgtgtgtgtgtgtatatatatatactaatatacatataataatcaacaaaaacgtaacatagggacgatattacaaacatacaattcctttttagtgtctgagcgctaaagaaaggtagatctttatgttaacatcttgattgacataactttgaggaagaattttgcctaactgcttacagg

SEQ ID NO: 2434 - DNA, 2414 bp, Homo sapiens
agctgagtttggatcccagctccactcctccctgtctgcgaggcctcaggcagtttcctcacatgtaacatgggcaggattatagtagttcccacgtagagccgggagtgaaaagcgatgatgaggtgattcgtagctcagctctggcacaataaagtgctgaataaatggggacagatatgggaagggagtgggatgaggtgggcctagattttccagtatggaaggacttttagtctgttccttcattttgtagatagaaggactgaggtccacaggtgacaggtccaaaagtcacgctgctcttgggtcacctggcacctgggctcccgctccttgtgggctccagcgcttgccctcccggaacactccttgcccagacgcaaccctcctgttctggagggatgggtgagtgaggcttggggtggggctgtggccaggtcgacggagctgctctgtccccaactcctaggaccccccgaccccggtcttagggattcatctgcggcatctcctgcagttccgagttatggccgctgggtgtcgccacacagcaaaaaacccacgggccgccgggaggacgggacctaatgggggctctgatgggacagcgccggccagaccctgatccccgacccttgaactcctgcccaggtccttggtcggctacagcctagagcctccctaagagaagccctaagggatgatttcaaacctttctaccacccctccttgccccctccacctgctaaaaggaaaacctggctacagcctacctgggggctgcttctcccagctgagcctctcctccccacgcagtgctccagccacgctgcactagtcagggctcccagcctgctggacacctgtctccgcctttgtgtttgtcgggctttccacgtagagggcccttccttatctctgcctggtgcaggcctgttacctcttgtgcatagggtatttcaaatccaccagcgaccctgctaggtaggcacagttatccctgcctgcaggtacagaaacaggctcaaagagaggaagccccgagtcacacacagcagaagcaggttttgaactcgggctcccacagtgagctttcttttgctacatctgagatccttcctaaaccgtgggctctctgaggccagggccatgtggatttcctgtttgtaacccttaggcccaaccctttgcctagcaggcagtgagtactcaaaaggaacctctttccctagctcttagatggcacctaccgtgtgccaggtactgggctaaatgcttcgtgcgtaccacaaccctgcaggtagttaccattattatactcattctccagaaggggaaactgaggcacaaggaacatgcactgtcttacggttatctagtggcagagacaggacccacaccatctggcttcagagtccaagctcttgctcgtagccacttatccaggcacacttagaggagggcccctctctcccttcaccctgtgagcacctcacctatggtggtctcaccctttgtgcttcgtgtgtggaactcccacgagcctctgtagtagaatgggagcactttgctggagggcagggctgtgtgcactcactcctgtgtccttgtgccctgtgatccctgaacagaatcgttagtccggagggtgggtgccaaacgtgcttcagcttgccttctcctttccctcagccttcattcatacctcactctccagcaggggtgctcaccggctcaggagagctgaaggcgggaaattggcaagctggtttttaactctgccattgttaaaaattaaattactgcaggtgctgaatccctgccagcagccctgagtcacgtcccttgcgaagatggggatttgggggcgtgaagaggataagtacctcatcaaaggtgacagatcagatttgaaccacactcttaactgctgcggtttattggccctacaataatagtgcccagttcacagggtggtttgggggattacacgacgtaatgtgtgttaaagggcttagcacagattcagctccagaggaacatagtaaatgttgatttaccgagaggcagaagagcgggatccacatccacccacgtttgaatctcaacttggctattttctgattgcgagatctctggagtcaagtcattttgcttatctaagcctcatgttcccccagtgaaaatggggataatcatagctactgaagagctgctcagaggatggagatagaggatgtaaagtatctgccgagaagtgggtactttatgggagtgagtgttcgggattatcttttattttatgtcacgcagacagcaactcttcccagccctgtggaggaggccggaggttggggccggagccctggaagcagggccttgctcgggcagcttctgaccctcccctcctg

SEQ ID NO: 2435 - DNA, 6289 bp, Homo sapiens
gtttggagcagatagatcagagggaaggcacaaagcgggaggggagctagccccgggagaagcagccgagcgccaggaggcctttgccgcctgcagcccctgcggtttcctcttttcctccgcttcctggctcagccctgcctgctgaggaggaccatgctgcggtgcaggcctgtgtccacctgagacagcacagggggctctcatgaggatggacacaaacaaggtttcagagaactatctgtcaggtgcaggtgcccagccaggtgctcggacagactacagctgctctaaaacaccccagcctgccacaaacacctggctgctttccttctggaaagttctcctgttgaaaggcacgtcctctggaaaagaaaaacctcatcagactggtctcccctacgagggacggcctacaagcctgccagggagacaactgaaaagccccgggaggcgggtgacttaacagcgagttggtctcgtcatgattcgtctgcgttggaggtgacaacacatgtttatttctgagaccggcacgttctcattttctctttagtttcggcccagcttgaggtcttttttctgagctggcatgtgaggtagcaacagtgtgggttggaaacagctaatgaattttgaaggcaacttatccactctaattgcttttcttcctctccatcctcctccatggttagaaaaataatgaaatgggaaaagaatagttagcatctgtacatattttgcccaatctttcattgtcttattattagcactgtattcagcagttgcacccgagaaccatgttgagggccagagtgcaggctttgcaaggagggaatggtggagaagccacagtccctgccctcaaggtcaaggtccaggtcaagttgggcaggaaaggaaatgtgacatgagagtgtctgcctaaaaaatgggaactccagggaggagcctggggagccaggaagtgctgcatgtatgagaggatgagctggaagtttaagccaggcccaggactttctacacatagaaagccatggaggctttaagcagggctggctgtggccagatcactgctttggaaagcccatgctggtggcagggtgcatatgagagtgcagagaccaggggaaggaggactagccaggaggctgtatcagcttcaggcaggtgtagatggggcataaacaaagggagtggtgtgaactggggagaggtgggagatgagaagttctgggcagacacagataggcagagcagggtccctgggcacttggagaagaggcaaggggagaagccctggagaagggggcctcacagcaaaaggggatgaggctgtttttttctggaagctttgctaagagtttagggtgaactgtggagttagaggaaactgttcctaagactgctctcacttctgacaccagttgcaagttcaggagagatattctccaacccaccttcaggtttagtaattttccagaaggattctcagaacacactggaggctattacactattggttatgatttattacagggaaaggatgaagattaaaatcagccaagggagaggaagtgcagggggcagactccaggaggggcccaaatgcggagctctgagtcctcctctccctgtggagtcatggacggtgttagtgccactggccatggtatgtggcaatcctcgtggagtattgccaggccaagccttgggggtccaggccttttactagggttccgtcacatgcagatgctgtggctgacctttagtctccagtcctaccagagtcagaactgataccatgtggcccaaggccccatcatcaatctcagtgttagcctgcctatgaccaaagccctcaggccaaccaagacacttctgtcaggcaggacatccaggggcccagacatcacccccaggagccgagggaaaggcccgagttctctctgagtagagttaaatcttcaccacacggcttgcagtaaggcacgagagaaggaacagaagggtgaagacccgggaaatgggtactggaaagtagaaaggacttaaatagaaacatcctcctgtgtacttggttcagtaatgattagatgctgaattacacacaccctcacagtcaaggatgttcctctggcatcaggcatttggctcttcactcatgtaggttgtctttggggtgtctgtggttgatttttcacatcccgttgtgtgctgggcatagaggtcacactgggaacagagaaacagccaggatattgtgcgaggaacatgtacaccattggtggccacaaccttgacctcttccctgcacttcagtccttacctgtgaaatggaggcatggcgctacccacagggtgttgtgaggatgaaatgcaacccctaatataggaattctttgcacatgtagcacaaaaccccccataaagaagcaagaacaccttgtgttaaaatccagcttctgaaagtaactttgctaggataactcttttgtggtacagtgaaatgccataccactttggaaaagtgccctatggtgttggggcaactgctcctgaaataatgcccttcttctgtggtcctaggtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaagctcttcctggtgcatgagtgaatcgcagtggtttagtgtcgcacctgctcgagttgtgcaggctctgtgtaaagaggagttacagctgtgctggctgctgagagacgaggtgtgattgtgcgagcaacaggcagaagaaaactcaagaccagagagaaaaggattcagatgttagcagggactccctgtgcgagtcctgttggggtgtgagtcagggtgggaggtctggcccagccacagtcaggcctagcgttgtcttcagaccttcaaatttgaaggttaagtgaccacaggcctcattccggtggcctgcctggcccctggcagctgtgagtttgagacccctggtgtctctggcacatgtccttattgctgagggcaagcccgcagaaggaggtgtggtgtgcactcaggtggggcagccaggacaaaagaccacaaacaacggaaactgattttctcagtctggaggccagagacccgagatcaaggtgctgcagggctggtttctctgggggtctctgtccttggcttgctgatggctgattctctctgtgtgttcatgtggccacacacacacacccctgctgcctcttcctctccttataaggacaccagtcggagtggatgaaggcgtgctctgacagcctcatcttaacctcatcatctctttaaacaactttatctgcaaatgcagtgacattctgaggtactcgagattgggacttcaacatacgaatttggggcacacttttcagcccatacagaggggacatctcaggcttagggctctgaaagctgggccatcctgagcacagcgtggaccatggtgggtcccccagttctgggcagaccttcctgggggagccttctccccag

SEQ ID NO: 2436 - DNA, 2639 bp, Homo sapiens
caccatctgaataatatgccatcggaacattcttttgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 2437 - DNA, 2364 bp, Homo sapiens
ggccctccctgaggctgcctgcgctttcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccag

SEQ ID NO: 2438 - DNA, 1622 bp, Homo sapiens
tgagaggaaaactccatttcccttaaggagtgcatgttactggggaggtatggtttgaaaaggttctcaaagtgattatgttgtattcacctctgtgactctgtgaagaggacatccctcttgagaatcattacttaacgccaaggagattcctcttctgttcaaagacccttccatgtgctcctgcagccttagacatgtgccattcatcactttagggaaagattattggagccaaaccggaagacaaagagcttcagtagtatggtgatattttatctgtggtaccagtggtgtttccttgatatgttggtgatggtggtgagaggaagagtcatgcctggaaagtctgcagaacaaaactgccaggtgacaatgagcaaaaggaaaaaaaggagcctcaattgaaagaggccttcaccaaggaaaagccagttgaggtgttcaagctccatccaaggtatggccacaggttaatccaactattgctatctaaagattaacctatttactttatgaagaagtatatgaagttcatgcatcccatagttcttccatataaatgatgacacaagaagtcacccagcacatgataagcagaattgcattgagaatttatacatccttagcttcttctgtgacgttgatctgtggtatagtagacatttagtcttactcgtgtttaatcctgataaaagagccctggaaccaaaacaaatttgaacctcacttggtaagttgagtttgctttgggcttgttccattcaatcctaataagtttaaccttaataaaatcttgaagtgtatcctgtacaagtctagcaaattgacagctaaacatgtgttcccaattcctctttcagtgtattctgattctcagcgctgcttttccttcttttctagatgcctccttaactctatgttattctcagctacccaattcttgtattaaattaattaattgtatttaatttagatcaattgtatagccaaagagaaaagctgaaatctcccagtcattatatttcttggccacaggagttgccatgttctctactaaatgtattattcatacatagcaggaataagtgaaaccataaagagcaaagtagcaatgaatagaaatttggaagatcagagaagattgcaataatccagaaccaccttcacaataactttcgtaagttttttaagagtaatcagaaatttttaaagataatttgttaaaatctggagaattatgtgactcaaagcgtgaaacaatctgtgcaaatttttttaatcacttaactggaggattctgggatagaatgcagaatgtgaaaaaattatctaaatgtattacaaatgtacaaaacaacctcagtcttaggggtgtagaaaaactgtgttgatctaaataactagaaatgagtggagtctgtaagaataaagtccaaagaaaccacacataatctacataagcatgtatgttagttgacaaagtggtgtctcatggagcacacagatcaacaattctaaaaccactacacatgtaaactggaattgaacaattaagtaaatgtatggcaaatattgggagtccaaaaactcaactgttgaagtgggaagttagatttaag

SEQ ID NO: 2439 - DNA, 20764 bp, Homo sapiens
cagacatctcggagccaagttccaaccaggacagaggctgcagcacccagggaggaacgccgtggtccctgggacggccaccaggccaggaggctgcagcaccaggcgtcaccggagggccagcgctggctaggctgtctctgtgcaacgtcttctgacccctcctctccaccttctctgtgtccagggaatctgtgctcacgtcttccaggacagtgcttcttctagaagctgacatggagctgaccacagctcttggaggcatggcctgaggcttagaaaatagacagagatcatctgagatttcagcagtggggccacgtggcagcgcccgaaggcctggagcaggagcgacccagggactcagagcagcatcttcttaggagacggaaggagagccgccggaggagcacggggcacctgcgatcgcgaagagcctcctgttctggatgggagcgaaggctccgagaggacctaaggttgctcagtgggccatggaaacggcagtgattggggtggtggtggtgctgttcgtggtgactgtggccatcacctgcgtcctctgctgcttcagctgtgactcaagggcccaggatcctcaggggggtcctggccgcagcttcacggtggccacgtttcgccaggaagcttctctcttcacggggcctgttcgccatgcccagccagtgccaagtgcccaggacttctggaccttcatgtgacgcccgagtccccaggatttgctgtgctgatgggtcagactcacccgctcctcagcaagccttccctggccttcccctcctcccagggccttctccctgtccttcccctccagtaacctgtgaacttcccgtctcctcccattccagccttctgtgccctccagcctcagggatccttgttattgggacagcccagctggggttgacccacaggatggggcttaggagagctctgaggagtgagtgaacagacagcgccggagtgcacggtgggccggctctgctgatctacaccaggaactgaaatatcactggaatttattgtaaacggtgtgcctatgatgctggttctgttgccacctgggcacgcagcaccctcaagtggacatttctagaaaccgcttcttacttgctcctaattgattacttttgcacattgcacagaacccaacctcgaggcctgctccctgccagttgcctgaaatcagccctgaaattctgaaaccaaagagctgcttcctgagaacaagttatttaccttagaattgaaaatgtatatccttttatgggcctttccaaatctgattagaaaaaccacaaaaggaaacagaagagaaaataagagccacagaaagtacaatatgttttattaacaggaaagccagaaataagatattttaaacatatttttaatgagactttattgctatattccaacaggtcactcctattcttagagaatgtgaatgacttgtgtcacttcggagtgacagaaaaatcaggaactgaaagataattccagacaagttaaaatgttatgttacattcaaagctcttgttttcatcacaaataaggggatattcagtttttattaacagaaaacccattctcccatggccatggaataaatgccatgctatatttaaggagtttggtttgaagggtgcaaaattgtgagcctcctggctcttatgtctgtatccagccctgaatagatggctctcccaggacctgtttgttgaggggggcaggactgagctttaggggggctctggcctctaagggtgtccagacaggctgcccttgccatgtggctgccatgggaagggctttcagagtggcttggagctggagaggtgcacgcggggagggggaagtggtggggagagtgaggctgacggagagggatggggaggagcatggtgggcgaggctcagcccaggtccaggagctcctgggaccatgtcctggacactcctgacaccagccctcgacgcagggccttcagagatgcacagagaagggaacggcacatgtggggaggccctggagacggagggaagagaacttttgagggctgtgttctctaaaagcgaacagtgagacaaagttcgggtgcaagatatttgtcagggatcaacacctacaaaggggagaaggaagaagcaggattgggcagaggaagaagtcaaaccgtgatgcaggtccttcatatccccacctttgctccgtctctgagtccctctcccctctcccagggtctgacctcagccagggcagctctctgcagctgaggcaggtcttgaagcccttcctattttattatttttattttattttattttattttattttattttaggagatgggatctcactctgccacctgggccagagtgcagtcgtgtgatcataggtcactgcagcctcaaattccagggctcagtcaatcctcccacctccgcctcctgagtggctgggactataggtgcatgccaccgtgcctagctaattaaaaaatccttttcttgtagagatgggatttcactatgtttccaaacctggtcttgaactctcctggcctcaagtgatcctcccaccttggcctcccaaaatgttgggattacaggtgtgagccattgcatttggctgaagtccttcctttgaaggggacctgggcagcacatctccacagaaactctgtagggtcctgttcttggaagagcctagactggtcagaggtgggtgaatatgtccagacacaaagaaaaacctgggcacaggagatctatgagaggagagacggccgtgcaggatctggaagggagaagagtgggcctcagtctccctctctcctcagccagagtcagctctgctccagctcaggcacccttcaccaggagccaggcccagggctctgctcttgtactgtgtggtcacagcactcactaggtcagtccgggagggtctgcaggctggaatcacagggccgtgaaaacaaagtgctggtgaagcgggcatggggagggagcctggcctccctctgcaggagacaggctgtctgccaagcccggcacgctcttcatttgttcacctgcccatctgcccatccatccacccacccatccatctactcctggagtagatgccgcctcacttacccatgcattcattcacttattcattcactcctccgttcagtaaacactgactgggcactgactgtgtacccagcccggccaagggaacgtgggggtcaactggacatttggatcccgtggactcctagataaggctgtatgtgtgtggtgtgttttatgtgggtatgatgagtatgtggtgtgtgtgtaagctgtatatgtgtagtgagtgtgtgtggtgtgtgtttttgtattctgtgatgtgtgtgtaagctgtatgtgtgtagtgagtgtgtgtgtttttgtttgctgtggtgtgtgtgtaagctgtatgtgtgtagtgagtgtgtgtgtttttgtttgctgtgatgtgtgtgtaagctgtatgtgtgtagtgagtgtgtgtgtttttgtttgctgtggtgtgtgtgtaagctgtatgtgtgtagtgagtgtgtgtgtttttgtttgctgtggtgtgtgtgtaagctgtatgtgtgtagtgtgtatttttttatgctgtggtgtgtgtgtaagctgtatgtgtgtagtgtgtgtgtttttgtatgctgtagtgtgtgtgtaagttgtatgtgtgtagtgagtgtgtgtgtttttgtttgctgtggtgtgtgtgtaagctgtatgtgtgtagtgtgtgtgtttttgtatgctgtggtgtgtgtgtaagctgtatgtgtgtagtgtgtgtgtttttgtatgctgtagtgtgtgtgtaagttgtatgtgtgtagtgtgtgtgtttttgtatgctgtggtgtgtgtgtaagctgtatgtgtgtagtgtgtgtgtttttgtatgctgtggtgtgtgtgtaagctgtatgtgtgtagtgtgtgtgtttttgtatgctgtagtgtgtgtgtaagttgtatgtgtgtagtgagtgtgtgtgtttttgtttgctgtggtgtgtgtgtaagttgtatgtgtgtagtgagtgtgtgtttttgtatgctgtagtgtgtgtgtaagctgtatgtgtgtagtgagtgtgtgtgtttttgtatgctgtagtgtgtgtgtaagctgtatgtgtgtagtgagtgtgtgtgtttttgtttgctgtggtgtgtgtgtaagttgtatgtgtgtggtgagtgtgtgtgtttttgtatgctgtggtgtgtgtgtaagttgtatgtgtgtagtgtgtgtttttgtattctgtgatgtgtgtgtaagctgtatgtgtgtagtgagtgtgtgtgtttttgtatgctgtggtgtgtgtgtaagttgtatgtgtgtagtgagtgtgtgtgtttttgtatgctgtagtgtgtgttggccccaggtacccctgccattctccgcagtgtagcctgctgtataagaagcaggaggggcccagcaacagggcagcggaagcctcttgctatgacggtggcctcttcctattgtccccaagggcaggaggtggctgtgcagggacaagactgaggctggcgccaacatgcagcaaagccgggagtgcttatctggtggtagtgagggaagcggctgtgcaaggtcaccctggaatctggggtggagccacactcaggcctcccagcttccaaaccgagcattctcaattctacttctcttgctggttccatttacttgccttttttttttttggagacggagtcttgctctgtcgtccaggctagagtgcagtggcatgatcttggctcactacaagctctgcccctggggttcatgccattctcctgcctcagctccacaggagcccgccaccatgccctgctaatttttttgtatttttagtagagacggggtttcaccgtgttagccgggatggtctccatctcctgacctcgtgatcgcctgcttcagcctcccaaagtgctgggattacaggcgtgagctaccgcgcccagcccatttactggacttttatgacacaccaggcacattgtgcttcctctgtgtcctctcatgagtgtatacagcaactccatcacctccattttacagatgagggaaccgagcccccatgctttgagccactttgggcaaataccaaatctgcagaacagtgctaagtagtcattttcctccataagtgatatctgcatccagccaattctcagggacacagttcatatcttcaggaggaagggagccaggggatctgatttgctccaggttcacctgagcaaaagccttgctggcacctacccatctgcaccttttttttttttttttttttttgaggcagagtctggatctgtcgcccaggctggaatgcaatggcacgatctcatctcactgcaacgtccgcctcctgggttcaagcaattctcatgcctcagcctcccgagtagctgggattaaaggtgcacacgaccacccctggctaatttttgtagtttttgcagagatggggtttcaccacgttggccaggctggtgtcaaactcctggcctgaagtgatccactggcctcggcctcccaaaatgctgggattacaggtgtgagccaccactcccggccccatctgcatctttgacttgaagaagaagcaggtctttgccctgtacagttttaattgacagtccaggaagcctccctcatagagtaaacttctgtggacggctggaattaagggttaacagacatcagtcctgacccagcctgcttaaggccttcctaaggctttgcacctgcagagatacaggccgtgcctctctgagcaatgagtcttgcttctccttcacttcctggggcttctctcagctccacatggggcaaagagcagggagaaccctgctcagttctgtctagcccgactgggacgtggaaaggctaatccgagccccacttctgccactcagttgctgggcctcagtttccctggctgtacggagaaggtaagaatcccatcccggcttgtctagaggacgtgttagagtgaagatcctgggaacccagctgtcaggaacggtcaagggaaagaggcccgccccgctctgcctgccctcctccccaccacctccaaccctcgccctgctctttctccgcattcctggacctgaaaccagggtggcgtttctcgctgggacaggctggattctggaatctaggaggccttgaaataacatgttttccggaaaagtaccttccttaaaggaaactgcttgttccagggagtagaaaaggatcattgtaccttgccaggtccccattcccctgaggacatgacatttgaaaaggcagactcagttggagacagagacctgcaccccctgccctgtgcctccatccagcatattcgtaatagtgaaaagttagaaaccacctcgacaccagcaggagggggctgggctggcaaattgcaacacagccacagaatcaaatgctaggcaggtgttaacgacaatgaggtaaatttaaactcattaacctgaaagggcatttatcatgtgttggtaaattaaaagggaattagaggactataaatgtagctgcacccttagacgcatagaagacgatgtggagagctgtatgccgaggtgttgataggccattgtctctgggtgggtgggactgtttgtgcattttattttttatttacttacttttttttttttttgagatagaactttgctctctttgcccaggctggagtgcagtggcacgatctcggctcactgcatcctctgcctcctgggttcaagtgattctcctgcctcagcctcccaagtagctgggactacaggcaggcgctaccacacttggctaattttgtatttttagtagagacagggtttaaccatgttggccaggctggtcttgaactcctgacctcaggtgatctgcccacctcggcctcccaaagtgctgagattacaggcgtgagccactgcgccttgcctatttgtgcattttaaatgttttccctttgtgtttatctgaatttctcataatgaatgatttgctcttgaataagaaagagcaagaacctaacaaaggaacaaaagttattttaaaaattataaaacaaaccaactccaatctaagagatacaaaaacacagtcaggcatagacacaaaaatgggggcagatgaatttctcagaacagatacaatgataaggacacacacacacatacacacagacacacacctctcttctgcctaattcacatggctgaggtaggcaaggctggggagttgcaagcggtaggggtttgccaagtttccaggaacaccggagtctgggtgttggggtggctgctggagcttctgggcaggttgggtgggctgaggagagtacagggagcagcctggggctcactagcctgagtgagaggcctggctgtacgacacccagcctgcacctcctgggacagggtaaggctcctaatcccagctccccagttcaggcaagactgaggagcctgccaaagcaactcttccccatcccagcagtggagggagacagcagggtccacagctggggaggagcttcctggcaaccacctacgacttccaggctgaggccttgtcagctgcctacggaccccacttaggaagccagggctgtggtggctcatacagggaccctctgtccttgtcctcctgagatacaggcacagccacagccctggtgtggggcctggcctgaggcaaggggtggatgcatgtcctccatcatccccactgtcactgtgcttgcgcagacctcaccatgtcatctccttatgggcctccctggcctcacctcacccctgcccacccggccgccagagagctctttcttggacacagacctaactccttagagggctattgggtgggtctctgttcccaccttcagagttcgctatctgtggtaggcataataatcatccctcaaagatgtccatgtcctaatccctagaagctgagaaaatgttatgttcaccaaggggaattaagattgcagatgaaatcacagttgctaatcggtagaccttaaataagattatcccagattatctgggcaggcccaatgcagtaagaaatgtcccttcactgtggaggaggagggcagaggagtcagggcaggtgatgtaagaaagacctgaagacagaagcaggccaccagccaaggagtgtgagagtctctagaaaccagaaaggaaaagacaaggaaaagcattctccccagttgcctccagatgggaacatagccctgccaacatctttttttttttttttttttgagactgagtctcgctctgtcgcccgggctggagtgcagtggtgcgatctcggctcactgcaagctccgcctcccaggttcacgccattctcctgcctcaacctccccgcccggctagttttttgtatttttagtagagatggggtttcactgtgttagccaggatagtctcgatctcctgaccttgtgatccgcccgtctcagcctcccaaagtgctgggattacaggcgtgagccaccgcgcccggcctgccctgccaacattttgattttagcctagtgagtcctattttggtctctgatctccagaactataagataatacatttgtgttgttttaagccactatatttatgctaagttgttatagcaacaaagtattcttagctcaaccattagtgctcacaaagacttagccttgaattagctcctctagttaaatctattcctggccgccaagagacagagaaaggtggcctctgagggggtcaggtcttacagctgaagaaggctgttgggtctggagtatgggtgggctgaccacttagagatagggaagggagtcagaaattacatttcctagtaagtaggatgagagtgataatgtgacaattgtcaggccctgcaccaggtgttgggcaatgtgcaaacccagtcatccttatccttaccctacagaaacacccacgcaagtgtgcaagcatgtacgtccaaggttgttcttacagtattgtttctattagcaaaacattataaaaatccaagtacccatcaattgggaaatacataaagattatgatacagccacaaaaaatggaataataggcagccattacaaaaatgtactgacttggaaactgccctctatacatagagaaaaaacagcaagttacagaatggtctcataaaacaaaaacaaaaacaaacaaaccaaaaaacacttttcctcctcaagaaaacaaaaataagaacaaaaaaacctcctaaattacacatatgcgtatgtgtttgtatgaacctaggaaaatgtcaggaaggatgtgatggcctctgggggacaggcttggaggaagaaggaagcttatgttttacttcatatccttctgtcctgttccaccttatttgaacaagcatgtgttgctttttattacaatgttaaaaggaaaaatccttagactaactaagttcaacagtttacttgaccaattaaaatgattcaaaacaaagagaaacaaaaaacaatttgggaatcaggcagccccccagaaccaaaacaggttcagagaactttcagagaactcaggccaacaccatgatcaggcaacatttgtagatagagagagaacagaagtgagatacagagacaacttaattggttacagcttaattggttgattagttctacctaaacgtcttaccttattcaactcagctgacctactgtagttcattaagttcagctgtgtgactcactgaacctcaaccatttgcaagaatatattcctaaagtaattagtttcattaagcgtgatggcttcatattggtttggtctgctaggctcagtaaaggacactaattcaaatcaatggcctcctattttaacacataataacttttttaatgttaagataacacaggttaagaaagcaaacttgactgtcctgttctgtgacaaacagctgttatttgcaaaaaggactccctgggttgagggagaccagagctccacttagcaaggccactcaggaaacagatggaccaacttgagttctttttctgtgtgagctcatctggggaatgagacactgtggatcttctgagtggaaaagtggagtcattcaagccctcctggcttctacagaggtgagagctgaagttctgaaaggggaactgacatattcctctacattttatggcacttccagactaaaatataactttctggcctccatttcagtgaactttgaacttcctcaaaactcacactccccttttcgtaatccataatttttatgtgagggataaaattttctgttttacagcctgatcctggctacttacagaatggctgcactttaaacccaaggtgttctttgcaccctgtagccccagcccataaaagagacaaacactggcagagagatggtcccaggagagcagccgggaggaggcactggagttcagggctccagtcccagctctgctcatctggctcctatgacgagggttgtatccagtgtgtggacgtcccctctcctcaggctggaaaccctctgaggtcagtgcagagcctcggaatagcgacattgacatctgtctggcacataatggccttcaaggtgtcctaagtttacaaagctctttcccaggcatctctcagttgtctcccataacaagccttggggcccagtaaagcaggctgtattaaccgcagtttacggatgagggaaccaagacttagagacacaaaagtgacaggccccactccaagtcactcaacaaattggtcacaaagttcagcacaggaccatattatcccctctccttcagccagagcctcatttttgcctcttttatatcttctgtttcccaggtagattttgcttgataaaaaggggtctgctgctttaaaaggtttgaaagctccagaataatgtttccaaattccccgcgaatacttctgttcagtattcaggaatgagaaattgaaatttctgggaattcatgagcattcctgaaattatacattaaatttttttttttttggagacaggatcttactctgtcacccaggctggagtacagtggtacgatcatagctcactgcagcctcgaactcctgagctcaagtgaccctccttcctcagcctcccgagtagctgagactataggtacatgcctatagagtgtgcccctaacatcttcatgttagccattagggtgctcctggctattttgttttcttcttttctagagacagagtcttactatgtgaccaggctggttttgaactcctggcctcaagctatcttcctgcttcagcctttcaaagtgttgggatgacaggtgtgagtcactgcgcctggctcatattttctataacattatattcacatacttttaaataataatgaatgaccagaataataaacagttaataattgtcagtgacaaattgatgctaaaagttccagactttttccttaaggtttattattattatgaaccaatatgttgtgacaagattatttcaataacataaaaattatctccacctgatataggcactggatatagaaaacattaaaaaggagggaacattattgcaaaataaatgccagataaaaatcacttaaaaatggaaaaataatagcacaaacatttaattttaaaagttatttttaaaatgaacttttaaaacacaaagctttaattgctctatctgatagttttgatctttgttttgtgacaaatattctagatgtaggaaacttttttgttttttcatttttcattgatgttggttgagtgtgcccctaacatcttcaggttagccattagggtacatgttgttttatagaagctcatttcctttttaaatgatgctttatttttatttttactttttggtctgcttactctggtcttgattttgccattgagatcaatattgctcttgctaattcagattttagagcaatttctgatttccttctggagtgttctataacagcaatcacgtcttctttttgcatctcttctgttaaagtatttacaaagaactgtagcctataatgaatattcaacacgtggaaatgccagcaatcattactgggaagtgttcaaataactaacattcagactcactaacaaggttcatagaatcacttgttggaattgccagtttcaagacttattttgctttcaaaatttgttatttttttccgacactgctcataggacttgtataagtatcctatgtgtacaaacttaccaatatttgttttatttgcaaaaatgacttaccattagaagcagaccaggtcacaaacacacacttataaccagtgtgtgctggtaaactgactctcctggagaaaaaaaaaaaaacccttatatgtagggtttgccaaattctgaggggaggcataaatgttcccacaatggtcaatgcccagctaccgaggggatgtcactgagagctgggaagagcagcatacaactggctcttcttgagccagcgctagcccaccaccacctctaccctggcaacagcagtcggaagactgattagatgatggccttttctctcctctactccccagttccattcagaacttaactttcctatgggtgcctcagtattttctactctcgcttttgatttggtgtcagtggattcctttgaactagtcacatctagttcaacatgttgattgctaagctttaattctcacacaaaaacactcttaccaggttcctagatgtcttaacttctttttctcaggaattggcatttggaaaaacagtatttccgagaaatgctgggaaggaattcctgcataaaaacacaaatctggccgggcacggtggctcgtgcctgtattcccagcactttgggaggctgaggcaggtggatcatgaggtcaagagatcaagaccatcctggccagcatggtgaaaccccatctgtactaaaaatataaaaattagctgggcgtggtggtgcgcgcctgtagtcccagctactcgggaggctgaggcaggagaatcacttgaacccgggagatggaggttgcagtgagccgagattgtgccactgcactccagcctgggcaacagagggagactccatctcaaacaaagcaaaacaaaacacaacacaaatccaggaaacccaagtaaaacctatttgcttgactgatcgtgatcctactggatacattctcctgggtcccaattttggccaccgctcattttcattgatctcattttaaggggtttgaggtatggagtccttaggatttggtgttaagtttggtgatttttcagagaggccgcaccagagctgcatcggtgatcatttgactttatgtctgaccctgtgcacaggggtctacttgtctcctaacctcagttttcctctttttccttattagaaaaacaacaataacatcaacacagtccctcttggaactaggaatggccagtagaagtggtgtgtgacttctgggaaatgtccttaaatagaggcggaatactcttctttgttttttctcctttatctggccagaatgtagatataatggctggagctacagaagtcagattggaccagagtggccttgggagtagaagccccatttgggggaacaataagataaaaggggcctgggttcctgatactgtgggagcccatatcagtcctatactgccttcttccaggcttttataccaaagcaaaacagtcttatttaaaccactattgatatgtggttttctatcactcataactgaaacaaattaaacagcacaccagtgcattgtattctgttacatagtttatgggaggccattgttttggactagcctcctacactggccctagcagagcagatcaaaccagagcagagtcacctgtgctaactgccaagtcatcaaaccggactttgaaatgaggcagttttccaaaaacgcaggagcttccagtcaccctgaatcagcacaataaaaagtgccctctgctttaaccctataaggaaagcaactttgaaatgaccaatctgctttttgttccctgtttctgctttcttcagccctcttttatccataaagccaaacttctctgcccacttcactggaatactcattctatttcgtagaatgaggtgttgcctgattctagaatcacaaataaaagccaatttgatcattacaaataatttgttgtaattttgcctttgggaagttcctagtgaaagcaaaagctactagcaagaatccttgaaaggtttgtaatggaggtgaaaatgaaagactgtagcattacccagtgactcagagagtgtgggggaggcagctgcatctagtgataatggatgatacatttggaatagaagaggctgtggtttcatgcatgcctgtcttcccatctgccaagaaggctgatgaataagcttttatactcctctaagttggtaaaagaagttttcagatttttaatactcaaaggtcttttcacaaatgactatgaccttttcttttcttttcgagacagggtttcactcccgtcgcccaggctggaatgcagtggtgaaatctcggctcactgcaacctctgcctcctgggctcaaatgatcctctcgcctcagcctcctgagtagctgggactacaggcatgcagcactgcgcccagctaagttttgtattttttctagagacggaattttgccgtgttgcctaggctgctctggaactcctgagctcaagtgatccacctgccttggcctcctgaagtgctgggattacaggtcggagccactgcgcctggcctctatgcctgtggtctttagtttgtaggaaccagaccactcaaaggctggaacgtaccttattgctctgccagtgaatggtttaggaactggctgaaggagctggggattcagtctaggaagaacttacaggagttgggattgggtttgagagctgctttcacacatctaagtaaaaaagatttagccttcctcacagagggctctaggccaaaaccagaacccaaaggtggaggctgccaactttaccctaaattaaagagaaacctcctacccatcagaactggatggaggtagctttttgatagcaactctccactgctgggaatatttaatcaaaggatgcagaaggagtcattaactgagcagcagttcccatataccagcctatgtattggtacctacctgtctataacattttccaggtctcagccaggcacggtggctcatgcttgtaatcccagcactttgggaggctgaggtggaaggatctcttgagcccgggagttaccagcccgggcgacacagggagaccctgtctctacaaataatttaaaaattagccaggcatgatggtgcacacgtgtgtggtcccagctacttggaaggctgaggaggagaatcaattgagcccaggaggtcgaggctgcagtgagctgtgattgtgctactgcactccagcctgggtaacaaagcaagaccctgtctcaaaaaaaaaaaaaaaaaaaaaaagagagagagagagaaaaaaaggcaatgtagtacattttaaaaataaaactaaatatttgcaatttgaagtacattctctttattccaagattatgttctttctatttcaggaggtgttataatgtctttttttagtagtaggtggtattagctattgttgtttaacaccctaattagacaacataaaatcttggcaatcctatataattccattaaaatttacactggctataagatctagaagtctggtaatatggatgagatgacacctggttgtctgaattgaccttccaaggattagtagttcattcgagtgtctactagatgccatttttgtgtatttacagcaactagataatttcatggttcaaatcagagaaaccagtaatgtgatccacgtgcttatggtaacttaaactttattgactattcatttttgacacatatagctactttttgatagacatgaattttctatttgcatttaaaaacaaaactaattttcaaagttctattctcaaaatggcaatgatgacctttctaaatgctctctttaaataatcctccaatattctcagaaatttagtgtacctacagcaaactatttctcttagtaaaagccttctgtgagcaacttaactgtctgatgtctttatccgtgtgagcagggactgggtcctgtcctttttcttttttttttttgtttgagatggagtctccctctgttgccaagctggagtgcagtggcatgattttggctcactgcaacctccacctccagggttcaagtgattctcctgcctcagcctcccaaagtagctgggactacaagtatgcgccaccacgcctggctaatttttgtatttttagtagagacagggtttcaccatgttggccaggatggtctcgatctcttgacctcatgatcctcctgcctcggcctcccaaagtgctgaattacaggtgtgagccaccacgcctggcctggtcctgtccatttttacagagcagagagcatctagcatgccaccacattaatgtaatgataataatttccatttgtctagagacttatgctttacaaggcccttatagtttacttccccttaatggtagttcaagtagcagagaatgaccttttcattgtccttctctgtgataagccaaagtgaatgtaatgtacattcttcatagtgaaggctttctacctcattcatttattcacaaaatatttattgagcatgattatgtgttaagcactgaactgtgctctgtgctgctgggcactgtgtgttaggtacaaacacggcagatggagccccttcccccatgaaatgaacattctaatggggcgttagtcaataaacaaataaataaatagattgtcagggggtaatgagtgttatggggaagaataaagcagtgggagctgggaagcaatgggaggatgtcaatcttagggacatgagaaggcaccctcatgcagagacttgggcaacgtgaaggatcgccactgtgtgaccaactggaggaagcacgttccaagtcttgtggcagaaaggagcttggctgtttgagaatcagcagtgatatcagtgtggctggagggaagggaaggtgggacgagtgggtgggagataatttccagaggtggacaggatgcagattatatgggagtttggatttgattctcaagtgtgatgggacactattggagggttttgagctggggagagacatgccatgaaatgtgaagtctggcctgcagggaagcaggtacaccaactgaatgagttcaatttggagatatatatatttgagatggagttttgctcttgttgcccaggctggagtgcaatggcacgatctcagctcaccgcaacctccgcctcctggattcaagcaattctcctgcctcagcctcccgagtagctgggattacaggtgtgtgccactacgctcggctaattttgtatttttttagtagagatggggtttcttcatgttggtcaggctggtctcgaactcccaacctcaggtgatccgcccacctcggcctcccaaagcgctgggattacaggtgtgagccaccgtgcccggcccaatttggatatattttaaaggactacctgatgcgttaaatgtagaagatgggggaatgtagaatgctccacagagttttgtcctgagcagccaggtgagtggcgatgcttttatttacttacatgagaagaattgggaaggaatacgttagaagaggagacttgagaaaccaagagtaaatgttttggattagtattaattaaattggaaaagtctatgacacatcgaagttcagatgtcagataggcaggtggttattcaagtctgaacttaagaaggatgggttagggctggcaaagttgctatgagatccatccttgtggatctctgctgcctggtcagcttagatacagtagaagccatttaacttattctaatggcacctagaaatttagcatgatctcctaatatcttcactacatttcatctggaatatttactacattctacatctactgaaactatcagacattagaccaatacatttcaaaatacagaaagtataatttgaaaagttaaagaatatgattttctattgaatttacttagcttatttagaagtcactttgtttctgaatgacagctgtatcaacatgacagcactttccttgaggatccacaggtaagagctttgtggtgcagatacctgttgagccagcagtctctttctagaattcaatcctaaggaaataatcaaagactggatcattttctcaacaaagatgttcatctcgtcattatttgtaaaacaaacattggaaacaaagtaaccaccaataaatagtagattcaataattatagcataggacaggcacagtggctcacgcctgtaatcccagcactttgggaggccgaggggggcggattgcctgagctcaggagttcgcaaccagcctgggcaacacggtgaaaccccatctctgctaaaatacaaaaaaattagccaggcatggcagagtgcgcctgtagtctcagctactcgggaggctgaggcaggagaattgctttaacccaggaagcagaggtttcagtgagccgagattgcaccactgtactccagcctgggcgacagagcaagactcatctcagaaaaaacaaacaaaaaaaattatggcatattgataaaatggaaaattattcacacattaaaatgatgtcaacaagttttttgtaacatagtaggtatagttatgatatgaaattaagtgaatcataagatataaatgtgcacatacaatatgatctcaattacataaaaatatgcatgtataaaaaatgaccagacagaaggaaatgacttcaaaatgtttagagctattaaccacaggggatggaattccttcttatatttttgtccaatcttcctatcatgggcatgtattatttagtattctgaaaaaaatccagcatttggattgaaggcaatgaaaaagaaacaggaaaatagaactagatttggcctgggatttgggactgtggtcctggtttgccttccctcccactttgagcagagggaatgccatgctttctctaagcccaagatttctcacctgcaaaatgtggacaagcatcctgccctgtctcccgcttggggctggtgaaaagattcagtggttatgccagccaaagggctgatcacagacacagttcaaagtttggaatgtgaagtgtccgccccaaagttccaggatgtcctgcttcctgaagagcacagttagtccaggaaagaaactgaaggggagcaaagttcacagcccctttgggcatcgtgtccagggtcccctaggaggtgggtcttccagcgtccacgacatgtgagcccagtcccgactccttcgtgccttagggttggtagttagatgggagagacctcagcgatcacctgataataatacttgttttatagttatatttagtgaaaattcacaagtgtcaggattgatgccttttactcattttgttcaccattttgttcatgaattccacccaatatctacctgtgtagttggagttattaaattcattgttatatggcagaatttccctttcgtaaggcctgacgcacaccaactcctgcttttgggatgagtgagattcacacgaagctgggataacaaaagtttgccttctgtaagacaactcaaagctcagagagagacagagatgctgggggcataataacgtaaatctaagtgatgtactacgaggcaatcactggagctgtgctaaaagtctgactgtctctgggtgcttgaggcttaggttgttttctttcatctcctcctttgtgttcacccatttgaaatcatctccattcaggagaaaacaagatggaacccagtgactggccaccatggacacatgcaagggagaaggagaagtccccagtaggaaaaggaatgtgtacaatgaaatgtaatgatgtataatacattggctgtttttgaattccaaccatggatttcccagctactggcagtgaaactgatcttttctgtgacacgcctgtccccctttgtcttctgccatgagtggaaacttcctgaggcctcaccagaagctgagcagatgctggtaccaaacttgtacagcctgtagaaccacaaggcaaataaatctctttttgaaaatagattacccagtctcagatattcctttatggcaatgcaaaatggactaacacacagccctaaacctaattaaacccctagaaaccattacatcctccaaagtaatcaattcccccaaaactaatcataccccttcccctaagcactcccaatcaccaagttaaccactagccatgatccaccaatcatccatgaaacaaatgtcattgtggcagagaccactaatctttcaatatccatttttcacttcctcatttcaccaataaaaccctctacattttagctgagcacatgacctcacagacagatatgatatctcctgcaatcctttgcatctgggtaaggccatatgactaacttctgggt

SEQ ID NO: 2440 - DNA, 528 bp, Homo sapiens
cttaggtcgagggaccaggccccacaagagtgtcacaggcagatcccagtgcctgcttggatttcccatttgccttccctcagaggacacgttgctatcagtgcctggctccagcgctgaacaagaaatccaaacagatcggcagaaaagcagcagaaaagaaaagatcttctaaggtaagggcagggaagttctgggagttctcattgttggggtgagactggacttaaagaaggaggacccccaacctctggctaggaactaaatgaaagatttttcaggcctatattaacaaaagaaactgaaagctactaaagacttcctggcttgagctctgagccagacacccacagaagcccagggagctgaagtccactgagcaaaataggttacgaaaagcagcttcctctactagttagcccctgcctgaaatttcaccatcactcatacttttggatgaatgtggtgtttcccaaacctcagtcatttcagaaccacatttataactttgccatatctgagttccac

SEQ ID NO: 2441 - DNA, 981 bp, Homo sapiens
agcttttccaactcagtccttttgggtaattatggtcattatgtagacatgactgattatggttatagtaatcgaaggggattatttccaagactcccacagatactaaaatctaggtcctacagttgaccattggtgatcagctcaaccttcagcttgtctcccctccctagagattaagaaatgtggctaaaagttccaactctctaatcatgccctagtttttctgaccaatccccatcctgaagctatttaggggccaccagtcatctcattagtgtacaaaagatactcttaccactctagaaatgcctcatattttaggagctgtatgatgggaaccagggcagaaattaaatatagatttttaaaaattataccacagtataaatagttttattggaacacagctatgctcattcatttacgtattatgtggatattttcatgctaccatagcagagctgaataattgtattggagaatgtgtggcccacaaagcttgactatctggccctatacagaagaagtttgctgatctctgacttagctgcctaggaatagccaggcaaccagctgctactttgagcacccggctaaaataagcagagacaactggaaggcttgatgtgaaaaagagctgttgaagtgtacacaagcaagctgactgccttatgactaatacttgacagaacccagcaagaggatatgagattgcagatggatgacctcaatcctgaacagaaaggcgtgcatgataatggagagaaaaaagccaatggggaaaaaaaacccaccactatttttttaatagcctaacacacacacaaaaaactggttttcctttttctgtaatgtgtctgtagagctggctattctgattaaagttgcccttgaaaaagcaattaacttaagagtcttactggaagttaaaaatcccaaggggcaggaaaaatgagtgtatgggaagcccagtcaaca

SEQ ID NO: 2442 - DNA, 3881 bp, Homo sapiens
gatttctgtggccatgtcatgaattgtatgcctccagaggacagttctgttttttccctctgtttggtatttggtggtcatttcatgataagcagaaagaaaactttgggatagtgctattctctgctgaaggacggatttacctgaatgatcttccaattttgagtctgggtagaatctagggtcctaagtcttaagtgtctgcaaattcattttaccaggcaagatagacttctttttgcttcttcatggtgaagatccttgcaataatctcagatcctcaggctggaagccggtgcattaccccatgatgtacttctttcactaacccatcaacttctatactaccagtgtaacactcttctcaaccggactgcctcatatggggatataggcttgccatctttgtgtttattttttaaaacaattgtttgagtttccatccaggttttcttcaaagggaagaaatttcccctaaattaccaagccagtttcctctcataaggcattggattaagagtggccagtagctgagttttgtgattctgaggataagtaataagtcaaaaagagctgttggctaatcctttagaaggatactaaaagaagagtaagatgatcgtaagcttcctagatccaggctgttaaaatgacctccatattaccaagacttgtcagtactgttaagggaaaaaagaggggaacccctatatataaaaccacaatcttgtttcatctataatacccctggtccccctccttcatctacactgccacccccacctacacccaccacttgatcattttatagcagatattttattacatttttgaaagcaaaggaaacataagacaggtgtactattttaagattatattaacatatttcatgtttctttaatgccccaacacacacacacatacacacacacacacacatacacacacaccaagagctgatcacttgaacaaatcattaaccaattgacttgcttcccatttctggtataagcttctgtaccagtgctttatattaattaccaaaaccctcctgcagacagagcatgatacatctttagtataggatgatgcaataaaatgtttatgctgtgaaatttggggacaaaatttttcatcatggcataatgtgcatgtatgggcacacatagctttgtttgtttattcttttttcagaagtccttccaattctaaaatgtattgtagtctgacagtgcctctaatattggtaattctttttaagtttataacttttcccgagtttgtttctgcactttaaggtttcttaactaggttatttctagttgagctgtaatttcagtgtatagttctccagagtgtttgtgctaagtgctgaagtttcattattttaaagctacctccctgaaagtatattacaaatgttctacaattgtaatatagtgattcacacacaaaaaaatccctattatcagcatacctaaactacacactaaatatttaagaaaaaaaaagtggaaacattagtagcttttatactggaatcttgccatttctttttcaatttagaatagaatttggttgtcttatcttggtactctgtgcttcatgacatatctgaaagcattcttttggcatggatctggaagatagttttagagccagacatcagtgtagtagttctcaagatactgaaaattcataacattcttatgggtataataaaaaatgtttacatattgaattctatgaattctataatataaagtaggagcacacttactatgtgaaatataactcctatgcaatataaaagtaaaattataagcatatttccataaacagtaaaagctattaaatctaagcatgattgacaatttcaaatgttccaatatcatttaggcataatacttcaaagatttcaagccctttttctgctagcattcagaaaagtagaggacaagaaaggatgaagaaaagcttacagtgaaaaaatcttaaaattgagagaattcaatctattaactttaatctataaaccttttttctccgaactgggtacattggcatcattatttgattttagcagcaaacatttgggtttagcttatggaaggcagatgtcctgtgggaacgtgacttgaagtcaccatataacttcccgctaaataaacatctgaactgtaacttgacagctaccaagtgaggtcaagtgtctgaaagtgctgtgtacaccacataagcacgttttccttatgtgaaggatgcatttctagcaatgtgtatcagactttcaagtactcaaaacatacttgctgccaaactttgccacccaccactaacctccatttgatccttagaaggtagaaacttattttacaatagaaaaagagattattttatttgtatgatgtccctaaaattatttcttggtattgatagacctaggtttatcttatttcaagtttgccttattttttaagaggtttattgagatataactcacatacatgcaatttacccatttaaagtgtacaatttaatggcttctagtatatttacagagttgtgcatccatcatcacaatcaattttaggacatttttatcaccccagaaataaagcctgcattcgttggccatcaccccccgattcccccaagccctcagccccaggcaaactctagtctactttctttctctatagatctacctattatgaacatgtcatgtaagtgatatcattcaatatatggtcctttgtgactggcttttttcactcagcacaatgttttcaagattcatccatggtgttgtatatatcagtacttcgttcctttttatagctgaataataatatgatacatacatattgcatatacatgtccatattccatatatgacatgtccatataatggaatattatccattcattagttagatatttgggtttttcctattttttggtttggtttggtttttgctattataaataaggctgctttgaacattcatggacatacattttcatttctcttgtgtatttacttaggaatagaattgctgggtcatatgataactcttcttagccttttgaagaattaccatgccattttccaaagtggctgcactattttacatccccagcagcagtgtatgagtgttctaatttctccactttcttaccaacacttcttattatctgtcttttagttattattcatctttttatcagggtgggtattaaatgctgtctcactgtggtttgatttgcacttctctgaaggctaataatgtcaagtatatttttatgtgcctattagtcattcatacatcttctttagagaaatgtctattcagatcctttgcccattttttaatgggggtggctttttgttattgaattgtaatcgttctttatatattaaacttacaccttgtaaaaacgctgggcactagactatacagggattactgtaccacttgtcataaatcatagctatggtcctccttgagaagaattccttactgtagttaacacctgctctaaataagcactctgaagtgcttcttacaaagggtaacgtgggccaggcacggtggctcacacctgtaatcccaccactttgggtggccgaggcgggtggatcatgaggtcaagagttcgagaccagcctggccaacatggtaaaaccaagtctctactaaagataccaaaaaatagccaggcgtggtggcatgagcctgtaatcccagctactcgagaggctgaggcaggagaattgcttgaacctgggaggtggaggttgcagtgagccaagattgggccattgcattctgttaagccattgcactccagcctgggcaacagggcaagactccgtc

SEQ ID NO: 2443 - DNA, 442 bp, Homo sapiens
ctggcatacgattactgtccagagctctggaagaatgctagccttgcacagatattttctttgcctggttaggctgtcaaacaccctgacctcgtcaatgttttaaagggtaggagttgttacagttctcagtcccctaagaggctgaccaagtgctgagaggggctcccagcttctctgcattctggaaaacccactgcagagccccgccctagtgtgcttccggagcttctaatgcacttctctattacttcaagaacactgtgtataataataaactctacagaaataaaccaaatcacaagaagctttcaggtctggaggctgacatttctcaagacagatgcaaaaacccaggcccagagagatgaagaaacctggctaaggtaacatgtaagttagtgtcaaaatcaggataaaacccagatcttctgactcttag

SEQ ID NO: 2444 - DNA, 1779 bp, Homo sapiens
aaagtgctgggattacaggcgtgagccaccgcacccagcctattcccctattcttaaacatgagggaaaaaaggttgccagacatctaaggaactctactaggatgaaaaagagactataaagaaatagaagggctgggcgcagtggctcacatctgtaatcccagcacattgggaggccgaggcggatcatacagtcaggagttcgagaccagcctggccaacatagtgaaaccccatctctactaaaaatacaaaaattagctgggcatggtggcgcgcgcctgtagtcccagttactcgggaagctgaggcaggagaatcactcgaacccgagaggcggaggttatggtgagctgagatcatgccactgcactccagcctgggcaacagagcaagactccgtctcaaaaaaaaaaaaaaaaaaaaaaagaaataggaggctccgtccagtaggtcattcctgaaatcccagcactttgggaggctgaggcagggaggattgcttgagctcacgcattcaagagcagcctgggtaacatattgagaccctgttggtacaaaaataatttttttaattagcgggccatggtggtagtcctagttactcaggaagctgaggcaggagtacttgagctcaggaggagcacctgagctcaggggttctagggtgcaggctgcagtaagccatgatcatgccactgcacaccagcctgggcaacaaagcaagaccctgtcttaagaaaaaaagaaaaatatgcagagctaaagcatatttagctttggggaaaaaaatgtatgtgtattcctgataaagttggctacataaaaaactaaaacatacagcaaaaacaagtaaataccagaatgccatatcactctttatacccattaagatggctacaataaaaaagatggaaaataagcgtgagaatgtagagaaactgctatcctcatacactgttgtagaaacgtaaaatggtacagctactctggaaagaagcatgacagttcctcaagaagttaagtgttgaattaccatatgacctagcaattctattcctaggtatatactaaaaagaactgaaaaatgtatgttcacacaaaaatttgtgaatgcatgttcaaaacagctgttgtggtctaaattcatgttgaaacttaatcatcgatatggtggtattaagagggtggggcctttgcagcatgagccactgtgcctggctccctaaaggggtaaattttatggtatgtgaattatatctcaatttaaaaaataaatgtaaagtcaataattagctgaaaacgtgcaacatgaaaaaccagtgtcaattcctcaatattcaaagaactattgcaagtcaccaggaaaaaaaaaaaaatacacagctcaataagaaaaatggggctgggcacagtggctcacatctataatcccagcactttgggaggtcgaggtgggaggactgcttgagcccaggaatttgagaccagcctgggcaatacagtgaaacaaacctctcccaccaatcagccaaaaaaaaaaaaaaaggacaaaggacatgaatatgcagttcataggtaaagaaaaacaataatgaataacaatgtgacaccagtttttaactatcagattggtaaagattaaaaactttgaaaataatcagtattgggagttagtaggaggaaaaactctcaaactactagtaggacattcaattggtatagttgctttggcaaggctaatttgacaatatctactccaactaaaaaagcagag

SEQ ID NO: 2445 - DNA, 1631 bp, Homo sapiens
tccacattccagctaccagggagcagacagagggactatccagctctctgtggcctcctcagaaagagatgagagactcaagaccccaggacatgaaatcacttacctggaatggcatggtcaataaaggcagattatggcagtggcaatgtattaagaggagtatcaatgggaattgaagatccaagcaagttaaatatgtgggtggagggatacaaaaacgttgaatgagattctaacattttaggctatttacaacagcacagtgagtcaggggagggtccagtggaaagcgactggagacacatccggcagacaggcagaaatgtcagtttcacctcaaagttgtggcagaagtagtctgagccaagaagcacaggcattcctggggtcagcagatcagggcagaaaggtaagctgggaacaaagtgacattgaccttgaacattaggcaagggcttatcttcgaggctgatgcttcccagtcagtgcttcccagccttcctcattaccatggcacatacagaaagcaaatatgtgtgcatctcactgggcagtgactgagtgggctacctcccaggcctgttcctgcagtgccccttggttcttcatgagactattcagggtgtttttctgggcaagtaactccaaaggcaagcatgagagcagctcgaagacttaagaacatgtcacaggactgggaggaatggaaggtgtcacatcagaataacaatagctcttgacaaatggatgcacagccattcccataaacaggaatttccctgcaggaaaacttcctcccatgggatcttcaatttgatgaaagcaattacaggacaaagaggctgatttcccctgcatctgctgaggtgaagccagtgctaaggtttcacttatactgaagaaattcttggtttcctccagaacagaacaccctgaaatatgaagctaatctcatcagagggacaggcaccttaccaagatgaaaattccttaagatttatttgcccagccttaaagcttagacaacttattaagagttacaatagttttgtcaaaaatgacagccttcagtgcttcacagaagccataaaaaaaacaaagtccaataccgatgtgttttcgttaactgaaaatatcagtgaccaacaaatacaaagtttcattagaaatcatcaagaaaaaccaggcttgggaagataaattccttgatgcccatgttttaaaaatgatcctgtctgtggattaaactgcaagtcatttgggccattgctcagccgaaaagacaaatgtttcagagtagaaggccactctcctctggcctcaatgaaaacgcatgtcaccttccggctacagacccaggtggccgcctaccaccttgcattctcaggagcaatgcccacctgtgcacaacacatgaaagaacatgttcacggaacacctactgtatggccaccactatgctaaaaatttttcagaaggtttctcattttgaactcagaataaagagttatttatacacattatgactgtttacccattataaaaatgtaggctcagaaaacttagtacttgctccagtacacagagccaagcagctaagctccaagaatttacactacacacacacc

SEQ ID NO: 2446 - DNA, 819 bp, Homo sapiens
cttgtacaagagcagatgtgcctctattaatagctactatgtaaagaggcctacaattagagactgtgacatttggcaaacatatttcatttctaatcctctcaatactgcaaaatatctgccgtcatctttttcttcggcaaggcaactgagctgcagacgcagagacgcagatctttgtgaagaccctcacgggcaagaccatcactcttgacgtcaagccaagtgacaccattgagaatgtcaaagccaaaattcaagacaaggaggtatcccacctgaccagcagcatctgatacttgctggcaaacagctggaggatggccgaactctctcagactgcaacatctggaaagagtccaccctgcacctggtgctgcgcctgtaaggtggcattattgagccttccctctgccagctctcccagaaatacaactgtgacaagatgatctgccgcaagtgctatgcttgcctgcacccccgtgctgtcaactgctgcaagaggtgtgaccacaccaacaacctgtaacccaagaaggtcaaggctcttccttcctcgaacggcagcctccctggagcctcaataaagtgtgtctctttcgttgactggagcagcaaaaacaaacaaacaaaaaaacaatactacaaaatatgttatagctccattttacagatgaggaagctgaagcccatagaaatactggttttgagttctggtgttttctgaacagtgtggccaaagctacaggggacaaaagagatgatcagaggaccagcagtcttggcctctgggagattgctggacatgcagaatcacgg

SEQ ID NO: 2447 - DNA, 1269 bp, Homo sapiens
cccggatttgccgccgcgcttgggaagccgccaccgccgccgctgctgcatggcactaggctcccggcggggcaggttccgcagccggcaccgctctggctaggcgcacggaggcgccttgcttagtctgacccttatttggccaggcgtaaaacttgtcctgcctaaaagcctactgagacctcctaactggtctaatccgcgggagacgccaaaggcggcggccgtttgtgcgcacaggatttttcttggagctgtagcagtctaggaagccagggtggaacttttgctaagctcccgttgtaagcccagagctgtaataactgctgagacacaaccagcagtatacaggctccagttggaaatcgagaactttccagggctgtcacccaggctggagtgcagtggtgccatcacagctcactgcagcctcgacctcctaggctaaagtgatcctcccaactcagcctcccgtagctgggactacaggaatgtgccacgcccagatggtaaactcctgcaaagcagattgtttggttcttcttccttcacggtgcctgacccatcgttctgcagatattagtcaccacttgtcttgagtggctacctggggttaagaaaaaagctctgccctgaatgccaatgggaaggacagctgttgcagctcctgagtgcaggccaaggaaggcattcaccttcatgaaaaccaggactactgtgcatgacaatgaactactggatagagactgatgcctttaagatagtcctactttcaatcttctatcatggagaatatccaatcaaatgagaagtggaacaagtcaaaacatgttccaggcaaaatgaaggaacaaggatgactggtggagagtaagcagtctgcatggtgtgatggctggctgaggtggtcttgtggatctgcgacactggaggaagtgctgtcctgggaggaaagtctggcaaagcaagcctggatcagtggaagggcttgagcagcaggctgagcagtatgggctttggactacagagaactccaggtgaggaaggaagaaacatggttagactacagtgatgccatttccttatgtaagcatttgacttcagaaattgaaactggccatgattattgagtaggcacggcagttcagctgaaggatgatcaatggacttcaactcagatgcagatcttgactgacagaagataattatcattcaagctaatggggaacttgaattggactcaatggtgttagaaagtgaagaaaggct

SEQ ID NO: 2448 - DNA, 8343 bp, Homo sapiens
gcctcggcctcccaaagtgctgctctttgtcttcttataaggacatcagtcctatgagattagggttctacccttgtgaccttatttaaccttaatgattttttttaagggctcttctccaaatacgttgggattgggcagcacaaaatgaatttggggaagggaagaacacgattccattcataacatgtatcttttggaatacccccaaaatattggcttttctacttcaggtcaagcatttcatgataattgttataaaatgtttactaattgtgataatcacagaaagttaatttttaattcacaagaccatctcagtattatcatattataagaattttatgctttgcccccaagaaaaacaatgcagaaagattgtaacacaatatatttagcatatttatgttgaaaggagaatgtgaatgggtctgctcccttctttaagtaagctcagtcccccttcttgggactatgcctttcataattcttgctacgttataaagaaggattacaagatgggctcacatatagggaaatttctccttataataatggtaacagtacaggaatagcagagtagctagtatcagactaaacctcttgtagacattaattacaaactcttgtaaacattaattacaaattacaagaaaaaaatacaaacacatacacaactatttgaaagcattataaaatgatcaaaagcaggtaggaactgaaaaggaattcaactcttgaaaggagaaacggcactcaataagatccatatttatatatattttcccctaaggccatagagcaattagaacacaaacagaaagccacatttttattggcttaagtatcagaggacagaatttgaggatgctgataattggaaactttgtaaataaatccacaaaggagggtgccatagagaggcaagacttaaaatcttgatatagactagttttaaacttttggataaccccaaactgcacatgtctagggcagagtccaaggaagacagggaacggcaatggaagtaaggttttaaaagctgggcaagtaatctagctgttgactacatcatagaaaatggattttgaagtttaactttagtccagttgaaggggcttagtaaatgcctcgagctttccattgaaataccagaacaatcataatttttgattctaataatagtctactttctatcattgaattatatatcctaagactaagagcaaagctaaacactaagattatgggtaaaaccttccctaacaaagtataaaatgcaagccttgacaagttcaaggtgatcagctagtaacttcactgactgggcacataaaaattaacacttctcagagagatatttaaaaatcctaagtctctataatgcatcattcacagtgtgcactcaaaaagtactagacatgccaagaaataaaagagtaaaacccctattcaaaagaaaaaagaatcaatagaaaaaggtctccaattggcctggatgttaaaattagcaggcaaggactttaaaagaaataatcataaagatgttcatgacttaaagaaaaggattatcaaaatgagtgaacagatgggcaaatctcagcagagaaacaaaattatataaaagaaccaaataacaattctatgactttattagtcatcagggaagtgcaaattacaaacaccatgaaataccatttcacacccttagaatagctacaatttaaaaggtagcaacaccaagtgttggcaaggatgtagagcaaccagaactttcatacacggctaggaagagtaaaaaagataaagccactttggaaacaagttttgtcactttcttataaagtaaaatatatacctatcctaggaaatcccaacttttccactcttagatatttattaaaaaacaaataaaaaaatatgtctacataaatattgcaaacaaatgttaacagaaacaactcaaatgttcattagcgggttattagataattaattatgatctgtttatacaatggaatactacccagcaatagaaaaagaatgtactattatacaacaacatgaataaatatgaaagacatcatgttgtttgaaagaagccagatgcaaaggagcacactgtatccttccttttataagaagttcaacaataaacaaaatatccctatactgacacaatcagaatattgattgcatatggggagcagagattgattggaagggacatagtgtaacctcctggaatgattaaaaaatgttctatatcttgtttaaattgatgcttacatggctgtattcatctattgaaactcaccaccatgtatgtatattttatctgaattttaaaaatggtatcagaaagcatctgcagactatatattcacttataaaatttaaattcctgaagaccattagagaatatgaacccactgcatttaattactctccatgaaaaatcattgctgtatatagttgtccatgtgatcaaacataaatactaaatatagaaagcaatgtgaatacaaaaaaagaaaaaggaacaagaaattttccagtcttacaaaatagtgcttacttgggaaagggaaactacagatattttctgttccttgttaaaattctttttgccttcagaaatttacattataagtgggagagaattcaaattgttccactcctttggaatgggttctgggtccagctaagcagagtaaattattataacatagcattttaaattgcatattcattgtatcctaaaatcttataagttaaaaaaatagtgacaaattgaaagttaactcacttatattctgatttttaaaaagttgtcactagaggtacatgatttttaaaaaagacaataaggagtgtgtgattctaaagcaactgttctcaaccctagctatacaatagaatcacctggccacattataaaatactatttaccaggacttgagccttattaattaaagcagaatctttatgaggaaagactttttttctattttatttactgttacatccccagagcttaaaacagtgcctggcacatagtaggctcaatgaatatttgatgaatgaatgaatgaatgaatgaatgaatgaatgataaacaagtttttgaaagccaaggaatcattttggtcttatacataatggcagaattcctttaggtgatgtagaatgaaggaatgccaagctgttattttattaaaatgtttgataatttgtgttaactttagctgaaaattaagtttttattgaaatttcctatggatcaggtttcatgctagagtaaggtttataaatgtgaaaagacgtgaacgtgcatttgggaaattcccagtctattatggattagtggcaaagagaaagtctagcatataagcattcacccattaatccattgattagcacttatttattaagtgcttattatgtgccatacacatatgtgctaggatacactgtggcaaacaagacaaatataatacctgtcctcaagcagcttactgtttagtaaaggagaaagataataaataaggaaacaaataataaaatttttgatgaatttgatgacctaaatgagtacaatggtgttatgtattaacagaattttggtcaggtggagagcactattttatattggatggtcagaaaatacctctctagggaggaaacatttgtgtggagacattcacgatgaaaagaagccaacaaagcaaagtgctaaggggagagagtttctagcagaagaaaaaatatgttcaaaatagttgaagtagaaaagaacttggcatgttcaaggacctgagagaatccaattgctggaacataaatagaaagtagaacaagttgaaagtggaataaaaggtggggttataaaatgcacagcctggtaggccatggtaaacagtttgaattttattaagtacaacatgaatctattaaatagttttaggcaaagaaatggcatgttgcaatttgtgtacttaaaagattatttctttttccatatgtagaatagactcaagtgtggacaaaagtggaggcttgtagactagttaggaagcctttgcagaagtccaggtgagagatgatagaggcaatacattgctgcaatcactgtggcaaaggggaaaagtgagcagctcagaatatatttggaaggaattgttaggacttggtgagggattgagtggatgaaagagaacgaagaatcaacatgaaccccagagttctggcttatacaaatggaaggattgaggaaatatctgcatagatgagaaaaaatatgtcaactccaccatttaaaatttggatagaaaaggaaccaactaggagtaaccagagagggaggaaaaaaaaaaccctagagcatgaggaatctcagaatctaaaaatctcccttaaaaactagagtatttcaagaaggaagaagtgatcaaatacgctcagtggtgctaagcagctaagataagggcagaaaagaatcccctgaatatggcaaaatgaagattatcggtaatcctaactgaagcaatttcagtagagtgagtgaaataaaattcagataggagtaggcttaaaagtgaatgggaagcaaggcagttgaagaagctgaagtagacaactctttcaagtttagttttgaagggaagcagaaaagtgaaatgagagctggaggaaactattactgaagaggagataccagagaatatttgtgcattgatgggaatgctctagtatagacaaaaagatcgatgattccgggaaagagggaccgtcaattaagaagtcaaagagaggagcatagtatattaggatgttctcaaaagaatgtgacaccgactcacaccagtcagaatggctactattccccccaccccaccccaccctgagacggagtcttgctctgtcgcccaggctggagtgcagtggcatgatctcggctcacggcaacctccgcctcctgggttcaagcgattctcttgcctcagcctcccaagtagcgggattatagatgcctgccaccacgccttgctaatttttgtatttttagtagagttgcaaataacagaggtatacataggtgaacttaacaacaaaaaataaataaacaataaacttaagggggctgttcaataaaagggtacaggtatactatagaatccaagagtgggaatacaatgacaacctgagaagaggctagaatattgccagtcctttgtcaataatttatccttttctttcccagtctgtttccttcttctccattccacatattataatgtggcaactacataactcataattatagtctttatagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccaggtaaataacttctcaaatagatttttttaagcatctgtataagttcaagatgtacatcacttcatgtagaataacatctcctaaaaagaactgaaatgcctcagtatacaaccagctgacctggctatcaaacacttatttagcacatattacatgatggacactttgatgtagatacggaccttgggttgtgtcctcaaggatcatacagtgggttgaggaaataggatatgctatccataggaaagtaaataataatatgacagcttattttcaatgagaagtgaatagtacaaagaataggagttgccagatttcaaaaggaaagagctatcacacagaggcggaacaattagaaatttttcatgaaggaagtgttctttgtgctggacctttgagaaagtatagaatgtagattagcaaaaaggcatggaaaaggcatgataggtaggagaggcaagttaggcaaaggtccattagaattgctcaagatataatagaccaacttggcctgaaaaaggcctggaagtatcctcttttgtgctctgtgagaagtttgccaccatgtaaaaagtctaactaccctaaggcaaccatgctctgagaagcccaacctatccaggtggagaggtcctgtagagaattgaggccactggccctgagctcccagttgaaatagacaatatcaacatgtcagcagggtgaatgagaccatcttggaagtgggtcctccaagagtagttgagccatcctgcctaaatttcagcattttgagcaaataaatgatttataccattttaaatcactatatttttgagtgaatcactgacttttttctcaattaagcataggtttagaaactatgaaaaccctagaagaaaacctaggcaatgccattcaggacataggcacggacaaagatttcatgacgaagacgccaaaaacaactgcaacaaaagcaaaaattgacagatgggatctcattaaactaaagagcttccatacagcaaaagaagctaccatgagagtgaacagacaacctatagaaagggagaaaaattttgcaatctgttcatctgacaaaggtctaatatccagcatctacaaggaacttaaataaatttacaagaaaaaaacaaacccattagaaaatgggcaaaggacatgaaaagatacttctcaaaagacatacatgtggccaacaatcatacaaaaaaaacctcaacatcactgatgattagaaaaatgctaatcaaaaccacaacgagataccatctcatacctgtcagaatggctattaataaaaagttaaaaaacaacagatgctggtgaggttgttgagaaaaaggaatactgttatactgttggtgggaatgtaaattagttcaaccattgtgggagacagtgtggcatttcctcaaagacctagaggcagaaataccatttgactcagcaatcacgttactggatatatacccaaaggaatataaatcattctattataaagatacatgcatgcgcatgttcactgcagcattattcacaatagcaaagacatggaatcaacccaaatgcccatcaataacacactagataaagaaaatgtggtatatatacaccatggaatactattcagccataaaaaggaatgaaatcaagtcctttgcaggaacatgaatgaagctgaaggccatcatcttcagcaaactaacacaggaacagaaaataaaataccacatattctcacttacaactgggagctgaatgatgagaacatatggacacatataggggcacaacacacactggggcctgttggagggtgctggggggaggaggcagagcatcaggaagaatagctaatggattctgggcttaatacctaagtgatgagatgatctgtgcagcaaactaccatagtacatgtttacctatgtaacaaacctgtacgtcctgcacatgtacccctgaacattaaaaaagtgtgtttaaattgtgagataaggattcaagagggcctcttgcttcactattgttcactttcctagctttaagttttctcttctatttatcataagtatttatccttaaatgccatgtcaaatgatgactggttaattaattattattattttttagttcaaagggtcccttctaatgttatttatcttttaacaagggaagacaggaatattttcaagatccaagtatttaaaaaggtggaagtgagataggatcggggtttggaatgaagtagaaagaaaaggaaacatgtaaaaatgtaaaatcaccatgtaggagcccaacatatccaatataagctatactgctttgggttatctagctcataatttttctttgcctaatttctctacttagaaataccatgtcacttacggtgtgtttttaattgaggaaagttaattactaactattgttttgtaaaactcatatgccaatttattctaggctaaaatcaacttggcagataattatttttaaataacaaacaaaagacctttcctttctgatgcttttcccaaaacatgcaatataaaccaaagagtaaaacaaaataatgtgttacacttctcttcaactagtctaccatcacttctgtttaactggtttgatacattcatgaaaaatttcctttaaaag

SEQ ID NO: 2449 - DNA, 4267 bp, Homo sapiens
gaaaccctgtttctactaaaaatacaaaaaattagcccggcgtgctggcgggcgcctgtagtcccagctactcgggaagctgaggcaggagaattgcgtgaacctcgggaggcagaggttggagtgagccgagattgcgccactgtactccaacctggccaacagagcgagactccgtctcaaaaacaaaacaaaacaagaaaaagagtgtaaaagtattttgtaatctgttccacagaactatttctgatcctcttttctgataaaattcaatttcccagatcaataaccataaataatgtacccaaatttgtcttaatctcctctagcaacaacatcatatctggcacaactaaaatcgggtctcttacttggttgagtttgtggtagtctattatcttcctccaggatccatcagcttattgcaagggccagactcgtaaagtaaatagaaatataaaataatgcaggatgctgcattttgtatgtctttaagggtgatgctaattgctgccattcctcttcagattaaatacagtgattgatttactattcggtgaatagctacgggccttcccatggaacctagtcctttactgggtcttctgagcttatgttgtttgttcgctctatcatgagcctttctctgactctttcagagtgtcatggatattctggcatttctgtctcagcatgagcagcagataatgcctcatatcttgaatccagcctgttcccttttgtaaatcaagttttattgaaacacacacagccactctcatttatatatgtattatttatgagagcttttccactacaatggcagaattgatgagttgcaatcgagaccatgtggcctgcaaatcctaaaatatttattatttgtccctggtagcaaaagttcccttactgctcaagtagcccattgcttgttccatgcttctagaaaccattctagtagagtagtatttccagagtgttaaattctgtgttctgagagtcccaaattgataagttcttgcttatacaactttattttccagccattctgatcaaacaccctcagaaaccagtctcgtgggtagtctcccagctcttgccagtatatactggctaggttctctaactctttggaggcgcagtctctttctccattatcagtctctgcctgtccctgactgtgtcatgttgtaacttaactctagttatgggtctagcagattctaagacaggtatatgttgcctggcaaagaagaagcctttgcttcattttcaagaaaagagggagtgctagcttctagcagagaggccacttgtgcaaattcagagggtttgggggagtcgtgcctttcataatttttgagagtatcaacccagatctcccatcacctttgttaggatcccattatgtcccaagcagtgcttaaaccttggcatagctttacttggaagttcaaactcattggcactcagctactctgacaattaagccctggtcctcgtcctaagcttactcttccctctcattgcacatgataattgtctctttacaaacttccaaggtgctggctttcttattgacttttaatcattaagtaattgctctccactccattttattttgtcattacagttactaattctaccatattgctaaatgcttaatagaatgtattagctgattaattttctttcatcagtatacattgcaccaaggactcactgttttccatctaccaccagtgatgggactcttccagctaataacatacatttttttttctcccagaaaggtgggaaaatagaacacaaaggaaggatgctataataaacatcctggattcatctattcaactttatttgtaattaacactggtgtcacttaaaatttcactagtaggttaactatttctatcccactgtatcttttcccaagagagaccaggtttcttgactggaataaagtacttcaaaactctgtaacaattttattactcatattaacaacaggctaatataaatgccaaagggtaaagttgcaagtataacccaatctataagatcatcactagagccaccctgcattaaaaagcgcttcctttaaatttagaaagataataactaacattatttacactggatatttaaaattatattgatttttgtttcccttctgaatgaaagttaatatacagcttatacataaggatttctttgctttcacaacacaactgctgcaattttctttcctgtcttcttatataacagtgctaagaaacatgaaggttaaagagagtattcagtgacttcactgtggaaatatcattattaggtactgaaaaaaaataagaactgtggtttcactgcaaagtttttaatcatcaatatttaagcacacctaattctgatctaacagagccgaaaggaggaacatttttatttgctcgagctttcaaagatatcatggaaaaataaaatgtcaataatcgtatactaactgtggaataaccacataggatatcataactgggcaagtagcgactttcaacattttaaaacttgaactcaaaagaatgcagctatgtgaaaaaatgctgatgatggaaaaaatggtatgtacgttaacagaaagagaaaatgagttttttaaacataaggtgagcaagtgcagaaatagggtgattttaaatgtgggaagcagactgtgagtgattgctaattataaaaagaaagatgaaagaagcacctgcaagaaacaagtgaggcaattatagcaggtggagagatattaatggctaaagagtgaacagtatagggcagatagaattgggcatgaatatggttgtcagtcttgtcatgttccatccacatagaaactacaatagcagaagtaaagaggagggctgtgtacccactttaatgaagaatgtaattcattaaaatgtaaagacatcatgtttttttctcataatcataacattttctgtaggtagacatataagagagaagaaattacatgctcatttgctcctctccaaagtaagaaaagtattttattatatcgttcttaaatctcagtttctctaacataaaaccaactggatccaaacctgcatctggctttggaatttatttctttcaatgtgtggttacctccgagcccgagatattctcagtactatgggtaaacaaaacacaaaacatgtttgagttataagtctattttcttttgtaatcttagtgtaatagaatctcaaaagtaaaagtgtgaattcagcccaaaccagattcactagttaaacaataactgtgaaccactccttctactcctaaatagaatagaaattgttttttatctacaaattcttctctttcaaattcgctagaccatagaaacttaaaagcgtaaacaatatcattctgaaatattaaaacttaataacatgtaaatgaggataataattaaaaagagcaaataaaatctcaatttcaatagttaatacagtgacactcataccaggcattgaattaacttttttctgtgactagtatataaatatctaggggcgtggcccagtaaagttctagatcattaaaattccttaaaatattaaccaattaatcaggtaagtgctcatgaccaattagtatacatagtgtattagtcagggttctctagagggacagaactaataggatacatgtatacgtgaaagggaatttattaaggagaattgacttacatgatcacaaggtgaattctcatgatagaccatctgcaatttgaggagcaaggaagccagtagtggctcagcctgagttccaaaacctcaaaagtagggaagccaacactgcagccttcagtctatagccgaaggcccgaaagccattggtgaaagtccaagagtccaaaactgaaagaacttggagcctgatgttcaagggcaggaagcatccagcatgggagaaagatgaaggcctaaacactcagcaattcagctcattccaccttccacctgcttttcctagccagtctggcagccaatttgatggtgccctcccagattgagtgggtctgcttctggcagtccactgactcaaatgttaatctcctttagcaacacccatacagacacacccaggaacaatactctgcattattcaatccaatcaagttgacacttaaccatcacacatagtaatctgttatttaatatcgttatttccaaacaagaagactatactttataatccaaaaataaagaag

SEQ ID NO: 2450 - DNA, 4064 bp, Homo sapiens
gtacatttccctcctcttcccctttctctccctagaatatgagaagggcctagaatgaaggactcagaggtttgaatgttcctattcgcttagcctggttgcgtgcttacctgtaaacctttgtgccgccccttttatgacagggacagctctgtatccctgccacattgcttttttactgtgcaatctaggcagtggcattgtattatatttcatgcgtatattatcttgtgtcacctatgtaattgactttttaatcttttcatgaccatttcctggatgtttcaggtatctgtctggagaaaagaaaaacatattacttgacatgtcattaaagtttgttaaattccatggtgtgaataagctcaacccgcgctcttcatgaagtctcaatttctatctggtattttcatggtgttttgatataattaggaaccctgaatatagacgtctcattttaaaagagttctgaaaatgttctgtttcaaaaatgaactgaagttaggagaagcctccatatgtttatcctaagtatggtaaactatttaagaaacagttattatttcttactggattgtttgttaattcataaagttaggtcataaagttgttaattctgtattggattgtttgttaattcataaagtaaaaccatacagtgggaatttggaaaaattacctcttattttcttcacaaaataccaattattttgttttatgtaggctccttgaagttcgtggaaggctgtatgagcttctaactcattgtattcctcctgagataataatgaaggtaacccaatttcagatcttgaactttttacagctataaaatttggacgctgggtgtgtgatcatagggctttttgcagtatcaagatatcacctctttctctccagcgcattaattgcacgtatttactgaacctctatggtgtgccaggcactattagaggaatgctgaagaaaagaagggagggcctgcctaaagtgaagttatattctagtggtgtgaaaaggagaacaaataaagaagagaatttcagagtgttgtaagtgctgtaaaggaaataccaaggtgcagggatgataatggagggtggggctacaaagaaaaaagtgaagttccacccatccgttttcacaaaggtaaccacttttaacagacctcttttctattcacatagaaacaagtacgtgtatatatgtggtttcacaaaacttctcagttttccacactttagtatggatgttgtgtcatgaccatatgtatagatttacttcgttctgttaatggatgaatggttttctgttgtgtgactgtatcatagcttttccgaatatgacctccattggtggaactttaggttgtctacaaattattattgttattataaatagtgctgcagaaagcatccttacacttatatccttgcactttgtgcagttaaatatttggaatttagaatgtggttgatacccaccacatttttatgtcatggaaaaagtacccaaagtttttgcttttggatgaaggtcgttgattcacataaaaaattaaagatctcacacatataaagagagtatgtttaactttagtctttttgtgaatgggagaaataaggcatgcttagctgtttttattaatgatttttaaattactgattatttttgtttagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctgacttctgtcagttattcttgcaaagatttctcagtatcagtatttacatacagcttatattaaaagagctgtgggtaaattaactgaacttaatcatgtcgtatttgcgtttttttggtaataacttctctgtgaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattatgaataaagttgctgtgaatacttacgtatgagaaactggatccagctgatcatgggtgccactctaataaattcacagctaccaaccaagaaatgggctgtcaacactgcccaacggacatatgtttctatgatcaagtctccacaatgcctttttcaaaacttaatttggagcaaataattttaccttcttgttagctaccgaaaccaaatccatatgcagcctatgttaccatatcctcatttgtatgcatcctgttgactatatctacatttatatgcaacctatattctcctaatacggtagagaagctgcccatcttccttgttaagcttcccatcttgttgggtttgttctatgttgattgtctttttcttttgatgattaatcatgtttttctacttctttgttgagtaattgtgaatagtatctagtggttatgaatgatctgggctttagagattacagaagaaagtatttgcagaattagggttcaagctctcttgttctctcttttaaaggattgcctctatcattttgtagcagcagtggctgccccctagtcttctggttctttaatccaataagacagtaaagttttcataagagttttagctgcccatgttagtgatgactgtggcctgccttcaggctaaatgccttaaaaatgaaaaactctagtgctctgcccaccttccaattgttgattaccttccagtttctgctgttcttctctctccagcagttgttttttctactaccgttttatcatttgttttctggttgttttgtggccttccttccctccttcttgcttgcctgcttacgtgattttctcagtggtgtgtttcaatatcttgctttttcttgtttgtgtatctgttgtaggattttttatttgaggttgctatcaggtttgcaaataatataactcattattttaaactgatgacaatttaacactaatttcaaaaactaacagagaaaactaataaaaattctacaatttaac

SEQ ID NO: 2451 - DNA, 4936 bp, Homo sapiens
ctgagatccaaaatcccctctgtgagttgtgttttcccagtgacctactgtgttagttaaggtaatgctagctgctataacagacacaccctgaactcccagggccttagcacaatgaaaatttatttcttgcatacttcacagtcccaagaggatgttcctggtcagtcagccttccagatggtcattcagggatccaggctccttccatcatgaggctctgccttcttatctgttgagagagtttatgaagaaaccagccaacatcctggaaatcctcaggccacctcaaatactgctgtttctgtacaaagcctctgatggattgatgtttcatcaactggtactgggacaaggacccaaccaccaccatgatgagagcactgttaaggtcagataagcacctgccctgggcataactgaaggcttcaaggcaccagccatctctaaggaagtgtctgctcacaagacaaacgatctttctactgttccagatggcatcctggatattggcaatgcggttttctcctgggacaaagtctctttcttcaaagcacaggttgaatctgttttggtcactgtattgagtgtccaggtgtttgagcaaagcattctgcacccatgtgaagtctttgctgctgaagcacaaataggcatcatatttgtacatatcaggttctgtgccctggggatggtccttgaacaccagtctctgggctgtcttataacagataaaacagaagccccggaactttgtgactgtgaggatggtcatgaggaacagagtcagagtgacagtgcatacaatgaaaagggagaactttagggactttaagacttcctcttcatcacaaccttccgtggaaagagagaagagggaaaccccagagaacgagtcagggtacacacaatatatgtctgcaggaggcccagctatagtgacattggtgtgattaagccaattgataaaagtgctaagttcacattcacaaatgaacttgttatgagttatatccaagacactaagtgatacaaatacatcaggattaggagctaggagctggttcctggatatgtccaggatctctaaattagcaggtaaatcattgtgagaaagaactgtcagcctgttggagttgaggcttagtccccttaatgcagtcagatggctaaatactcctggtggaagggaattaagatagttatgattcaaatacagaacttgaagatgagaaagtccctcaaaaacatcccaacagagctcagtttcccaggcaagttgcaacatattttctccaaggaaaagctgttctaagctgggattctctgaaggggtttgatctccactacaggaggagaagcgattttgatttaaaatgagaatctggagatgaggtacccgtaggagaaagtagagaatatctagattttctagcctgttttctgataagtggatgaggttcgctgtaaggttgatctttggcaaagtcactagtttattgccactcaagaagatatcgggtatgcttggaataaaatgaatggttgtaagagcattgtctcggagatccaaggtctgtaatttttccaggaatttgaatgtttggtcttgaattattgcaatgtgattcttttgcaaatcaatgtaggctaccttaggtagtccatagaaattcgaactgtaaagttcccccagaaggttatatgacaaattgagaacttggaggttgtcaagtccgtaaaatgcttcatctgcaatcttatttatcttgttgtaggcaaggttcagaaccttcaaatccttgagtgtctcaaagactcgtgagttcagggagaagacaaacccatgtgaaagatccaggtgtctcactgaacttctggccaggccagcaaatgtgttctggtcaggatctttgatgttatggaagccaaacccggcacccatgatgtggtgggcaagaatcaaagagaaggcctggcttttgctgatggcattgctaaagtttcctgtgatgtccactgtccagccatttccagaaacatctagtatctccagcaccatgtttctgaatgggttcatacattttccccagtccactgagactctgctatacaagctattagctgcgaggctaaaaaaggagagcgttttcccttgtaggggctcgagctcatgttcacatacaaggaatatttggttggaggaaaaatctatggactttaaggaattcaacttcccaaatgaaggatgaaggtaaaggctacgaatctgatttttggatagatccaagcgagttaaagcctttaaatttctgaaataaccatctttcaatacagcatcagagagaccacagaaatacagtctaagttcaaacagatggaacagtccctgaaaagcatctggatgcaagaagtatatcttactacttcccaggtccaagattctaaggttgggcaggtttctgaaggcctccttgtcaatagtcaagggggtatactggctcccgagctccagcagctgcagctgttccagaaaggggaaggatgaagcagtgactgtcctgatatagttgaagctcagcaggagcctctcagtggtgttgaggacctgggggacctgggtgaggttgcagaaacgataaaaggctattcggccatcaaaggagcaggaaggaattccaaacacaggaccggccatgagcaccactcctaggagaaggtccaggtggtctcccatgatcctatggagaagaagggagaatgaaaacacaggcatttaagctcgaggtattgcactggggtcttcagatcttgggggtattctctatgatgtgcctgctccctttgaccccttcattcctctgactccacagacgtggctgttggcagatacagacaaaactattcttactctatttctgttttttttgagacagggtcttgctctgttgcccaggctggagtgcagtggcatgatcacagctcactgccacctccgcctcccgggttcaagccatccttccatctcagcctcctgattagctggaactacaggcacgtgccactgtacccggctaatttttgtatttttagtagaaatggggtttcaccatgttgcccaggctggtctccaacttgtgggctcaagtgacctgcctgcctcaacctcccaaagtgttgggattacagatgtgagtcaccacacctggcctattcttgctctctatcaaacacttacgttgaattttctgtatactaggcactattctaggtacttaaaaaacatttcacttaatcttttcttttaaaaaaattttatttattattctaaattaaaataaaaatatagagatgggggtctcgctttgttgcccatgctggtcttcaactcctgagctcaagcgatcctcctaccttggcctcccaacatgctgggattacaggcatgagccactgcaccctgccttcacttaatccttataataactctatgtttcttcattcattcgtttgtttattcattcatgatttgctgaggggaggtggagaaaacagcaggaagagacacaatgttgcttcacttcagccgggtaccccgttcctagcccacagaaagctcggctgatgagtggaaaataaattcactgtttttctcccttaatttgtctaggctactggcccatctccatttatccgaccttactccacacacagtccatcccatcatgcagaaattgggcactttctggcaccccacaaagagccagatgtgatcggtttaataaaagtgtgataagtgcctagtgctcgcctggcagctgtgtgattgtgtgagtgtacgacaataaacagagactggcccacttgcttaagtcctgtcggggagctaaccatctgtctgggttgagtgtttttttcatgggtgcagcagaaatggtgctcaatgaacgtgtctggcttatgttccaagtattgtgctgggtgctatgaagagaaaacacacaaggaccccacctgcagagagcttggtgtctattatttgcacagcacctccatctttggtgcctactatgcattccatttgctttaaatgtaatgaaaggcctctgttggaaggtaaaggaagagttatatagctcagagggcaggagaatgagaggaaaaataaatgaaagaaataggaagaaggcaatggtttataaagagcatgaatcccatgagacaccatcactggcaaaagtgtcaacaccaggagagattaagcctggagcagtcacggtgctggaggtgggctagctctgacgaggttgtgctttgtgctggggctgatgtatggtggggtttccacagaaactgggaggctgtggcacacaagctacagcaaatcagaagtaggcatggatgcctggattgactcaaagtttcaaactcaggcatctaataatcgttaggaaaaacttggtgagaatgtttatcaccactctgaatttctcccccatctcagtaaatggcttcaccatatccatccagagtctcagggtgacaacacagcagagtcttttaaacatcattcttttaaacatccccccaatatccaatccctcagcaagtcctgttggtgccacctcccaagcctatccactgccctactgtaagccgccgccatctctttgcatgggccagactggagactcctcactggctctcttatttctggtcttgctttcattttccagccagcagccagcatgttctttcaaaaacataatctggtttatatcattcctctttgtacagggcccttcccttccttcctgctgtacttggaataaaatcctgtgagtacttacatgattcagctcttggctgtcttgtcaacattatcttgaatagtttttctcctcaataactcattaaaaaaatttgctgagcaccc

SEQ ID NO: 2452 - DNA, 1085 bp, Homo sapiens
caaatgggatcagccctagataccagaaatggcactttctcatttccccttgggacaaaagggagagaggcaataactggtgctgccagagttaaatttgtacgtggagtagcaggaaatcatttgctgaaaatgaaaacagagatgatggtgtagaggtcctgaagagagcaaagaaaatttgaaattgcggctatcagctatggaagagagtgctgaactggaaaacaaaagaagtattgacaattgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtgaa

SEQ ID NO: 2453 - DNA, 21478 bp, Homo sapiens
ctcgctgactcttatgaggttggacaatgctgcagtcatccagggtgggaggatccacttccaaaacgtctcactcacatgactattggcagaaagcctcagttccttgaaaatgtggacttctctgcaggccttctggagtgtcctcctgacagcaactggcctttcccagagagagtgatccaacagagagagcaagtaggatatagctgcgcctttcatgacagcctcagaagccacaaatcaccgtgtctgctatgttttattcatcagaagtgagtcgctgagtccaaccatattcacagggaggcaaagtaagctctacctcttaaaggaaaggagtatccaagaatttgtggatatattttaaaacggccacagtgagttatcaaacttgtttttatctttgccaatatgataggtggaaatggtatctattgtgattttaatgtgcaatttccttattgtgagtttttttacagctttactgaggtataattggtatacaaaaactgcatatatttaatgtgtacaatttgatgagttagaacatatgcaaacatccatgatctcatcaccacaatcaaggtaatagacatccaacaccttacaagataaacaaaattgactaatctttagctagattaagaaaaagagggagacaactcaagttaatgaaatcagaaacaaaagaggagaccttgcgctgtcacagaaattaaaaggagagagtagtatggaaaatgatatcacaacaaattggataacctggaagaagcagataaatttctagatacatacaacctaccaagactgaatcatgaataaatagaaaatctgaacagatcaataatgagtaaggagattgaatcattaatttaaaatttcccaagaaagaaaagctcaggaccagatggcttcattcatgaattctaatttttttttttttagaaaaagaaaaccattcatatttcctttctgtaaactgtctgtccattacctttgttgatttttctgttggggttttgatgtttgtctgaggatatgaattgcaaatattttccctgtttgcctgttaacttcctctgtggtgggattttttttttcatgccaactttctaatgaaattaaattttcaaatgtttctactatttggagcatcttagaaagaactttagggccaggtgcggtggctcacacctgtaatcccagcattttgggaggccgaggtgggcagatcacctgaggtcaggagttcaagcccagcctgaccaacatggcgaaaccccatctctactgaaaatacaatattagccagatgtgatggtgcatgcctgtaatcccagctactggggagacagaggcaggagaatcgcttgatcctgggacgcagaggttgcagtgagccaagattgtgtcattgcactccagcctgggcaacaagagcaaaactccatctcaaaaaaaaaaagaaagaaagaccttcagctctctgagcatatggttaacaatctgctatgtgttcatatatatacacatacgtgtgtgtgtgtgtgtgtgtgtgtgtgtgtgttttggtgggggaacaaggtttgctttgtcacccagactgcagtgcagtggcatgatcatggctcactgcaatcctcccacttcagcctcctgagtagctgagactgaagcaatcctcccacatcagcctcctgagaagctaggactacagttgcataccaccacgctcagctaattttttaatttttgtggagacaggtctcactgtgttgcccagagtggcttcaaactctcgggctcaagtgatcctccttcttggcctcccaaagtcctgggattacaggcatgaactgctgtgcctggtctgttttcttctatatttttgtggtgtatttttttctatattcaaatatttgattcacctaaaatatattttggtataagctgtgaggtaaggaatcaaatcttttttttagttccagaagttgactgcagatccttgaataacattgtttagttaaccatttcttcacaacattgatgagaaaaataaattgctttccagccagagccactctctatgtggagtttgcactttctccccacatctgcatgggctttctccaggtactttagtttctacccacatcccaaagatatgcaccttaggtttattggcgtgtctaaattgtcccagtgtgagcaagagtgagtgcgtgggagtgtgccctgtgatgggatgacatcctacccaaagttggttcacctcttatgccctgagatgccaagatagactctggccaccatgaccctgaactgaaataagccggctggaaaaggaatgaatgaatacaaataattgtaaagtaaaaattcataaagtattcaataatcatgcaaatgcacaacaataaacgatgaggtacaaaagcactcagcaaacctaccacatttatgactgttttggaactgcataggggcaagagaggctcctcacaattatcactttgcaaacatttattccttcatttaacccaccaccactacacctgccattactcactgactcaccacaaattgactagtcatttactgatttttattaatctttctcaaatgtttgtatagctcatacttatttcaatgtttaagattagaactgttggggatatttatttagaagtttggcgatttttttttgtgccagaaatatgccataggaacttagttcttgtttctcctaattagcctatggtaaaattagtttcattatgtgtccagtttccagttacctatagacaagcagtccccaaattttcttggcaccagggaccagtttcatgaaagacaatttttccatgggccagggtggcaggggatggtttaaagatgaaactgttccacctcagattatcaggcattagattctcataaggagtgtgcaacctagatccctcacatgtgcagttcacaatagggttcatgctcctgtgagaatctaatgctgcagctgatctgacaggaggtggagcttaggccataatgctcacctgccactcatctcgggctgtgcggcctggttcctaacaggccacaaactgatagcaggggttggggacccctgctatagacaatgttaagtgaggagttactgtacctagtttcaccaatatcatttgttgaataattgctatgttctcctttgatcagctagtgtcctgttaggaaatgtggaagtactctagatatttccagcagagaataaattaatgcaaacaatttgtgacaaggaattggaagggctaaagaagcaacaggggaaagagatattagtctgtgatcatgacgctgctagtgctcctgggctggaaaccaacagtttattttcactgctgagctgctggctgcagggccattgcttttttggaacatttctgtagacattgagcaggaaccccagaacttacattctaaggatgctgctcaaactaccaccattcttactaatgctggtggagcccaagttacctgctgctgatgttcctcctgcggccagaagaggcaccagaagcagaaaaatggctccttctcacctcttgttcctcaatcccaaccagtgagtggccctcagttgcagaaccttaccataggcagctgacaagaaaatccagaaatgtggcgctctggcttccagccagcatatttgtggcagaggggagcatggaaggttgggaatgggggtaaatgccaacatataatcggctcaccctctgctttgaaaaatcacaaaataaattcctcaatgcttgaggatctattcctaatttttttccactagtttatttatctacttaacattcagtgtcacgttgttttgaatattatgtttttatatctagtagaaacagttccctcattttttttcataacttacctagctttcctggattgtttattttttccatataaattttaggaggccaaagccttatctgttaagaaatcagggccatataagttttagaattagcttgtctagttctaaaagaactgcagttgcattttattggcagtatgttatacatttagtttaccttaaggagaattaatatctttataatgatataattttctatcagtttagtatattatttgttcaagtgtccttttgtgaccctcattaatatttaaagttttcatcctataaatcttgtacatttcttaagtttatccttaagtatttcacgtattttgtatttgcccttgggggcctcttgttcttattgattataatttgcatatatgaaggctattgatttccatatactacctttatttagttaccttgccacattccctgattataacaacatttcaatttattgtctcttggattttttgaggcaaataaatctgctaataattataactttatgtgctatatcccaacttttgaaccatccatttctttctcttctctaattgtgctgaaaaactccactaggccatgataaattacactagtgacgctgtgttctttccttgttcctgattttaataggaatgcttctactcttttcctgataggcatgatactgggttttgcataacacagtaatatctgttaaattctattctattaaaactttttttaaaaatcaagaacagatgttgaattttctcaaaaaattgatggaaatctttctataatatttgaatccattaatgtgaaatatattaataaacatacaaatattgaaacacccttacattcatggaataaattcctttggtcgtgtaatattaatcttttaatatgctatctgtttgcacacattttattgagggttgtggcaatgatcgtcatgactgagaatagtccgtaggtttatgtgtgtgctctttgtcctcatccatttaaagttgatttttgctagcttcactcttagtgaccttgctaccaattttctcagggcttcttacagtggcctcctatatgctgattttaatgaaattgatcttctaaacataaacctgcaatatctttggggtggaagaaaaaaagatacgaaaagaataaacataaacctggacttgatgtttatttcttataattccctcatggttttatttaattgcagcaatccaccaacatctttttgattcctgacttccctttgtagattctatactgtgacttgaagaacagttggcaaatgggtcaaaagccagtagataggctggcccataatttctcccttaccttgtgagaaaatataaaaagaatgagaatcaggtcatgactctccaccccaggaaagaagaacaatcaagaaacacctgctagtggcatgccaggccagacacacccatcggggtctcctgcagtcaagaaggagggggccgtgcaagctgggaggtgagagaatctccaaggccatggctttggtttccagcagcatctctttcagacctcagatggacagaattcaactcatcacatttcttggttcttgacacgctctcctcgttagtccatcacatattgcacggattcattcatatcgctgcatgtaggctgctttgacctgctgtagaatatctcattgtgtggatgcacatgtggatcactgagtatgtcagagctggcaagatacgtcagaagagaaaggagaaactcttaactaaatagagttggaaataaaataattgtctgtatggaataagatcaaaggtcccacatgttaaagtcaaccccagatgaattaaagtcttacatgtcaaaaaaaattgaaacttttagaagaaaattaaggtggatatattttagaccttaaggtagagaaagatttcttaaagaagacacttacaggattgattacaaacaaaaagactggtacatttgaatgtattatgttaagaacttttccaccaaaagaaagcctcgatttcctcatttttaagatgaggataataatccctaccttatagaattctaataagatgaaatgaagcaacatatacaaaatacttagcacagatcctaacacctacaaaataataaatggtaacgattattattcttctcaaacaacaatcctattatttatcaaataatactgagtaatatgacaagacatatttaaaccacacaagccatatgcagacaagtgtttaatatcatagtgatagtttcaagagagagataataatttattctacatttatcagaggtctatagcccagtagtcaataaatacttatctatagtcaataagtactatcaagcatccatgccaggaaccatgctaggggctgattaatttacatcaatcaccatgacttttttcccacaaactaacacacacacaatcttcatagatttttctgtgatcacagcaaggaaaagacctacgcatgtttggatcatctgtgtacagtcctacagaagaactttgacactatcagagacagaaatctcagaatagtccaactctcacttatttgtgctaatgaaagagtaaagtaaaagagacaattaaaatgggaaatgtgttttgttttgttttggtgttttgttttacaagtatgcaaaaacctcaaatcaacctgacccaacaataaggaagcaagtcagaaaaaggcagtcttccagagctgtttgttcagcagctcagtaatgccatgaaggtttgcttcctttctctgctttgtgtttctggagagagtccgcatacatttcaatatggctgacagcagttctggaatgtataaagccttgcataaagaaaatgacagttcactatgaaaatctgattcggatgatgttgaaaatagatttagtgtctgctctgcctctctgttttctaggacttcaccacctcacagactttgtacactcatggttcacaacttcctcactgtgttttctttaacgagtagaagataaataagctttaagaaatagtaaattatatcaaaatagactttatcatataatttgcctaattatgtaccttcagtaagtgtttattgaactctggggtgtcaacaattttttattcagctctcataagtaatatttgcttagaaatctacccataaataggataacaactttcataaaacaagaatttatacctagctaacatgaaaaagctaaacatcccttgaagtacaattctcctgaaaatcatcccaatatggtttattgaggctgatggatttggacaccagctcttaagaaaaaagataaagaggaaagctactgcctgccacaacatattctttttcccaagagctggtaagtttcttccatatgtggaatccaataacgttcggaacattcttttctctttctggtaatgtgatatacccaacgtgggcctatgatacaaggaaggagagtagatcaggagtcaaaaaccacaggtcctagttctggttctatcatttctttgctgtgaaagtctggaccagtgacttcatagctctgagtttctgttgtgtcattcttcaagtcaggtcatcatttgccttccctacttcacaggtagtatacagtaatcttttcaaaagccctttagaggacataacacaaccttatgtttattttctgctagagcatgactcccttgagggcttggagcatgtcttaatcaaatttgtatattccaccattcctaccccagacctattattaggtgctcaataaatgttgattttaaatgacagctgtcatgaaataaatgaaaacagaagccaacagtgacggtttgagctgcctgctggctggcatgtgacacttaacatctaaagagtgatagtggcagctaaagtgcggaaggaatccactttatgaaactatctgagcagtgaagcactggaaatcacagagtctccttttggctattttacatttagatatgaaagcttgtcaggctgggctgagaatagacaatgagaaactaacacatttcaacaggttttgaatagtttcccagtgaagaattttcctggcctctctccaccctggtttttatccctcttcttgggagttatttttcgcaaatgtaccccatgattggcaaatttcagaagaataactggggttggctcagttcagctcctccccgtccttctcctgagtctgcttccaaaggcaatctgcaagggaggaataaagcaactcagggaagggaaaaagagatgtgaagaaggaaagaaattggaagacccaaaacaacatgatggttagtagagctaatgaaaatgaggaagctccaataatatctggttttttttctctgactttgtgaaaaccatttgttattatgatacgacaatgtaatcaatggtactcagtaaagtcagtaccccaaaattcggccaggtgtcatggctttttgtgtatggttgtcctgggaattaaaggagaaggaaggggctgtgcccctgtaggggagatgatgtgcagaaacggacggtatacacaggaggaaagacaatgagaaaagataaagaaagaattcactaaaagcagggacttggagctagagaagcaacaaaagacatccataattcttggagatattaggggaatactaggcttcccaagaaaaagattcaagccattctattgcactgtcagctggaaggtggtcccaaaaggctggggaaattggaggcactcaggaagctgctgtcttggttacaggcattcatgtatggatgaggctggagaaggtaaaagacagaggaagagagtagggaggcaggtacagaaaagagactcattattacctttctctattgcaggcttcagaaggtgaacccagagagcaggctgtttctgtccatgggaaagcaggatggtacagcccatatctgattcagaaaccaacagtcaaaccattctcccctgagactaaagcagagaatgaagccatttcccagaaatttgggtatttaaaaaatcaccctggcctgggttacagggtaattgtcccatatctatgtttcacctgcagattcatgggacagaattatttcccaaatctagctccatgctcctgccctgacttaagtcagggaatacttggtatgtagtagcatttattatttcacgttcaaaatatctcaaagccttgaaaactgtaacgtattaaacggaaatttggtaggcattgcttcgcacaatcccatgatgccagcttgctagcatggatatgcccagggcaccctaccagatgctggacacaaaagctcaacatggtagttcttccctgcaagggttcacagcccagtggaggagatcgtcaggtgagtaaatcatcctactgtacagccacgatgtgcagaggactcagaggagggagtgaaactgccactcccaggcccatgtctcagaccaacccttcccctccagccagttgtgtagactgcacctcttctctccctcctcagtgaatacaggctaaggaacgcaggcttctcttacccaggttccctgaactgctttttttagcccatctcatcttcttctggttttgttcaattttctgccagcttttttatccggctcacttatctccctttatccctcagaaccatctccagtaattccattgactggcaggacatttttccatcagagagtagagctgagctgctgcagtgccacggccacctcccagcaacaacccctccgaccccagcagacccactacctggctctttcggtcagtggggacttttcagatggtatctcttttattttagctttttaatttctggctgccaggctttcttttcttaactacgtttggagcagcattttgcacatcacagaagccatgccagttttaaggtgagttaggattctgcaggggaatcccattattttgattccctcatcaaagcagggctaagtttaaccccttgcaaatatgaaaatgaaaaggacagaggagtgtattgtcatggaaaaggcaccaaattagtcaccagggaactggacacaggtcccggccccacaactgactctgccatgggattttaggcaagacacctcacctttctgactccaaaatagtatgcctgttagtcttcctcatgatgaagttggaagaatcaaatatattgactgctataaacatacctcataaactgtaaagcactgttcagtcaacttaaagacccatgccaaacctagggacactgggcagcatgtccttctgaataagcacataagctccatgagagcaaggattgggtcacctcttgctcgctatttactcccagtgcttagcacctggaaggaaggaagggagggagggacagggggagaaaattatgcacccaaggggtctgaaatgttaggtccttccacatgtttgtgaagcccatcacctgctggtaggagtaaaaatatctcaaacacaataaatatctttcccgaattagcatctatgaattgaatcccatttgtgtgagaagtgaaaaggctgaagtttccacttttcaatcaacggtaaaagtcctgacctaatgcaatgtcgcagagactgttcgtttgcacaagccaatataataatagcaatagcttacatttttatagttctttacagtttatcaagcattttcaagtatctgacctcattctgatcttcaaaatctcatataagtaggtagggtaaattaaccctgttttacagatgacgaaactagggctcggaggagcgcagaaacgtacaccaaatcacgaggcctgtaagtggcagagctgggatttgggcaggttctcttggcaccttggcttcttcagctgctaatgaagacagtaatgatgatgctcccattgttaagctgacagctctggagccacccaaaccaatatgatttcctctttattttgctagaattatggttattctgaatccctggagagtagagtaggtcctctcctcataaaataaggacaaaaaattcttttcaggaaaggaaggctacacagttggtcaataatcacatttttaatgacttcattagtcatcaatcaattgaaacagcaacaatgatgcatcatttcctcctatcaaattagaaacaataaaattaatgttgataaggatgtagtaaaaccagtgtatatgttcaatgctggtggccttgtatactgctacaaacttttagaagctacttggccacatgcctcaagagccatgaaattgttcacactctctgaagcagtaatcttacatctgggaatctatcctaaggaaataatgaactagagaaagaaaaaaaaataccttcctagggcctggttgttgatttctcccttggatagcaatgagatatcatggtatctttttcataaatttcctatttgtttaagctcattccagctggttcctgttacctggcaccagaaccatcattacaaaagcccacatacagagagctaatataaatattaatatcttcccttcccttgcttcaaacttgacctcaattgacatttccagcttcacagcctggtatcccatccctccatacccccatcaatctcaaagctccggtcaagtcaaatgtctcacagttgaccagacgggccatgaatcagcatgttctgagctttagttaggatcagaatcacctggaaggctggttaaaacacacacccttgtgcacacacacacacacacacaaaacacacacacacacatacacacacaccacacctttcactggctttgagaaccactggtttaagcaacagtctacctctggcaaaatcatctagtccttcaagtcccagctcctccctgctttttgcagccatctccaatcacaccagactgaactaattacttgtcccctgtgtttctttggggcaagaaaagcacctattacactgtataatgagggttaattgtataatggatgccagctccctgcttatcaggagtatctggagggcaggcccctggcttcattgcctctgtgcccccagagctagcacaatgcttggcacagagtagccatatgtgcatgtacgactgaattattccttgctccctccctctataggaagttatggtttattcctgtttccacaggatccattagcatattgaatagctatttttaaaaaacaatgattagccatgatagcaaaagaagaaacatgaacagagcttattcgtttgccaggctagtaaatatcatcttgctttgctttctaaactccttaatgaaaacagtggctctcaggcaaataaataaaacattaggtagacaacacacagcacatcacaagcacagtccactaatttgcctattgctgaaggacattagccacctttgagataatctccataaacatactgccccatctccctctctcaaacatgaattgtatcaagctaaatttttaatgtttttcaatgtcttatatatatttcatttcaacaacattttttaatagtaagatatccatcttaatcaaatgaaagctgtttttctgtaattgtcctaaaagccaattcattttctggaaaaacatcttcttgaatcacaagtggccgggctaaacagtgttctcagaatattaatgtgaaacttaagctattaacatgtcatggttaacctttctaaaagctaattaaattaaaataataatatgtggaatgcttttacagaaaggtaaggctcttttacaaagcacctgttccaagtctcagagctaacaccttatgaagccatggtgggaaaaaggttttgcaggcagacaaagaaagcctggctttgcacctgctgtgattaacttttagttgttggtattagagttaattattgcagcatgctggagggcagtgacaatttacttgcctgatcatacctaataagatgtatttgcggatgccagcatctcctggacttaatcaacaaactatcaagacaatcaatgctgttaggccccatgtccttgtgatagttttttccaaataaaaaagataaaaatccaaggatgcagtgctaaggatataggcaggctgcttagaaagcctccgttagctagcgtcaggcttatctccctccctgagtggctagatctattatgcaggagggttagtgcaccctaaggcccgattcaattgggagcaaagttcaaggcaaccacaccaggtacaaggaaattaagctctgagaactccagcacttcttggtaactgagctctggaaggcttcaaatgggccctttctactttatcttctatgggaaaaggttgttatacccaaggcgctataccctcttcctgctacacaaggagggagtttctgttcctttatttgataatctatgcttgaatccatggaatacatttttaaaggaaagaaactagctatgacataagacaggttggcaaattccataaaacaacatgctttagtttcaactctgttcctttttaggccccaacaaattagcaaaactcctatgagaggactggggtcatgtgtgggcacacaaaataaggagggtgctaccacctagagggatctcatacaggtaatggagaggtgcaggtgacagcaatcagcagcctgggggcactgaaaatagaactaagactgtctttgactcataagtcatccatcctgaataatgaaagaagaccaacattcagcatgatcacctagatctctaacgtcttttattcatccattcattcactcaacacatgtatttgttgaattcctccttcatgccagggactgtgctgaacatgttcctgatttcactaaatgtgagctgtgcaatcttgagctctagcagtttgcacaaggtctagctggaaaaaactgctttatgacaatgttggggatctttgttgactcccagccttccaaaaatatcaataccccagatatgacaagtatcatttccattcacattccattggtgagaaccagtcatgtggtcacaccaactgccagggagactggaaaatgtagtcttcattctatgttcagctaaaattcaggggttctgttaccatgtgaaagaagggaaaaaccaatattaaatgtctctgcttttgtaatatattttgtaatataagacactacaaaagatgtagtgtcttaatcacactgatgagtcaagaattctgggcatctccatagaccagagagatggaggaatggccaggagccaagagccatgtaggtagatttctcaaatgggatccaagcccacttcagggccagggcttcagagttagagacaggtctctggcccttaaagaactgacaggtgatccatgttggcatcaccattcataaaaacttcacaaaagacagttctctgtcctgttttgaaataagtggaccttttaaagtatcagggaagaaaaacttttcttctatcctcttaggttcagtgatttgggggtctatgaataaaaccaacaaaagacagactggcaaaagaaaagacaatgtttattcatgtatgtacttgggagctcacaaagaaagtggctcaaagaagctgttagaacttggagcttatataccattttaacaaggagaaggggttagggtttcaagggacaacaaatggtgggaaatgactgagaaatatataaagaaaccaacggaaggcaagtgaagtggtaaattttatgcgtcaacttgactgggtcaaacggtacccagataattggttgcatgttatttctgggtgtgtctgtgagggtgtttccagatgagattagcatttgaatcagtggactcagtaaagcagactgcccttcccaacaggagtgggcaccatgcaatccggtgaaggtctggatcaaacaaaaaggcagaggaaaggagaatttactctctctacctggctacttgaactgaatattcatctcctgcccgcagactaggacttacaccatcagctcctctagttctcaggccttcaaatttaggctagagccatcagttctcctggtgttcaggcctttgggctgtatggcagagggacctgacagccacaattgaagcatggcctaagagtgaccctatggtctaagaagaatatgtgttcagagtctcaagctaaggaattcaggagtggccaatgtaaagactcactccttatgtataaaggacatctgaacccctggcctatcccttggaatacaagctgtataaggaattgaggccctttgttttgggttaaatggaggttgctaggtgaaggttgctggttggagggtgctaagtgaaaatgctatataaactgcatgctttttacaaatggtagtggttctcctgtcccgcctaccaccactggaccatccctgtatgtaaatcatgccaataaaccctatgtcttgttctctgtctctaggtctcttccttggcctctcagacatgttgccatttctatcagagccaataagagtctggcatgccgtggcctctgactagaactatactaccagctatcccaggctgtagcttgcagacagcagatcatgggacttctcagcctccacaatcacatcaatcaattccttatagtacaataaggcttattttaataaggtgtgtttatgcatccagtgtcaacttctcatctctggtgacaggagtcaccccttctgcctggtacttccttaaagcaggattcatgatagcagaattcttttggaaggttctgcttttaggcagatgagggagtgcagagaaaggctcttcctgaatctgttgattctcaaatgcctttcactcaaaataatatttatgtcatgtggcatattctgatcccttccttggtcacacccaaattttatggactcaaatactttgaaagaaaaaagaaaggacggaaaaaaggaaagaagaaaggaaaaacagaaggaagaaaggaaggcactggctatgataaaacatttttcaggtgatgtatgaattttagaaaaaaatacatttacatacccaaaactagggcattatttttaaccaaacaatgtaatgtatggaaaagacaagttaaattccacattcaattggtaggatttcatattcagtgtgagccattctctccctgtgctgtgcttgctccaaacatatttccacagacttggataatttaccttgatttttgcttagtattgtaaaacgtccccaaaatttgagaaagcataggaaaaaaacttgtagaagcaagtaaaaccagagaggaaagccatgacacaggaagagaagatattactgcccacaaagcagctgtttgtcaacaatcacattagtggtctgggatcatgaaggaatgttttaagcattttacaccctaatataagttttttagttacatataggcatttttctatgttttcagaaattggctaaggatttggggttgatgcataccattttgtaatttttcccatttcaaataataggaaacagctctggttagcatttttgtgcacaacatctgattttaggaggggatgactaatattaagtgggaggtgtctgtattttaggaactggataggaaattgtattctctttacttgctcaacatccatttaacaagcatttaccgagtactacagtgagccaggcattgtgctgagtgctgagcagacagcagtggaaagtcttcatccttggctaaaaggatctagtctagtaaatgagacagagtgagagttgtgaaagggggcatggcaggcactaatccagctacaggagcccaggagagactgaaactaactttgcaaaatcatggcagtaagagaaatctaacatagttgactccatcctgcttctaacctccaagctctccttggtcattcctgagcatagaccaaccaacttcaggagcaatttagtttatagtttaatcttaaagcaagaatgataatagcccttcccaaaactaaactgcctttgcaaaactaatgaaagtccttcattctgctaagatgtaagcatagttaaatgacaactagctattgttctggaggttacaacatttgtaacgtttcccattactcctgtagataacataactattgtagaacctacgattggctttttgagatgtctttttagagttctgcatttctgactactggctgactccacctggaccagcaacttgtgattcaaccggtcctgtgaccccctccacccagagggggctcagtgcataaggaccattttccacactcctatgatttcatccccaaccaatcaacattccccattccctagccccttgcccaccaaactatccttgaaaactatccttgaaaacctctagcctcagagccttcagggagactgatttaagtaataactctatctcccacctggttggcctcacgtcaattaaactctttctttactgctataccattgtttcgaggaactggttttgtctgtcagcaagccagaagaactcacagggcaattacaagatgaataagagttaccggggtgaaagtaggggaccaagtacactaggcagagggagcagcctgtgcaaaagcccagagacagagagcaaggcagctgaatctggcatcaccaagccccagtggatgagcagtgcagatcctcccacttacaacatccccactgggccccaagaaagaggctgaaatttccagttcctctccatatcctctacccacacactcctgacactcatcgtcttcataggctacttcaggcacaaaactgtgaatgagctctaaaatgtggtttcctcatctataaaatgggataataaagttttatcttatagagttattgtaggtattgaataggttgatatacataaagcgcttttcaccaatgtctagcacattttcagtgttatatattagctattcattgttagctagaggccctgaaaatgtgtcgcagtgaagccagaggtccctgaggtcaggctggggatatcaagtcccaggttttctgcccacccacctcctcttccaaataaggcaaatgcacttttttttttttttttggcccaccattgtgcagtaaaactgcatcctacatagatttaacttaagcaaattcaagaatgcccagctggctggatgagactgggagaaaaataacttcaatactgccagtcctactccattctctgagagcaaatgccccaggtgaacctggaggagagggagaacaggcactcccctccagccacagttttccccacctttccccggtctaagcagcttgacgtatactttgttaaaggattttcaagcctaattgtgactacctgcaattttcaccccacaagccgactttaaaacctaactcttgctaaaaagaagacactccagcacctctgtccgcttagcatcaagtaaattccaatcaaattagaaatcttgaaggctttctgagagctggtctttactttaaacagtttaaatcacccctaagcttagcctgaggagtaggattaaagcctccctgatgtggaaaaaaacaaaagaaggaactgtgatttactgcctaagccaccacccttagcttcccccaccacactctccaggtaaaatctgcttccgttctgcctactaccgtaggctaaaaagagatcaccggtcctgagactctagtcacatggatgcgcagcaggacaggcacagagctccgcagcttgaaacatagatgcttgtagctcacaagcccacaagtccaccagcccgccacatctcttgaagctcaggcaggtacgttcgccccgctggctttaatttcaaaatccagcacaatcactgaaaaactagagcgatttgctctttcagctatgcacaattttcatcagcagtctccagtggctacaatctcaggcaggcttttaccaccttttctcgtcctctctataccaacacatattctggagaaatggtttttctaatggcctgtggaggtctgcctgtgttttgaggctttgtctgggcaccaagtccagcagatacaattctctttcctgagtcaagcatttataaagagctgtgatctcagatttcagcttgcttctgtcttccttcttactcctgaaatctgatcatcccttttgtctttctaccacaattatatattgaaagaaaaacatgaagatgcaagagtatgcagggacatgtgtaagtgattctctgcaagtgttaaacacagggtgtaattacagctggaaggcagtgccttgtgggagaaaagacaaaaaaagaggtggggggggatattctttataaaatgttcttgtctttatttttaagcttgatgctcacatctcactttctaacacacacggacaaagaatatactcatgtacaagcaaaaatactcatatatgcacatgtgcacaaacacacacagacaatgtagtattttagagacccttggtcttttattcttttcagcaaatgaacaattagcctcaatagtcaaataaacatcagaagatgagggtttttcccccttcctctgctgttacaaaatatagcaacaaagtggggcaaagtagcatgaaacctgaagcagctcacacagaaggactcaagagaataggatcttccaaatggaagtttcagttagcttcagtgttctcagaattgcatctcctaaattttgattccaaaagggaaattccctatggcccagcaggcccatacaatcaattttccacattatttgtgtaaatatctgtcctgttgcatattctggaagaagtgacagtttcaaaatgagacttgccaacacacccccttgtcccaaacaataagaatcagcagaacatccctatcagccctctcaatttattcttcatcagaagccagtggaaaaggaattcagcaaagtgagatccccaactgcacaaagcactaacctaatcacacccaaaggaaaatgagagaagagtttgacctagagagtcttaaattagtgggcacactcagagactcaggggaattttagctaggcaagccaccaataatttagagagaggtggctctaatgaagggtccaggctgcagggcatggtagacaatctttcaaggcaaaggctctgggccacgtgacctgtccatggcacagtgggtgtgtcaagcacagtgaagtgtacagaaggtgtctgacttatgctgctttgatgtacaatttttcagctttacaatggtggaaaagcagtatgtgttcagtagaaactgtactttgagtacctataaaaccattctgcttttcactttcaggagatattcaataaactacatgagatattcaacactttattataaaattagctttgtgttagatgattttgcccaactgtaggctaatgtaagtgttcccagcatgtataaagtaggcaaggctaagttatgatatttggtaggttaggtgtattgattgcacttcgacttacaatattttcaactcatgatgggtttatcagatgtaaccccttcataagctgatatggtttggctgtgtacacccaaatctcatcttgaattcccacgtgttgtgggagggacccagtgggagatggttgaatcatgggagcagtttcccccatactgttctcatggtagtgaatgagtctcacgagagctgatggtttgataaggggaaatctgttttgtttggctctcattctctctctttgcctgctgccatccatgtaagatgtgacttgttcctccttgccttctgccatgattgtgaggcttcctcagccatatggaactgtaagtccaattaaatgtctttcttttgtaaattgcccagttttgggtatgtctttatcagcagcgtgaaaaaggactaacacatataagccaagaaacacctgtacatgtgtttcttgctttagaaagcaggaaggcaattaggctttattttacatgaatctacaatgttggtgaaacctgctcttccaacatcctgcgggctcctggaatggactctgattaggcataaaatgaggcatagccacacacaatgactttatctggaatactgctcacctccatgtccctcctaccctgcaagaatgggaagtagactcattagcatcatttaaaaatggtctcctggctgggtgcagtgtctcatgcctgtaaccccagcactttgggaggccgaggcaggtggatcacgagatcaggagatcgagaccatcctggctaacacagtgaaaccctgtctctactaaaaatacaagaaattagccaggcatggtggcgggcacctgtggtcccagctactcaggaggctgaggcaggagaatggcgtgaacccgggaggcggagattgcagtgagccgagattgcgccactgcattccagcctgggcgacagaacgagactccgtctcaaaagtaaaaataaaaataaaaatggtc

SEQ ID NO: 2454 - DNA, 2321 bp, Homo sapiens
catgtgtaagagagtgttggaatgggaaggaaaagtgtggagtccgtgtggatttctcttattttatctgtggcttgaatgtacatttctgagagagggagtcagatggtgaaagggagagatgttcttgctgagtttgtttatgttgtgcttcagaggatgtaagacaagcagcaaatcagcagagacaagttaatgttcaccaccacaaaagtgaaattaaataaactgattgggcagtcccttgaagatggagtctcattctgtcactcaagctggagtgcagtggcgtgatctcagctcattgcaacctctgtctcccgggttcaagcaattctcctgtctcagcttcctgagtagctgggactacagctggcactgcctcccaagcccgccgccatggccgcctacaaactggtgctgatccagcatggagagtgcatggaacctggagatccacttcagcagctggtacgactccgacctgagcccggcaggccaccaggaggtgaagcgcaggcgggcaggcgctgctagatgttggctatgagtttgacatctgcttcacctcagtgcagaagagagcgacccggaccctctggacagtgctagatgccattgatcagatgtggcccacctgtaatgaggacttggcgcctcaatgagcggcactatgggggtctgaccgatctcggtaaagcagaaactgctgcaaagcatggtgaggcccaggtgaagatctggaggtgctcctatgatgtcccaccaccctgctggagcctgaccatcctttctacagcaacatcagtaaggatcgtaggtatgcagacctcacagatgatcagctatcctcctgtgagagtctgaaggacactattgccagcgctctgcccttttggaataaagaaatagttccccagatcaaggaagggaaatgggtactgattgcagcccatggcaacagcctccggggcattgtcaagcatctggaaggtctctctgaagaggctatcatggagctgaacctgctgactggtattcccattgtctgtaaattggacaagagctcgaagcccatcaggtgcatggagttcctgggggatgaagggaccctgtgtaaagccatggaagctgtggctgcccagggcaaggccaagaagtgaaggccggcgggcggactactgtccccaggagcaccctccttgcctggtgtgtccctctgctcatccctcctgcacacgccacactgaccacatctgtaggcatcttgagctgtagctgcagatgaggaccagtggctcccattttcgttttagccatttttgtctcctgcacccactcccttcattcattctagtcagaatagcacttctagggcatgggttctcagtccaagctgtggaaaagctccccttgtccaagagagtttaaaggtagtgacttgggtttttgcgaccgctttgtttactaagaacttgtgggggaggaaccatgctaagccatgaccaatgaggagaagcaagagagcctgtctgtccccaagagccagtcctctgctcttctgtagtcaggccactgcctgggagctctagtcattccagtggaagatgaatgtaactcgcatggtgatgtgacagctgtttcctccctgaccccagaggagatggctctagaaggttgggatcaatcctgaatttagcttaggtgttacatttacttttataaaaaaaaaaaagtatagtatatataaataatacaaaaccataatccttctcggatctcttgtggcagttgaaatagtcccacatgtggtcatcagaaagtaagccattcctcatactaatatgggataagctccttgacctcagaggagtaggagtgcttcctgctgtgtgttttagaatccctctgctgccttgtttcatggcagtaaaatgcctcttggtcctgtccaagtgtgtctttcactgactgatttctgaatcatgttctagttgctcggccacatgggtccagtgctcatttgagcatcactgtactaaatcctttctccaggaatgagtataataaaggagttatgtgcaattaaaaaaattggcctggtgtggtagtatgtgcctgtagtcccagctacccgtggaggggagcattggtggcactgaggtgggaggattgcttgagcccaggaggtcaaggctgcagtaagccatgatggcaccactgcactccagcctggacaacaaagtgagactctgccaaaaaaaaaagaaaagaaattgtagtaacctaagtgaatagcctatggcctttgataattccac

SEQ ID NO: 2455 - DNA, 784 bp, Homo sapiens
atattgactgagcttcgagaaaaaaggatggctataagagtggggatttcacatcaacctgaaaagggcggaggcagccgagattacaggcgactgaaatacaaaggaaacccactggagcctgaagaatgtctaataactatcaaatctttgttctgccagtccacataaaacgaataggacgagcactggatctaagtgacagagaaagtgcagaaagggttccaactgtaacggtgttaggtgtctcctctcacaaaggccatgaggagctactgtgtcaaaccagaactagaagcatgaagtaagaaaagtccgtcacgagagaccagctctccattcacgcgtgcgcgcaggtcaactgatcttcagtagtattatttttctaatatcgccttttgatcgtcttgacagggtttaggtagttataagccacaaaaatccctagagctacttgaaagaagtgagcaaaggagaaattgctgaatggcaccctgatttccatcagaaggaaagcagtcaggggcaggtataagtgcaagactcccaagcctgtggagtacaccccacacagaatctccacctgatccaccagctccactgaagccatctgcttataccctgctccccagtagaaaaaatactgcctaagggcaagactgtaacttcctcccttcttggagcatcaccctctagaatacctcatacgtagaagaccccagggcttactctctttgtaaggttagtagtcaaaagtgagatcattatccaaactgtttctaat

SEQ ID NO: 2456 - DNA, 4966 bp, Homo sapiens
ggaagttggagcacagagaaagtgacttgctgaaggacacgctacaaagtgagatcgctaaattctacgcaatccaagtccccttgggtaactgaaggccctgactggctcctctccactaggcaccaacactgctcttctcaggctatttacatgctttatcttgaggcttgagttttgaccattggaagcactattggccatgagaatagaagacgagaggtttacacagttactcaaggaagctggcaacttcaacagctccttattcatttccatggcttccagctgattttcctgtgttcggctctgggaaacaaggaaccctctctgcttggtggacatcaccctgcacaccacccctgccgcccaccactcgcgtcctctccagttcctgcctcccctctctgcctgctgcagatttggctgcttctttatcctatgaccagttttcatcggctctgaggattagcagggaccagagcccaagccccgggagtgctcagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggccccagggcgagacaggcgtggaaggtgcaggggtgtgtgtgggggcaggggctcctggctcagagccgtatccaggaaccccccttcaggctggagccctgccctgagccccctgtggagagactgtggagagccccctgtggagagggtgactgtgggagagcagcatcaggcctagtctcggctgtgaagtaccccccacctccacgcaggatcccggggattctgtcaaggtgggggccgcctgctcagcccaggctccctgaacgtgtggctagctgagtttgcggaagaaaccaggagagtgccaacaccaggcttgcaagcaagaggctccctgactgcctgatcctggagcgcaccccatcctccctgtgttccctgggcctcagctgttccccagtgaccttggagacaccctgccccaccctggctccacaggagccctgcccatcaccgcctcagctctgagtctcccctggggacacaaccttcctcctggtgcagaggcgcaggatgctgcccctaaggcccatcttcctctgcagcatgttttgatgtcagctcattcacaggaaagaaacaatcacatctcagtgcccagaatggggaccaataggagaggtcactgggaataaagcccacacgcaccccagggtccatgggctccccagaaatgcaggtggcctccgccagagccaacaagcctaagttgctgatcagcccctccctgcttccctgtgtggaagaggaaacagaggcccagactagtagggctctgccgtggtggccggctgcgtccccagacctctggtcccagggctggctgggagtgcccctccctgtgctcacttcctgctctcctgggaaatggctcagggatggggcgtgtggggacagatgctggcatagctcacaaaatgcttgcacaagggacactccatggcaggtccctgcaggagagcaaagtcacaacattcagagattccctgcactctgaggcccgcagagcctggccgaccaagcgaggctgggaggatgttgcctgctggtcagggcagccctctgatcagggcggccgagtgaggctgggaggatggtgcccgctggtcagggcagctgagcgtggctgggaggatggtgcctgctggtcagggcagccctctggtcagggtggccaagcgaggcagggagggaggtacccaccggtcagggcagccgaacaaagctggaaagatggtgcctgctggtcagggcggctgaatgaggctgggaggatggtgtctgctggtcagggcagctcaggaggtgctgcccaggaggtgctgtccaggcagagcctagggctggtgtgggtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttgaggttgcttcttatgcatatttcatctggaactttcccctttgggggtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactgacatttagccagtctcctctgtcactctccagtgacatgtacacactgttggcacgaactgcagatgtcacgttctgtggctgagagcctcagtgtgcatctgtagtaggaggatgtcagtgaggactgtcctgtcgctgctgagctggcaccgactgtgcctggtctacactccaggtctgccaaacgacccagcaaggtccttcacaactcttctgatccaggatcacacatcacttgtgctttgatgcctgcttctgaacaattttacctcctgagatgtccatttttgggagtgtgagccctcctctcctggtgacagctggctgaggccgtccagcctcaggacacacagggaacggctgcataaggagatctggggcagggggcccaccaggatgttctgccctgtggggggcaacaccggctgtggtctgccggcggcatccagggacagtctgtctaggtgaggctgaggccgcccccactcgctccctcacccccatgctgacagcagtgagctgaccacagactgggggagccccacagggagactggcctccccagcacatgccccgcagtgccagacgcggtcatcacagaggcaggtacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctggtaccgtaaaaaccctatcctctttgttgggccttaggagtaaatgggctctgaggtagagagatcagtgagaagctagttttgttctaaaggagcagagtgtatgcgtgtgtgtgtgtgtgtgtgtgtgtgtgtgtgtgtggagcagggcgggggggtggtgtggcatgcaccctgttgacagcataagattgctgttgttgctaatatagctattcgttagtatgatatcctacgtctctaactgataatggaaaagatggaaagccaagaagccaatccacaatccaggaaggaaaatgtgtctacagtcataagggtctcctattatgagacccagagtggaatttgtaggatgggtcgattcattgtatttctatttcttcctttgtccacatattcaatatatggatatccttctgcctttattttaagtacccagtgtgaaaatcctttgttaagttaagccatgtgagtaggctatagagaactggaatagttgcaaaaatactgaatttagcccatagaagtcattcagcagtgtaaggtaccaggaacgcagtgaactattatggaattgttacagcctaggatgaaatgtctttagagcctcacctatcagtgtgatt

SEQ ID NO: 2457 - DNA, 3652 bp, Homo sapiens
accatgattagcacttgaaaatttagaggtgcatgttgtttcagttctcctccgcaagaccccacgagttgtctgaacacccttttcaaacccagattccttccaccataccatcctggctccaggagttgggagaaaggaggcaggagccaggaacctgggttctcatcctggtttcgccagcctccaggtctgctctgtgaagtgggctcataatgcctgccttgcccactcacatctcgctgggttcttgggaacctagagagcactacacaagcaaagagtacctggggccatggttctctctgtggccactgccttccagcccatctccgtgcacgtctccatctgccttcccctctctgtcccactgtttctctcagtccccaccttgcctgccccctggatcccaggtttgggagaggggcaggagtgacaggcctcacccccacaggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatcaaccccactgccccaccagagctgccagggtggcacagggccctgtccagcccctggcacacacttccctgccaggcctcagcctctagcataagctccagagagccagggcccatcagtttctctctgtggatttgtatctcagctccatgatgccttgggctttctgtctcctcaacaagagtgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcttcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcctgagctccggagtcttcccaggccgatgcctctgcagtggcccgtcgcagaggtccagataaaaccagagggatccggggagaagagggtcccaggatacacgcccagctttgcccttagacaggtcacagtttcctcacgcccctgctcagacccccgcgggggcccaaatctcagttcctaccccagattgggagcagcctagtcgccgcacctgccacgtcgccctctgctggccgagggctgcccagcggccgcctcccatccccacacagggac

SEQ ID NO: 2458 - DNA, 12956 bp, Homo sapiens
attaattatatgtaacacaatacatattcattataacatatataacattatataatatatatcacatagaacattgttatagattatacattaatattataatatataatgctatatatttataattatatatatttaataaatattattttatttagtaaaactttatataaatttttaaatttttaatttttaatttttttgagatggggtctcactctgtcatccaggctagagtgcagttgtgtggtgccagctcactgcaacctccacctcccaggctcaagcaattcttctgcctcagcctcccaagtagctgggattacaggcacctgccactatgcccggctaacttttgtatttttaatagaaacaaggtttcaccatgttggccaggctggtctcaaactcctggcctcaagtgatccaaccacctttgcctcccaaagtgataggattacaggcttgagccactgcacccagcccatttattttattaaaataaaataaataaaataatatgtttaattaaaatatatatttgtataaaaatatatctattttaatatatgtatatttatatatgaatgaactacacatacaaatcttatatttttataaatgtttaaatattcatttatataaatataaatatatttcatactttagatataattacatatattaatatatatgcatataaatataaatatataaatttatgtaaatttaaatatacaaatataaaacatatgcatatttttatacaaatatgtatttttaaatatatatatttgtctaatataaatatatctgtattagggttctctagaagggcagaactaataggatagatgtatgtatgaaggggaatttattaaggatcacaggatcagaagttgaagtcccacaagaggccatcttcaagctgaagagcaaagaagccagttgagtcccaagacttcaaaagtagggaagctaacagtgcagccttcagtctgtggctgaaggccagagagcccctggcaaatcactggtgtaagtccaagagtccaaaagctgaagaacttggagtctgatgtttgagagcaggaagcatccagcatcagaggaagatgatggccggaagactcagtaagtctactttattctagtctccctgtcagttgattagatggtgcccacccacaataagggtgggtctgcctctcccactccactgactcaaatgttaatctactttggctacactcacagacacacacaggaacaatacttcgcatccttcaatccagttaactcttaatattaaccatcacaatatatatttctatttacatatatgtatatttgtaaatatacatattatattaacatgtcacatttaatcctttacatatgtgacatgtatgtgtaatcctttacatatatgtgtatgttgattgcttatgctttatgcttataataaaaaatgtttacatcattcacctagagtgagaatatgattaattattcctgattcacagtaaaaacatttattagggtttttttaattcccaaaaatgttcttgacttaaatattatgggtattgatttttgtcctttaaaagtttctggaacatgtaaattgaatttctattctctgtctcccattatgattaagttctctcagaattttaatctcttttttcctgtactgtactgtaaatctttttcaaatttgtattttataataatgataccgtgacccaataaatgacttcattttttctgcctccattggaaatttttatttttaatttgtgtttttaaattatttattatctatttctgaataaactcatattctgtgtcaatcctttattttgtggtaacattccattcctgcttttaggaactaggtcttttaagaattctaaactgtcgtggtaaaatttacaaatctttgttattcttttttgaaaggtatatttttcctttgagtttttactatgagattgtcttttcttaattttgcaaactttttacatgccagagattgatttttattgctaataaatcttaaacaaagagagttatattcaggtataccttttgttaactgaaacaagttatggagactgctcttgtagtgttattgcccatggaatttctgattgaattctcttaaacatatctatatctggaaagcctgtctgcacatagttctgttggcataacctgcaacatttagcaacgattaatacagattaagtttcttatgctctaatctcaagatggttctgtgataatttgaaaaactgctaaagaaaacaatgcattttatagaaaatgcatttctcctgtcaaagcctccatttctatcaaagcatctcttgtgaaatctatacatccttgtaatatctcgggcctgagaaattgtaaccaaactgtttgcatcattttatgtctgcaaggaaacagaatgctctacggctaatctttcccttggtctatgtctcatgagtgatttcaaacatgtgcaatcatataagccaaaatatagctcatgttctgtcaatgggttgttgaccagtctaagtttccaatgttgttctattctttctatgtcttgataacttcttagcatgaaaagattaaatctgaaagctaaggaactattttcaactgaaattctaggtttaaatctaaatatctctattatacttgatgtataataaaattaattatttttaatgttatgcatttggcaccaatatttatattgtcccaaaacaataaagtctatttcagtgaaactctgcctttgtttaatagatcttcatctatattataatttaaaaggtgatttgttttttcttggcacaacaatttcaccaatttttgtcacaccaggaatagtaaactgcatgtatccgcatcaaaatagaaaaatgttgtttgtgctttttttttttttaactatgacacattactgtttaatttttttagtcctctaccccaaattttaacagttaattagcatatcatgttacttgtgaagaagaaaacactctttagagtggcaagtggctgggtctcaagtcagcagaaatgtgtaccatatctgctgaagatcaaaggtaacagattaaaaaaatgtaagtgatagcagtttaggattttgtttctgttttttttttaactaatcaaaaaatgcacttataaaatataatttttaaaaagtgttgtctaaatttagtattcaatcatttagcacaccgtcattattattataactattatattaactcttctgtattcacattggtcaaataatataatgccagccaagtaaagtttatgtttttaaatcatacaagtatgtttgaaactatattcacaatctctgacattttcagtttcctattaatatgctttaaccaaagtgcattataaagaaattataaaaaaactgacatcaaggtcaaatttagttatttggtaatataaacttataggcacaatgtgcagctcccttgtcttaaaatatacctatgcctgcaaggttcctgccagtaactttctacagttgaggaaactgccctgatttgcattgacattcaatagcttcccccaggcaaatacctgcaatcatctgttgaagcctgtctataggcacagaacagccttagaacagtagctctgtaaaagcagttattcccttgactgttacaggaaggacattagagaacacagaagattattaacttttattataaagttcttttcattctaaagacttttgcaaatttatcattgatttttaatataaattagaagacaagttagtctatatttgctaaattctaggttggaacttacaatcattggtatatatgatttgctcagttctagtaaaccaaactccatttattaagcccacagcatgcactgagcactttgcttagtccaatggatctatacaacacaaacttttatatgtaaaatttaagaagaatgaattcggactcagaaaaaaactgcaatagaatcctgtctctggcttttagctctattctgtttgtccaaattacagagcatccttatgtattcgattctttacctataaagttatgctgtccaactttttgagtggttgtcgtgattcaatgttataatctattttaaagtctcagcacagttgccctgtcatcactctagagaaggcactgaatgaatgcaagccattactactatttactatcaaaaatctctttagtatcaactgtgaagacagttacatagctcttcgttttcttcctacctgagagattcttaaaatattacttaaaaaataacccagagaagtatatcttaagacatccttagaaaagttaaaataaattacaggtttggtctgatattcagcaagtatttaagaatatgttcatgtatgattcatttgtatagacagtatcttcagtgttactgaaatattcatgacaaactatgtttaaaagcagaattaattaaacaagaccagaagctactcaaatttaagtcgctgagattaagttttccttttaaagccaaccctatagtcccatagatagttttttggaataaacataaaaattgacccttgtgttcttaaagcttgaaacttacatttgttttatctgagtttcttccttaggaaaggctcctccggcctctcaaaacaaaagaatcaaataactgaaactcacgagatcatcacatccagacaatgagatgctggacccctcattcatcacgattgcttccttgcccctccctggctcctgttttcatttcttctctgctatataaactcctagttttagtcagtcatggaggtggatttgagcctgagctcccatctccttggctgcagcacctgattaaaaccttcttccttagcaatacttgttatctcagtgactggcttcctgtgtggtgagcagcaggacctagaccaaacccctagtgtttcagtaacactttactggagaaaaatactattaaaaggaaaaacaaaactataattctcattaatgatataaaccagaaaaaaaaagggaacgataacattgtagccactcagtgggttctcctttgcccctgcctagatggagccaatttatcaaggcaatggaattgtaatagagaaagagtttaattcatgcagtactggctgtacaggagactggagttttattattactcaaatcagtctccctgaaaacttggggattgggtttttaagtatttggtgggtagggggttggaaagtgcagagtgctgattggttgggttggaaatgaaatcatagggagttgaagctgttctcttgcactgagtgagttcctggttgggggccacaagaccaggtgagccagtttactgatctgtgtaataccgactgatccatgagtacagggtctgcaaaatagcccaagcactaatcttaggttttacaatagtgaatagattttacattagtgaataggttttacaatagcaaattggggaggttcagagcctttcagcctccagctgcataactcctaaaccatattttcaaatcttgtggcaaatttgttacccctgtaaaagcaattctggtccccaggcaagaaaggggtttgttttaggagagggctgttatcatctttgtttcaacgctaaactacaaactaagttcctcccggagtttctttttttttttattaattttattattattatattttaagttttagggtacctgtgcacaacatgcaggtttgttacatatgtatacatgtgccatgttggtgtgctgcacccattaactggtcatttagcattaggtatatctcctaatgctatccctccccactcccgccaccccacaacagtccccagagtgtgatgttccccttcctgtgtccatgtgttctcactgttcaattcccacctatgagtgagaacatgcggtgtttggatttttgtccttgagatagtttgctgagaatgatggtttccagtttcatccatgtccctacaaagaacatgaactcatcattttttatggctgcatagtattccatggtgtatatgtgccacattttcttaatccagtctatcgttgttggacatttgggttggttccaagtctttgctattgtgaatagtgccactataaacatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttgtcatgtgtgttttggctgcacaaatgtcttcttttgagaagtgtctgttcatatccttcgcccactttttgatggggttgtttgtctttttcttgtaaatttgtttgagttcattgtagattctggatattagccctttgtcagatgagtagattgcaaaatttttctcccattctgtaggtgaactcccattcacaattgcttcaaagagaataaaatacctaggaatccaacttacaagggacgtgaaggacctcttcaaggagaactacaaaccactgctcaaggaaataaaagaggatacaaacaaatggaagaacattccatgctcatgggtaggaagaatcaatatcgtgaaaaatggccatactgcccaaggtaatttatagattcaatgccatccccatcaagctaccaatgactttcttcacagaattggaaaaaactactttaaagttcatatggaaccaaaaaagagcccgcatggccaagtcaatcctaagccaaaagaacaaagctggaggcatcacgctacctgacttcaaactatactacaaggctacagcaaccaaaacagcatggtactggtaccaaaacagagatatagaccaatggaacagaacagagccctcagaaataatgccgcatatctacaactatctgatctttgacaaacctgacaaaaacaagaaatggggaaaggattccctatttaataaatggtgttgggaaaactagttagccatacgtagaaagctgaaactggatcccttccttacaccttatacaaaaattaattcaagatggattaaagacttaaacgttagacctaaaaccataaaaaccctagaagaaaacctaggcattaccactcaggacataggcatgggcaaggacttcatgtctaaaacaccaaaagcaatggcaacaaaagccaaaattgacaaacgggatctaattaaactaaagaacttctgcacagcaaaagaaactaccatcagcgtgaacaggcaacctcctggagtttttttagcagtatcccaggaatgatcaaggattgtttgggggttagaagcaagatggagttggctaggtcagattcctttcactgcaataattttttcagttataattttgacaaagatggtttcaacataggaattacaattattaacagtcatgaaattggcagaatgttgacaccaaaaaccagtttacatcatcgatgaagaactaagaggcaaaagtgttactcattggctaaataagttattagtcctggatggctactagaaagagactcaaaaatattgtatgttagaaattaactgaaatactagattaggaccagtaaaacttataaaacaaaaaggacactacatgatgtttatatgttaatttctttaaatttagttttaagtgttatttcttcccaaatttaaaacctacacacatatagattttttagttagaattatattaaataacaattatttattggaaatgtacagaataattactttaacatgcataaaaattactttttaaataccccttgtgtataatgaaagtaatgagcctaatctactgcaacattagaaaattcctacctgtcaaaagatttctattaagaaagaagagtttcacaataatttaaccagctttgaggagacataatttacaaaaccatgtttattagttgcatgagtaaaatttaatatttttataatataataggaaacaactatgtgagattttggaaaataaataatgaataattaatatttattttattctcagaactgagtggaaataagacatataggagaccaacaaaagggatcaagatgtcagatttgataagcaattgataaagagatttagaagtgtggctttagacctgtggctcaaatagtggtttgaaagcagaatcaaggattaatcaaagtgacttcatcatctccgtatcagagaccgtttataatactgtccaaagtgctgaatgcttgttatatggaggcagataatttgatggagctacatctaacttgacgtagagaccacagtgtgtcaccagagattctggcctcctgagctggatgcagaaactgagagaacttggagttgactcccatggggagtgggtaagtattttctgtcatggtaataatgtaatcaagatatttttgataccagaattgtgcctagctttggacagtggaccatgggtggaggaggcgagtgtcgcttctgggcaggaacaataaaaatatcctgcacaatgtttcttactgtctcttcctctcctgagacaatcctggaactctcatgttcagattgtgaaggcataagacagatagagataagattcttgaattcccacatataaggagctgtcctagagaggttactaacttgctgtggggttttcttgaatggaggatgaacctctattatgttacaccctaaaatttggggaattattttttggttttgtagctataatatttatttattgaatatatctatatatctcctatataatgccataatgcaattaaaattaaacgtacacatacaaaaatctatagctcaatggaaaacacctgaaattgggtgatttacttttctttgtaaagtgagaaattaggaaagttattcttatatgtaaatcttgctacatgagaaaaagatgtaagggaaagatctataaacatacctgggaagaatgatatataaaatgatatattagctttacatatatatgcatgtgtatttacatatatatgcaatatatatgtgtatatattttagatgttatttaaaaatatttgtgtaaaatgtttttttgcccaaatgattcattaattttaagcacaaaatatattatgtttctataattagttgcccatgtaatttatcatccaaacaatgacatttttgaatgtgaaataggacacaattaataattatgtcagaacaacgaacgtaaactaggactcttctgggcaaactaggacatatggtcaccccacctagaagttttaatttcaaagctctggaaattcttgccatttccctctcactttctcctcatgaaatacaaaacaaacgaaacatgttccttcctcaccttaaaatacatttgatgaaaatatggacgtccatttcactattggagcttaggactcattgctaaaccagatagctcatcaatttgtttaaacatcctaagagcaagcaggtcatagtgggaagactgccactagtaactagaaatggaggtggatgagcaagagtgtgtgaggatttccacaaagtaaaacaagactaataaatagtaactgaacgcacccaagatgaatcttcacttactttacatgcaaagagctggtcatgtctgaatacatagttcctaaagctaaattatcattaaccttgagagagatttcatggtgcatgctttattgttctcattttatttctaatttcaaactgagatcttctgccaagcaactttcctttctccttcaataattacctgaaatccaaacttctatatgaagttgtccatgattaagtcatttaaagaaattaaacagtcttgagcaataatcagtcagagcagttatccattttagatgagtcatctgaataataatcattaaaaaaatcctcttcaatagcagttttagcctgatttttttctataattgccttcatccctcagcacaattactaaatgtccacacacttcttttacagttttactacccaaatcatttgctcttgctcatcagctttgcaaattaatattttgttaaatgcaccagggtagcttatttgaaaagaatgctaaagtaatttttttataaatgactaataaatatacctgaaatgacatttagtaagtttaaggtttcttatagtagggtaagcttgtgtttcttggtaaattgcacactttccaggatattgaaatttattaagaccaatagcagcagcattaataatgatgataataactacccattgattttgccccaaatatggggtagatgctaggtattttatcaactcttaaaataagactgtaagctatttttatccctattttaaacttcagaccttatgaacaaatccagcatctcatggatgattatgcttttacatatttgctttcaaattttctaacttattgaaacaataaactctatgaaggcagagaagatgtctatgtctattctacttgctttgccctgtccctatcacattcaaggacaatgaaggtatcacacttcagaaaactatgaaaaaataaaaatatatataaaggaacagagctaactccaaaaatagttgtgtttgtgttaatttggtaataattattgtgtgcttcagttctttatacaatttcttgctcatatttcctcatctacaaaagcatggaattattactcaaattttcctttcattcctatatgaaaaaattacatataaaatatagcataaatttagaaatgaagttgacagttttatggcagaagcaaaaactgattgccagccattaattaacactctaatttcctgttaatagatttccaattttgttctataacatttaacccattgcagaggatgtcttcactgaatataagccagtcttggcaaatgggtttcctttgccagatctctcctttcccagtctctcgtgtcactgggggaggttctgggatatgtctctggtcagttatgtgttttgttatgtgaaaaatattcttgatacaatagtagcctccacatatacgagaaggcatgctatacaaaaggctgtggaacagaaaggctcacaaaccaaattaaagtgccccaaatcacagagattataaaaatcagagtaaaacacagtgagaagaaaggggaaataggtgggataagctaacacagaataggatgtaagcaagatagaaggaccatgttacctgaatcttgagtgcatggggtgttcacacatcttgtctttttccctgccacatcaatttttcctgttgattatgtagttatgatgaccagagctgagatttctagcaactgtgccattagacaaaaggtgttctgtgccaggaacatttgatccactggagagacacagggacacagaccaaagtataagcttggcaaacatcttgatgaacagctatgggatgtatttgtgtttctttggcagagaaaacatgggaccagaatgtgtgttatctatgtgtggccaaataagaccccgtgaatattaagtgcccaaatattttgagactcatatattgaatcacgtgtatatttggtatatcataaatatttagtacacaggtgcttcataaagattaaatatctcttggtcctttcatccatgtatatctgtgtttgacacacacctatcctacttattaactacttatcttataagtaacacatcctatgaattctgccgaagtctaacaaactctttgcttactggttacttatctataatgaaacgactttaaatagttttgcctatgtcttaaaactacaaacttaattcatcgaagagaattggatatgctcaaaaggaaatgtgcatttcaaatataaagaaaaaatgtttgaaggcatatggagaatttttttttaactcatagaaaccagacctcctgttttctgcctgctcacttccttccagcttggaatgttggtataaaaacatggctgtggagctttaagagccatcctgcttctatgatgataaaaagtaaataggaacaagttgctgcaagttgtaaaaaaaaaaaaaaaaaagtatgtgtccttgacaacatttttgaggcactgactaaaaggtagaattgtttactttagatattttgtgacataagcaaaactgccctaattatccatatcactattagattttcttttgttttcactcaaatatacttaaatgattttaagacctattaccaactctcaaagttctatatcaggggaagatataactcacagagtgttttgagctaaaaaatgaaaggtgtgagaaagacgcaaaggtattctttaagacatgtcttatcaattcattaccatacataagtgttcagaaagttctagcttattctgtccaaaaaaagtatcaaacaccctcagaggaaaataaaaaactgtctgttcttttgtttaatatataggtgtgtgtgtttgtgtacatgtatgctcatggcaatctaaaactattcctattatgatttttgtcatatagtatgcataatatgatatgcatatattatttttaatcatattatattttactatatcataatgtttatgtccaacaaacagatgatgtaaactttgtgctctattacttggagatatatatatatatatatttatacacacacatatacatgcagtaacaatatcc

SEQ ID NO: 2459 - DNA, 585 bp, Homo sapiens
tctagtctctagtgccagggatagtgacctcagcctcaaaatgagcaacttgagaaaggggcgcattgtgtagacgtggaccgtgggtttgcgctggtccactcataccagtatattttaccttatactaaaagcctctctgtgggctgccatacatagagttcatgtagtggcctggcctgtataactgttgatagtatgatgtgggtaatggttcagtagaaattctctgagaaaatggggaaagggatcagctttaggtttcttacttgcaatttaatttgacctaaaaatacatacgttctgaaaattagaacttaaaaatggcattctctaaagacgtttgtgcccagaaatcagcattggtttgcctaccaaattagttaagcttcttcttttcctggcatttaaagccttgagcaatctagctgcattccacctttccaacatttatccccacagcctccctacccataacctgtatttcctcaaacgcacgtttcacttatatgccctgattccttgtctttgcttggagtatctcctttgaaattcatatcaaatgccactttgccctattcttcc

SEQ ID NO: 2460 - DNA, 881 bp, Homo sapiens
agcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaatttgattcttgctcctcttattttttacacagtcatcagagtaaatcttttcaaaggtaaattggattttatgacttttctgcttctaattagtttcatctatacattaaaatatatttccaaactattctacactggtctgtcactggccac

SEQ ID NO: 2461 - DNA, 42992 bp, Homo sapiens
cagcatagtcacaatcaggcttttttggggttatcaatttcctggtgaaataattatagtaacagcttaacagtcttttcttatcctttcttttagaagaagtaagcatgttttactaaagtcatgtacacagctgtgatttgaatggcaatatttatcttacatctgtgaaggctgattttcctgacctttgcttcagcataattgagttaaacactcaggggactgtgttactatatttaagacaatatgcataacgggtgttatttagctaagtggtgcctgcccagtaggtgctcaggatccagggagagaggcagactcaacatgcaaacaactcttctatgagggtaagtgtaattgagggccctaggagaactttagtagtggagggtttcttgtgtttctccctttggactgcctaactcaagcagtgttcttgacccatataagctatgtagtgtttcccctctcttatctactgtactaatttctgtgtctctcttggaaattactgccctgatctcgaaacttaacttcacccattgcttggtgagtggtgtggaaaacttctctcgggtctatgtcttatccctgaaaaatcttgccacagctgctcaggaagagtgtacaaactcatttccccaacatgaaagtcacaaaaattttgaaaaagttttccctaaaattgctgtgagaaggtcttgctgattatttttgttctcaattatatattctttggggggaaagcctgtagcttgctcactcatgggacagatctttcgtgggttacatgaagagcagatctgtgaatgttgtcatcccctgcttgttcctgctttcttgtggttaccatctttgtctttaacctttagtttttggctgagtgaaaaatttccagactcctgaaatcaccacaatcagatacaggagacatagtagagctcacttgtagaaagtgtcttttttctggtacagagaagaatggtttagagacacccttctctagtatatgccataaaatagcctatctaaaccttggaatattattgtgttaaagtacatgtagcatgtgtagcatgtttaaatgtccttttatgaagaatttaaagcaaaaaggaaagaaagaaagaaatttacatgcaatgactaggattaaaattattgctgtaattgattaacaaaatttactgtatattctggaagtcagtactcaaaacaaaattatagaaagtaataaatatgttaagtaccaaagagatatattgtagtcctggccatatgttaaattctttcccatgtgaaacattacataggggacaagggtcattcacaattttattacaaatataaaaacagtttacacgtggcaatttctggataaaagtttatggcagcaagaataacacattcaaagtgctcttagaacaaaagtaaaattatcagaaccatgaaatcccacagtttttgctaaattcgtttctcaagaaagactatttgaaaacaaaataaagaatgcatttgtataatcttctttcaccatcaaacacacatacttctaaaatacaaaaactttcaaattatcatctgtgatcattggataattcacctgtcttaaagtttctaaatcaataaatttagtgaatcattgttattctgaagagtaaggaaactgagtaattatcctcaatcattgtgcatttgctactgttacaatgattcctttagtgcttttaaactttacatcaaaacccaattgctcacagtggatacctgcccatttgcacaccatatactgacttattttcttttcctgtcttaagttcccattctcccaccagtgattcttgggttcgtctcccaaataaactactcactcaaatcctactcatagggtctgcttttgggacaaacaaccctaacaatatttaaagaaagtttaaatattatttgtcaaaatatgttctgtgcaaggaaggatatgtggaataatcttattgagaacaattatttttcacaataaaattcaaaaggaatttgaggtatcaactaattgagatttattttctatgtatatcaagctgtcatatattatgtcttggttttgatattttacttttgaagctggcttctgtgtattttctctctctagttatctcagctgtggtaaaagtagtctgcattgctatcaccattgcttagagcaaggtggctggataaagtgatgtgactatcaaagggtaggataaaaatttcatcttaaatattccttctcataatcacataatcctttaaaccaaggatagcctgaaagaaaaaataatgatcctaatttgaagaagtctcaagaatccaaactttaacattagaatgtatgagatttagaaaagaaggcatcatcaactatgagaataccaaaaggaaaacatggtcccataactaccacatatcagtcagcaaacagaatttctcccaagcaaacacagttggaattgcccatggggcaggtcagcaaagagtggggctctttgtttttttttttttttcctgtgggttccgctatgtcagtaatggaaattgtgagtcatctctgtgtccattgggaaagcatgtcatctcttgtgcctggcaagcagctcatcgcatgagagagcctaccaggctcaaccatgaattacataatctgccttcaaaggaatcagaggattaaccaggtgttcctaagatattacataacttgtgtatcttggagagatacacagatagtttcaacagctgccttgataaggagcataatttctcaggagagtaaaaatatatgttcttttttctctaaaattgaaatatatatattttttcactaaatgctaaatgtggttttgatttggttggttagaaattaacttgttttggtatttttcctatttaaaccatcaaaattgtttttaaataattttaattcttttgctggcaggtgaaatggaataacagggattgggcttacccctttactgaacaacaaagaaaagtgaaattataagagaaatattatttatgatattgagtattgggcaataaacaggggtaattttgatgagacagaaaacaaatgaggtgagaccctgtgattgcctgttgggaagattttcagagaaaataaaattgagggtctggggagaccaaagcagttagagttagaccaaagtcagttaatattagcagatagaaaaaaagcagcatgaagagagatttctagagaaatgaggagactcgtcgtcaagtatgcagctaaatactgatcagtgcatgcctgtgagaaaactacctagaaaaactatctgaaaagattggcataacaatgcccagaagtcatacctattccaggaccaggaatactgcctattagcaccagccagactggaagacttcaagacttataaggcattggatagaatagaatagatagaacagttttccttcagtagataaagcaagttttaagttgttttaacttaagcaaaagcacaaaggaagaaactgtttctaagtaacttgcctgcatataagaataatgctcaagaatatttatagtaatataacaatatccattattcagcaaggtggaattcacaatgtctggtattcaacaaaaattaacaaacatacaaagaagcaagaaagcatgactgataattacaagaaaaattaattaaaaccaacccagacttaacacatatgttagaattagtagacagggacattgaaacaatcatcattttatatttcatatgttaaaaaaagttagtagtattaaaaatgcacccctccaaacttctaaagatgaaaactgcaatgtatgagatggaaaagaaactgcataggattagtggtagagtacatatttcagaatgaagaatagtgaacttgatgctatagcaatagaaactattcagaaagttacatagagagaaaagaaaattaaaacaaatagagcataaatgagctgcagcacaactttgagaggcccacttatatatgtaattgtagtccccaaaggagatagggctaaaaattatttgaagaagcaatggctgaacattttctgaatatgataacaaattcaagaaactcaacaaataccaagcataagaaatatggaaacaatatgccaagaaacatgacaatcaaattgctaacatctagtgataaagagaacattttaaagcagccacatggagaatatttcacagatgagaacaaagataagtttggcagcatatttctcatcagaagagatatgttttaagtattgtattaatatacttaataaaaagtgccataagagcttacatacacttaagtaccttaaggtgcttaattagaaaatcttaactgaaaattttagaccagtaaaaatatcttgcaaaaatataagtgaaataatgacttttttgaaattacaaaagctaaaatcatttattattagcagacctgtactgtaaataagcctttcagacagaagaaaagtgacatcagatggaaataaagttctccacaaagaaatgaagagcacaagaaatgatataacaccagaaaatacaaaacatgtatcttattatttaaatatctttgaaaaaaattgaccataaacaaaaaaaatgtaatgtggagtttataatcaatgtgcaattgaaatgtaagacagtgatagcacaatgattggaaagagaaattggaaatatattactttaaatgtcttatactttatgtaaagtgatataatcattttaaggcacattgtaattattttaaaatatatactacaagccactcaactaatagaacaaaaatttgtaattaatagctcctcaatgcagataaaatgaaatcatagaaactattcaattaatccaaaagaaggaaggaaaaagaagaaaaaaatcaagaaaaacaaatggtaaataaagaaaacagttaaagttgttagactaaaacataataaaatcactaatcacactaaatttaaataattcatgtatctttataaaaaggcaaaaaattggcagattgaatttaaaaaatcaagacaacaaatgtgctacatacaaaaactcatttcatatacaaaaacacaaatatgtaaaagtaatgctgaaggaaagaatactgcattaacataatatatcaaaaaaactatattaatgttagagttgatttcaaagcaaataatattaaaagggataagtacagtaattataaaactataatgaggtcaatttatcaaaaaatagtagcttgtaaacattcatgcacccaataatagtttcaaaatacatgaattaaaaatctcacagaattattaaaagaaaagtaaaagttcaccattgtagtaggatttttaactttcttctataaataagttatagaaaattagaaaatcagtaagaatataaaacatttgaacaacactaccaagtagcttgatgtagtagacatttatagaatactccatccagcattattataatgaccattattttcgaaggcacaccaaatatttaccaaaaattattgtgggctacaagtcagaccttaagaattttaaaataattccagttaaagtgttttctctgaccataatacaattaaattagaaagaataacaaaaattcttgggtaattcccaagtacttggaaactaaataatataattctaaataacatataggccaaagcaaaatgaaaggaaacactgaataaaaatgaaaatatatcaaaatttatgagatgccaattaaatattatttagaggaaaatttatacactaaacctttatattagaaaaaaattgactcaataacttcaacttccactctaaaactggaagaaagaaaaaattaaacccaaagtaattacacaaaaggaaacaacaagaatcagagtggatagcaatgaaatagaaaagagtgagatgatagctacatcagtgaagcaaaaatctgattatttgagaagatccataaaattgatatacttccagcatgactgatcagaaaaagaaagttaaaaattaacaataccagaactaagaaaactgacaacattacaaaagttacagacattagaatactgttaaataaatattatagagaactttttccaataatttgacaccttattaggctggtgcaaaataattgcatttttgacattacttttaatgaattaaatagatgaacagatttcttaaaacttacaagttatcaaagcacacacccaagaagaaacagaaattctgaatatctttgtaaatgtttaagacctggaatgtgtagttaagaattaaaaacaaaaacaaacaaacaaacaaaaactcaagtcctaaatggcctcactgatgaattctaccaaacatttaagagagaagtgttaataattttattcagatattcttggaaaattgaagaagtggaaatgttttccaaaagcatttccctgataacaaaccagaaaaaaacataagaaaagaaaacttaagaccaacattccttgtgaacataaatgcaaaaattataaatgaaattttggcaagtcaaatctaattagatataaaacattatgatatcatagccaagtatagtttttcccaaggatgctaggttaaatgtttaaaaaattttcaacataaattactaaattaacaaaacaaaaaagaaaaccatatgattatctcaataaattaagaaaaagattttgataaagaccaatatttattactaataaaagtgttcagccaagtagaaatagaaaggatcttcctcagcctggtaaagcacatctattaaaaagtggcagttaaaacagtacttaatctggaattatcagacttaagacaaaaatattcactctcactacttctattaaatatggtattacatattccagacaacttaatagttaaaataattttaaagtattcagaatggaaataaataaaacactatttacagatgccatcattgctatgtagaaaatccaatgacatttacacaaaagatactagaattcatacagtacatgcattcattaaggctacagaatacaaggtaaatgtacagaagcaaatcgggctttatgtactagtaatgacaatttggaaattaaatttaaaatacctccaataatagcatcgttataaaatatatacagataaatttgataaaataaataaaagtcatatactgaaaattacagcattacctagagaatgagagaggacctaaataatagagagataagccatcttcatgggtcacaagatgatattattaaattatcaattctataagtcaaaccctggaataaatttttggtgaaaattataaattgattataaaattcgtatggaaactcaatgaacctagaaaacttagaacctgtgaaaacaattttgagaaaaaaaaagaacgaagttgaggattaacaatttggggctcttatactgatttaggggcattataaaactacagtaatcaaaacaatgtatatttgaatcatgatagaaaaatagatcaataaatcagaatggagagttcaaaaatagaatattatatatgtggacgatttatttttcatcaatgtgaaataagcaattcagtggagaaagaaagtcttccatcaaacagtactggaacattcagatagccataggaaatgatgtgaactttgtttcatatctcacaacatatataaaaaagactcaaaattcatcatagatctaaatgtaaaatctaaaattataaaatttctagaagaaaacataggatgagctttgcaaccttgggttaggcaacgattttttaaatatgaaatcaaaagcacgatcatttaaacaacttgataaaatgaacttcatcaaaattaaaaacatctcctctgtgggagatatcattaaggaaatggaaagagaagttaccaactgggagaaatcatttgcaaatgatgtacctaatagtggactggtattcagaatatacaaagaactcttaaaacacaacaataagaaattaaacaaaccaataaaaaacaggcaacagactttagcaaataattcataaaaatacaaaaagtgatctataggtacaagaaaagatgcactcagcatcattaatcattagaaagatgaaaattaaaatcacaattagcactacatgccaactagaatagctaaaatttgttaaaagatataccatactaggtctttgtgaggatatggaagactggaatggtcatacactgttagtggaatgttaaatgaaacaaccactttaaaaagcagatgacttttttaaaaagttgatacactgactatattatctaactatttcattcctattttaaaaaaaaacgaatgtttatgtcctcagatgttacacaaatgtttttatatatatataatattattattcataatagccaaaaactggaaacaatggccatcaacatgtggatggataaactaactatggtgtattcatataatgggatgggatgcttctcagcaacaaaaaaatgaattgctgacccatgctttactcagataagcctcaatataattatgttgaataaaagaatttcgacaaaaaaaaccccacatactgagtggtctccatttatataaaattttaggaaatgcaaatttacatgtggtgacagcagatcagtggctgaatggggatagaggaacacgggaaacatcacaaactttttagagcaatggatatattcattgtcttgataaaaagtggcagcacatcagaaacttcctttttgtctctctgggtaatgagtactatttgcataatttgcttcactctgtttcattggttccccaaaatggatgttgctaaagaaagaaatattgttacatttgctaatggctggaccctacccacttatattttgagtttcttcatgacacaattgtcaactaaactttgtagtagatattggtcacaggatttgaggtttgtctcttttcatgaaggaaaaaaggaagattcaaaaagctatgctgtcactgcttctatttttttcaaattatcttagcaatattttgtagttttcagtgtaaaggacttgtacatctctaatagatgtgcatattctaatgaaaagtattctaaatacttttccattagttatttgatttataaatgctcttttgatatcactttaggatgtcattttctaatattcctttataaacatagaaaataaacacatttgattttcatatgttaattatgcatccagagttgtatttatcaactagtaatttatctagttttctatgtgcacaagtctagcatcatcgtgggactgcagtatttcttcttttaaatccttaaagcttttacttattttgtgtgactcattacaatgactatgccctctagcacaatggtgaataaattaatgtagtaggcactctttttgtgttcctaatggtaccacaacaatgatgtttgctgtaggtagaatgtaccctttcaatactaattttctgaggatttatcatcttgaaaaaattttgtattgtatgttggtttttattgtttatcactaaatggacacacttgtttattgtgtttatgtgctgaattaagactgatattaaacagcttttatgtcctgaaataaatgcaaaatatatattgctggatttgatttccagttcatgatgtgtttagagtttttgtgactaggttcatgtgaaagattattctgtaatattattttattaataatcttgtaccattttgatttcaagataatgattgtctcatcaaataaatatggtgggtagtgttttttatatcctataattattttttggttggggggatagagtctgaccttgtctcccaggctggagtgcagggttatgatctcggctcactgcaatctccacctcccaggttcaagcaattctgcctctgcctgtaatgtagctaggattacaggtgtgcaccaggatgcttgactgatttttttgtattttcagtagagacagggtttgctttcaccatgttggccaggctgatcttgaactccaaacctcaagtgatcttcctgccttggcctcccaaagtgctgggattacaggcgtgagcaactgtacccttttgtatgatttttttttaacacgcacatttatcaattaagtgggcacagtttgtggtccaccaaaacaattacaacagtaacataaaaaatcacactgaacacagatcactataacagataaaatagtaataaaaaattttttaatattgcaagaattatcaaaatgtgacaaaaagactattgacatcatttttccacatcatgttttgtctgaaaattttaatataagtttggttttattccttatgtatttggtaaagtagtataggcttacttgttgggtattttgaatgataaatttaatttctttaatagatttaagatgattcatatttctttttgtgtccattttacaaatctgttttttcttgaaatgcatacatttcgtctgaaatttttgattgatgtgcacaaatacattggtatttgatggataacttgattgatgtattagtccgttttcatgctgctgataaagacatacccgagactgggaagaaatagatgtttaatggacatacagttccacatggctacggaggcctcacaatcatggtggaaggcaaggaggagcaagtcacatcttatatggatggcagcagacaaagagagaacttgtgcagggaaatttctctttttaaaaccatcagatcttatgtgatttattcactatcatgagaaagtcccatcccatgattcaattacctcccactgggtccctcccacgacacatgggaattgtgggagttacaattcaagatgagatttgggtggggacatagtcaatccgtatcaattggcattgtttaatttcctcttaacttttaaatatctataacaatgacccttttaaaaatttatgtcgttggtttttgtacctccttcctatcctctctcttctttctctcttcctccttttctttctttctctgctctctgtctctttgtctctctctgtcttgcaaggggtttatcaatagtatcaatctggggttttcaggtttttctcctttgtatttcttctttctatttcactattttataccttctataattttagggcttaatgtgctgctatttttgtttcttcttaagattgatactattaatactctttcattattatgaaattaccctttttatcttttggagtatattttttctttcagtgtgccctcaccatagctgtaccagagtatcttttaaccttattttgctttttaaacttccactatctatttttatatttaaaatatgtctcctttaagtagaaatgggtttctgtatgtagcccaacaatctttttctgacaactaaagtatttaaatatatatagcaattacttatattttggggtttatgtaatcttgccatttattttctgtttcgtctgttctttgctccatattacattatttagtttttaaataacattattattatttgttttttagacaggttctcactctgtcactcaagctggagttcagtggtgtgatcactgctcactgcagcctcaacctcctggactcaagcaatcctcctgcttcagcctcccaagtaactaaaactacagaagtgtttcaccacactcagctaattttttaattcttttgcagcaatggggtcccactatgttgcccagtatggtcttcaacctctgggctcaggcaattctccacctaggcctgtcaaagtgttgggattacaggtgtgagcccctctgcctggccttttagtcttttattgtttttaatgtttaccatatatattataatatgcatccttcactgattagaatatacttttattactttcacacttcctgatcaatgaaagtgcctgaaaagttccactctgatttcttgcactatcaataatatggatattaattttacatataatttgaacatgtattattattgttgttattattatgttctaacatttaatatttggttttgatatgctctgatgtttctccttccttgtgctttgtatccttcctttattattatgctttgttcagggattattttctttctgcctagataattatctttggcattttatttagaaaaagtattatgacctcagcttctctgaacttcttgtttcaccccccaaaaagaaaaacaaataaaaaaaggcctttatttagccttcatttttgaaggagatcattttctaaatatagattcaggcattttctttcagcgctgtaagtgttctctgtctcccattgttttatttcaaaagtcagctcttaatcatattattactcatttgaaactaatgtgtcttttatttgcatgcttttaagattgtcatttggctttagtttttagcagttttatataataggtgttattattttgtttttagctgggctgtgattcatagagcttcttgaatggctccaaagacttgatgcttttcattagttttgggaaattcttagccaacatttcttctcatacttctatttttttcctctgtcatttctcctttttggaatccagttacaaatacatgaacctttttttcaattatgttccacatagctcttattttatatttcatttaatttacttgcttgcttcaaactgtatattttgtatgtgtataagtatgtgaatctattggtaaatactttatttcttctactgtggttaatcattaatctactattaaagtcatctatatcttaatttcagtattttgtaagatccctgatttctatttgatttttaaattaaattccaattctctgatgaaaatattccatctttgtatttatttttggaacatattaagtttagtcctgatacctcagatattttgattttctgctgctctacttttaagtttttctcttacatttctcagtcatttggttctattctctggcatatctgataaattttgactgaatcccaaatgtatatgaaaaattgctggcattctcaatgatatctttcttcttgggggctactaaaatacatgcagattaccttgtttcagcagaggatattctgtttctagtttgcttctcactctatagttgttgccttttcagggatccaactaaaggcctgagatttttgtaagtccatctttttcctcttttttttttttttttttgtagaaatggggtttcactatgttgctatgttgcccaggctggttttaaactcctgggctccagcaatcctcccgctttggcctcccaaagtgctaggatctcaggcatgagccactgcaccctaagtcccttgttttgtaatgatcctacattctaattttcatcttccccgcaccaaaatactgccaaactatctgcctaaacttttagtatctcagcagttgatttctgcttgaattcttagacatatgttcttcaaatgcaaattttagcattcagctagtgcctcaaggggaaattttccacagaatgttatgcccatttctctaaagttcccttttactttggagatcttgatccttcaaactcttactgatttgcttgccatgcctgccaataattgttttcttagcctactcagatagtcctaaactccagagactctctttttgatatctatgcactgtttttatttttttacttattagacatttttccctatttcacagctgtaccctcttccacaatttgtttagacaaaaataatatttttttcaagataagactatcaaatggagtttatgtaaggtaacattaaaagtggaccaacgatcttattttctttttactcattaatttatcttatccatgaacaaatacatttaggctatagattggctctatcaattattttctttaacttttgtagtagattttctttctcttttctagtttcatgcttagagagccttagtgcataaaggtctctaaaaggaattaagaccttctggaaatatgattaaaaggtcttccttttgttttacaccatgtatcattcccaatataacataatgttcgctctgcttagaccttgtgctttacatttctcagaatgagataatccacagcctaaatgcatatagctataaagtattatgtgaattgtcaaaggaggtatgcattttttcatgatattctgaattaatcaccaaatacgtttataaaaggctatgggaattacagttaccctaatgcttctgaattgcaaatattccttatttctgttttgattactgttgtctttaattgagtatgactattttatgtgtacggtttagtaacatagctgtttgggctctctttgtctcttttgcaatgaacattgcaaagcagctgttacaagcatatatttagagccaaagggtactctggcttacatatgggaggggtgagggaaggataattgaatcacaaaatgcttgtgttaaaatatgctctgagaaacaatggaaacaggaaaacaatgccagaatggtgtccacagtgaagagaacaaagcctgactctaaacagaggttgctaaacaaatcagtccctatgcaattagatggaaaagcacttagcaacaatataaaaatgacagactagctgaaaatcagcacaatagaagatgactcagactctctaaagtttacatactttagaacattactttcaattccacatagagttagttcacttgcgacttcatgatatggaaatgaaagtgatgataaaaaagaaataatttctgcattacaaacataaagtcaatactaatttgacttttattaaagaaactcaaatccttcataattaattcctactgaaattttgcccaaaatcatacagactttatagtttagctttttttgtaggtataaaattgacatattaagatttctgaacttttgcccagcatttctagttctcttattctttttaaaacttcatattttagatagcaggcctccctggcatctgaaacagcatgattaagtatgaatatacatgtctttacctccctataaaagactattctgtatgacctgtacatttctcttggtgtaacactattgcttcaattttataggctcacacctatgagttttcagtctgccaaaccctcctggtgtgtgtgtgtgtgtgtgtgcgcgcgtgtgtgtgtgtactgtcatactctaaggagaatgtgtcttaacaactggagggtttgtttaatctgacctctttgaagatttgaatatgaaagtttgggatcaaagtttaaagtggagcaaattactctgcataaaattggaagttaatgaattgggggtaagagtcagtgagagagattgagagaagccattaaggctggatgctacataagagaacttgtatgtgagctctgggttacactaaagaaaaatacagaagtatatcaaggaaatagaagtaacataaaatcacagattgcaatcttcatatcagccaagtaaaattcaattaaaaaatgatgaaacctaaaatttaggccatgtttaaacactaaaagtcataatttacaataaagacataaagatttaataattatgtatatgtaagttatttgtctctttatctctatttattatctatctatctatctatctatctatcatctatcatcgatctatgccaagtagcaaaatacccacttttataaagtggaaactacagaggataaagaagacatagacagggacaaagaaatgcaagggagtgcaataatcactgaaagtcaattttttcagatacgtggtaggacttttcaatatagaaattaaagttctctgttattttttacattttctttgtttgggttaaaggagactttcattcattgctctatgtacaagtcacatcaagaggaaaagaaaataaagttatagggggaaaaatcaccttttcagtactctctaaactcttaaaatgtactgtctgctatggtttgaatgttttccccaatgcaacagtgttgggaggtggagcctcatgggaggtgtttaggtcatgaggtctctgatcttatagatgaatttatgcccctataaaaagggcttgctggagtggatttgctctctcttgctcttctgccacgtgaggacacaaagttcctctcttccagagaattcagggttaaaggcaccactttggaagtggagaccaggccctcaccagacaccaaaatctgctggtgctttgttcttagacttcccagctccagaactgttagaaataaatttctggcccggtgtggtggctcatgcctgtaatcccagcactttgggaggctgaggcgggtggatcacgaggtcaggagttcgagatcaggctggccaacatggtgaaaccccgtctctactaaatacaaaaaaaattagctgggcgtggtggtgcacccctgtaatcctagctactcaggaggctgaggcaggataattgcttgaacccagaaggcggaggttgcagtgagctgagatcgcgccactacactccagcctgggggagggagtaagactctgtctcaggaaaaaaaaaaaaagaaagaaattcctattcggtataatttaccagtctgtgatagtctgttatagctgcgagaatagactaaaacagtgtctttccataatctagtacttattgtttcttgcctgtctttccctcctaacaacatgtacttcctgccatatccctagcacttacaacagcatctggcatacaatatttgctgaataaacatctgttgagagactgaacaactgaaggaatgaatcctgtctggcactcaagttttagtctccatccaaaataaatatgttttttgatttattatttcttcaattcttgtttattttccataagtttttttctttctcaaaacttcttttaaaaaaacttcttttttaaaaaaaaaattggaaaaaagaaccattcgtgctgcatcttctctctcttacttcccaggaggaagagaagaatgatcatcaatggcaaaaagcagttgcagcaaagcaaaaccaagagccagctttaagctcaggagagagcgctacatctcctcctcttggtttctggtgctctccaggttcagagacacttttctagtaataaactgaaaaaagatcactgaaagtatcatctttctgagacttctttaatcagatattttgtctggtcattctattcccaaattatcttccatttctcataatttaaaactttgttttattttttactctatattataatacccagattatatttcatcttctaaagctctaattaccttttttattcttgtacaatttaaattcataaagtataatttgtttggtttatttatgtgcttgactctacctagttgctgtgtatgtgtagtttatctcctacatattctatgacagttttattaaaagtttcttcatattatttcattagctgtgcatctgtgggataacatatcctggtaattttattttgttaattttctttaaaacataaaatattatgcattacacactgatttatttaaaagaaaaagattaagatcagtttgacaattttaggaagatcattttggcaatctagaatttttgtttattattagtttttttaaaatttagtaataatttattacaaagcactttgctactaccggggtgacactacaacagtaaataaaaagtttgacttctactagaggatgtacatcatacattacatggaaatcagttcccactatgtctggtccatgcagggtgagcctcaacaagaattagcaattgcagaatttataattgcagaatttataatgttcagcaataacaaattaaaaggtgttgtgtttgagggcaaagacttaagcatttagatttagtaaagctgaattcccaaattaggaaaaaaaatctgattttaagagtttggactcctgaagagatttgtcccacttccggtcacactgatttgctcactttattttgtgacttactggcttagcttgttttcttctatattgctttccttataacaacaatagagagaaaatgggatacattccatatttgttattgtcagaaccccagtggtttagatgtgattgatgaataagatacacgaagttacaacaaagcattgaataatgtgtagttaaaatccagcaggctttataaacaggcacatgtaaatcatttcagcaattttccctcttgtttatgccaattagttcccacataaatgtctacatgtttgaagctattttaaattgattcagcatttttctctcaaaattgcagatatcaaatatctagcatttaaatgctgctttagcctgagactagaagtgagctgcaatgcaactgtaaacacattttgaatgagtggttttgattttatctaccttcatagtttattagttttataatgacatgaagacacagaatacttatcaaaataaggattattttttctgttaaccaaaatgtaaacaattaggtgagttaagttctgggtgcactagctgtgcttctgctttactagtgtctttaaaaagacagaatactgataattttgtacctgtgctactattacagcctgctaaagaagaatagtggacatgatgttctgaaatcactttctggtcattaggttactgagattatatcactcagtgagagccttttcttaacaaggagaaagaactatgtccagagtttatagtgtcttccaaccatgcactgagacaattttcaatgactaattatagcttgagggagcaggaaaaggctaccagaaaaaaaaaaaaaatccatcagaggagttaatttgtagaaagaaggaggagtgcagtttcaaagcaattttgtaaattccaagtgtaactacttgcattcttcaaaacaatttccatcctactgactttaatgataggtcattggtatagaagagataaaacgttcatttcataactgcagtgcctatgtttgtataaggtgtgcccaggaaaaagtcaactagtttttttagaaatttattggaggaatatttgaaatattaaaggctatagtctatatagtcaattcatattataactaaagtctcactccctagttaggcttcagtgttctcacattggcaatcttttattgattattctgaaactttgaaaaaaaaaaaacaactagatagcccccactctaatttttaaatactttcttgaaattataaaattttgctgcatgtttcttgtagtaaaatacattttatagatttgtttaacttacagattttagtggcaccaaaaatttaaaaatataaagtagacttaatcttgccaaatgatgactgaggaatggaatgaaaacaagtgtatacctaaatcctttggctacatttaagttacttttagtaataaagatgtaatgaaaatgaagcaacagccaggcacagtggctcatgcctgcaataccagaactttgggaggctgaggcgggtggatcacctgaggtcaggagttcgagaccatcttgaccaacatggagataccccatctctactaaaaacacaaaattagccatgtatggtgacgcatgcctgtaatcccggctactcaggaggctgaggcagaagaatcgcttgaacctgggaggcggaggttgcggtgagctgagatcatgccattgcactccagcctgggcaacaagagcgaaactccatctcaaaacaaatacataaataagaaaatgaagcaacatatatatcattccaaagctgaagccaaaatcttatcctgaaattagataattattgtcagcaaaattagccataatgatctcatctaataacttacctgatttacatgcaaagccagaataatatcaagaattcagtcacctatcacacagagcacttcatgtgttttacttgaatagcttggtctttctctttcagccatgagtgccagagtgatattttatgcttgtatgaaagaaatacttcaaaaataagaaaaaaactataggataatatgaacacttatggaatagaaagaaggatgacatcacaacaaaataaagcaaaataaatggaggaacacatttggggcagtgaaaaattagaattttctgtggttgaggaagcaggagctgtagagtaaagttgggttgcccagtgagattaaaaaataaaagggctcaaaaaactggtgaagacttgaagaagaaccatccagggattttaagagtgaataaagagataaaatcaatatttaaaaacagttggtgtgataaacagatggaaaggttagaattaaacctggaaaattaaatggctcttaaagaattcaaagtaaatagtggtggggcttctatccagagtgatggcataactaattggaaataagctagagaaaaaaaactttaaaagaaaaaaaaggtaaatatttgatgtctactgcctcagaaacgactgtgatatccatggcactgaagcctggagggagtatgataccatgataaccacaggaaaatgtaggggttaggaggaatggcttaggctgaagtcatgttaaggacaatgagcagttgttaagtcagagatgtgggattcatttatagagaatatacacaagagcagaaaggtaaaaaggtggatattctatactgcattcaattgtttattgattatcaatctattaaccaggcatagtctgaaatactgatacatgtttttttttcaaaacacatattgcaaaagttagttttctattccaagatctctcagttcttttctctaataataacacatttatgtagccaataccgattttttaaaaggacaaacattcaaattttaacctagtccaatttttctaattcatgtgtgaagattttatgaagctctgagttaaaattttcaaaaactagattatttatataaaaattgaaaaactgcctaatggttatcattttacctgtaactcaatcaaagtgttaaccaaatttggactgtggtgaagaattgccagtgaacagtgggtgggatgagaaaggtagctaatttgttttcaaatcacttagattaaaattaatattgctttgccagcataggcctaaacatatgagaattcatttaggaattcagcaattgcaaataagtataatttgctgaacagttctatttacccctgaattctaataagacccattatcataatttatcatttaggaaagcatagtgaagttaaaaaaaaaaaacctttctgactagtcagtgactttacagaaagaagtgttagaatgattatatgtgggagaaggtatccttgcatcagtgcatggttccctttaagggagtaatcattaattatttatataagacaagaagttactctaatagcttgtcaaagtgttgctggtcagaatcatagtgtcttgaaatagcagtttaaaaacaattattattattgttattactatttttacctctgggagcctttattgaatcaaagtgcattttgaaacagacaacattcttgctgctgttaagacaacattctggtgtgcttatagcttggtttctttgatgctcccacccatttttccctccccctcttcttttaggactcagttacttctggactttctaacagaaggaccattctaatatgaaaacatttcattttaggaatacccacattgtaggagtgacacttttttgtgtccattgattgatagaccaattatcaagaggtttcaggctagaaacctcttactactctagggaaaggccctgctggtgaatgttttcatgaacagtaactagctgcatccatctgatttcttatccatgaagatacttggctacacgtgatcgtcctgtaataattgtggtagactgaataatggccccaaagacatctacaggcataccctgtttcattgcacttcacttttttgtgctttgcaggtactgtgatttttacaaactgaaggtttgtggcaaccctacattgtgcaagtctattgatgcactttttccaacagcaagtgctccctttgtgtctttgtgtcacttggtaattattacaatatatcaactttgaaaattattattattatatttgctatggtgatatgtgatcagtgatctttgttgttaccactgaaatcattctggggaaccacaaacaatgctgatataagatggcagactcgatcaacaagtggtgtgtgtgttctgacagctccactgactggtcatttctccatctctctccctctgcttgggtctctctatttcctgaggcacagcaatattgaaattaggccaatttataatactacaatggcttttaagtgtttcagtaaaagaaagggtttcacatctctcactttaaatcgaaagctagaaatgattaaacttagtgaggaaggcatgtcaaaagctgagataggcagaaatctaagcctcttgtgccagttagccaagatgtgaatgcaaaggtaagtccttgaaaaaaatgcaaagtgctactccagtggacacacgaatggtaagaaggtgaaagaccctcattgctgacatggagaaagtttcagtggtctggatagaagattaaaccaactgcaacattgccttaagccaaagcttcatctagagaatggccttaatgctcttctattctatgaagagagggaaggaagctgcgaagaaaagtttaaagctagaagaggttggatcatgaggtttaaggaaagaagtcttttctataaagtcttctttcactttgcacataaaattgcaaggtgaagcaccaagtgctgatgtagatgttgcagcaagatctagctaagatgattaatgaatgtggctacactcaataacaaattttcaacgtagattaaacagccttctactgtgttggaagaaaatgccatctagaactttcatagctaaagaggaggcaccaattcctggtttcagagcttaaaatgtaagctgattctcttgtgaggggctaatacagctggtgactttaggttgaagccaatgctcatttaccgttctaaaaatattaagatgcttaaggtttatcttaaatctactctgcctgtgctatataaatgaaacaacaaagcctgatgacagcacatctgtttacagcagggtttactgaatattttaagctccctgtggagagctactgctcagaaaagaggtttctttcaaaatatactgctcattgacaatgcacctagtcacccaagagctttgatggagatgtgcaagattactcttgttgtcatgcttgctgacacaacatacattaggtagcccgtggatgaaggagtcattctgactttcaagtcttatatttaaaaaatacattttgtaaggctacagctgccatagatagttatttctctcatggatctggcaaagtaaattgaggaaaggagtcgctcttctaggtgccattaagagcattcataattcatgaaaggagatcaaaatattaacattaacaggagtttggaagaaattgattctaaccctcatggatgacttcgaggagttcaagacttcagcagaagaagtaactgctaataaacattagcagaatggaaacagcaagagaactagaattagaagcagaggctgaagatgtgactgaattgctacgattacatgagaaaaaaattaatgtaaaaggagttgctttttatgaatgagagtaaaaaagtgtttttttgagatggagtctactcctggtgaagataatttaagcattgttgaaatgacaaaaaaaattataatattacataaacttagttgataaagtagtggtggggtttgaaaggattgactctaattttgaaagaagttccactgtgggtgaaattctatcaaacagcatggtatgctacagagaaatattttgtgaaaggaagagtcaattgatgtggtaatctccattgaagtcttattttaagaaattgccacagccaccttagccttcatcaaccaccaccctgatcagtcatcagccatcaacatctgaggcaggactctccaccagcaaaaacgctacaacctgctgaagactcagaagatttttggcatttttttgcaataaagtatttttaattaagatatgtacattgttcttttagacataatgctattacacatttaatagactacaatatattgtatatatgttttataattactgggaaacaaaaatatatgtgatttgctttgttgtgacgttattgttattgtctggaagctaacccaaaatatatttggggtatgcctgtacaatcctattctctggaacctgtaaatgttgacttacatgacaaaagggattttttcagatgtgattaagttgaagatcttgagagaaagagattatcatggataatcagggaaggacctaaatataatgactgtcttctatgaaaagggagacagtaaaatacatgattagagagaggagagagaggcaatgtaattatagaagcaaaaggttgcacaggtgcaaaaaaggcgtcatgggcgatggaatgtaggtagcctccagaagctaaaaaaaggcaaggggagaaatcttctcttagttcctccagaaggagctaacctctcaaacaccttcacattagctcaatgaagataatttcagcctcctgaactgaaagagaatacatttatgttgttctaagccatgaaggtgttggtagctggttatagcagccataggaaactaatgcatatgctaatcatgtaatgataaaactagtaagcatgcaatgtttatacaggaaaaagccttcctataaggaatggtagtatatttcactagtagagtactttacagattttagagttcttttaaattattactcccatttgattctcaaaacaattctataagtaagcaggaaagatattattataatacctattttactaatgaagaaattgaagctaagggagcttacatgtcttgtggtaaaaaaaagttatttgactctttgcctagtaatttcttctctatagggtcctgtttctttaaaaaggagctcagaaaagcatctgtaaccagctatatagaccacatttctttaaggaaggcaaatacttttctggtccatagtcagacgcattatccattgcaacactggcctgtgcttgcaaatgttttcttaaactggataaatagaaaattcatcatggaaagacaaccttctaccttaaattcatgttaagcagaagtttattgattggtagatgcaagatcctctctacacaagaaagaattaagcagaatattcatatgaatttatattacttaatatggggtatgccattgaaaggagttagcaagcttgctttaggcaaacagtaaggaaagggtcctggagagcctttgacctgccctgtaggtgcttgcaccagatgttttgtgcagataaaggaacttgcaaagggggcttgcctaaacgtacagactaagggcccacatacaactaggggaatgggatggagccaccagcaattcatgccttatataaatagggaacccaccttcatcagcttgtatgtaaaggcccttgtattcaactctgaagggggcaaccagcaacctgctattagaacccctctttttgctgagagctttccttttcacttaataaattctactccactcattttttcaatgtccgcatgcttattcttcctggtcatgagacaagaacctggacgtagctgagctaaggcacaaaaaacctgcatcattttgggggctcatctgggatacctggtgggtgagtaaatgcagtcccacagcctttcactttcatttctgagccttcttgtcctcagacttttcctgaaggcagatgcagcactgaacctctggtgagccaattaggaatgaatggcacagctacagaggacaggatgcaggagaggaccatgacacgcccacccccgtcatcctctggggttgggaatgtcggtctcgtcccaatccagtcttttctatggcgttttacttctttttttcagtactgtcacggcacctatctcttcttttgtaatgttaagggtgttgctgcaaactgcggagatattactaggtagaatgagcctttgacccagccatcagacatgcaattcagaataatgcgatttccttctgttcttagaggtgtcgcccacccccatcctgatggacatgtggggtgggaatgagctgtggctgccacctgggcccgggccccaggacagcctcggtagccaagggccccatgtggccagctggccagtgtttcctgcttaccatccccccgacgccatgcaccaacagagtctttcctcccgtggccaagccaggaagagggtacaatgattgaaagtttctctccctgttggaggaacccatttgcatagagctagaggattttccctcaggcatcttccctgccctgcccttaagctgttttttttttttttcttttccccacactgtcaggagttaccttttatgcaagaggtttttttttttcctttggaagacatcttattaggccagtaccccaattcacaagacatccttttctctcccttgtttgaggaggactcagctccatagctttaccttagcatgactaagtcctgctgaatttcatggatagaggaggtcatggtagcattcatggatagaggatgctcccacttcatggatagaggtcatgctagcattcatggcatagacaaggtctagggaactcaaaggctactgacagcattgggaaaaggccacatgtggataagtgtggataattcccaccccctcggccccctgttaatgtgggtgaaaacctctgttttccttatgaaaccccaggaattgaaagcagaaagatccctctcaaaacctttagggttcctaacctgtggtaagtaaagaatgttactttctaataggcccaggagacccatgttcttgagacctcaagaaaagaggaatttactcaactcataggtatttgaggctaccaacccatggctggcctcagctgtaaaaggtcttatctgagattccgtggggaacagggtgtcattaaagccgatttaaaggcctgtgtgaaaaacaattactcatgctgcactttacgcaaataatcaggccaagtataagactaaggtttattttacaagcaacttagtcctatcatgatttgtttttgacaaaaatggggactagagagagaaaaattatgtttcaatgcttaccatatacttgttattaaattctcgtctcatctgttgtttttaggtttttgcctacattctagactaaccctgtttatccccgtgaaccaaccagtgatctctggctgtatctcagaagaaacagacagatgggtaatataaagatctagatcaatagtctagttctggacaattatcctgcaaagcctgcaaggtggtaagaataaatggggtgcccataacccagaagtttctttgttatggaaaataagaccaagggagctaaccagagccaagccccatgcccccacatcttggcaggcataactatagccaccagttttctgggcatttcagcagccttggggtttttttgagctgcccttacccccttgtttcattttgatgtgcatcttctaataaccctaattgtttattcttgcttagcggccattaaacttcaaatggtgttgctaatggaaccaggtatgaatgtgtcatttttctggagacccttaaagtgacctcaagaggagccctaactgccgctttcctaaaacagtgccccctgtcagcaggaagcagttaagagctgtcattgaccactttccccaccagcagttggggtatccactcctcaagcggggaatgaaaggcattagccaccttgctttaggtagacagtaagggaagggtcccggagagcctctgacccaccccacaggtgcttgtaccagatgttttgtgcagataagggaacttgcaaagggggcttgattaaacatgccagcagccgactaagggcccacatgcacactgggggaatagggtggaggcaccaggaattttcaccttatacaaataaagaagtcagccccatcagtccgtatgtaaaagcccctgtattcagctgtgaacagggcaccagcaacctgcttttagggcccctctttttgctgagagctttcctttcctaataaatttcactccactcactcttcgacatctgcatgcctatttcttcctggttgtgagagaagaacctggaactagctgagctaaggagcaaaaatcctgcatcacaacttagcatagaacatagtgaatcctaaaatgaaaccagaaatattttagaaaataataatcttaaatatatagacagctaaatagaataaaaaactaaaataaaaagtataccacaaatgtgaaagtgatggtttcatatttctaaagatcacccaaggagacagtttagaaattaaaatgaaaagtacatttttagaatgtattaaagatattataactatgtccagctttattttcatgctgtgtctgcaatctccactaggatgacaatatgcctataaccaagaattttctcattttccatggtcaacattataattactgtaaaggcaaacagcatggctgagtacaaagtacattcaacaggtaaagcatacagtataaagtctatactgtagctatgcaaatgccatcatcctcaaaagcacaagtaaatattgattaagaactttaagcactttgaaggttgctggagcaaaatgaatacgtttagaagtttttagagattgttttgactctattgggttcctggaactgagttattcaatacttctgaaagaagggggcaacatattagatagcagaaagtggttcaagaccacacctcagagaaactttaaaaaaatgaaggattaagaaagtcattatttgatatttttaaaaataaataacctcagtagaaatccattttaattttaacctttatattactaactagaactcatcttttattctatttcctttcatataattcagatctgccctagtacgtcactgaagagagactaaagaaaaaattgtctaatttcataggacattatagatcctgtgagtcttctaaggtacctccctgcttgctagggcataggaatttgcacatgggaatctacagtcttttatgccaagaaacaattcccagaaatcatttccttctcaagtggctttctggcctccctggagctcaacacagtttttagggctcaaggtccctctttctatttattttctgctcccatcatttctttatttttccttcctgaccaagatgtttttttttttcttttttattacaggaacaaaaagacatattattttctgcctgttccttgtgggaaaaaattcaaattttctaaattttataagggctgcaatttccgaaatattcttccattcattcaggaagtacttgaatatctactaaatgccaaccactcttttctggatgtttagcagtaagcaaaaacaaagttatgcttgtggaaagaaacaaaaaaaataagcaatttaaaaaataaatataaaccatattctgagaatgctaatttttgcattttgtaaggggataaatggagaaatgctcactaaaaaagtgacatttgaggagatacatgagtgaaatacagaatttggaaagaaaaattagtaactgcaacatccttgatacaggctggagttggctagctttattcaggattatcaagaaggccaatataattggagccgagagggcaaagggaggaaggaatagttatataataaaaaccaatgtggacttccagccttttttgtctaccttcacccctttccagagtcagcacagaggtggctatggaaaaagagaaaaaaaatcttcaataaaaacggaaagtaaaaagagtggaaactaatatctcaaatgttttctaaactaacaaagattccacagaatttcagactttggacaaatgttatcattcttattagatggtcattcttggaattgtttctgcttagaattatctgaaaatggcactgcttgcagttccctcccagttgattcatatcatgtacttgttgcaatgttagtcatccaggaattttatcctaattatatctgctgctcctttgattgcaatgaatttaattcaccttacctattaacttacttaaactcttttagtattgttaagccattcacaataagctaaaaggaagctaaaggtttgtttatgttctttagtctatgcttaaaataacacatagacttttgcagggtccacaaaactattgtacaaaagtgcacaatataaaattctttaagaatttgggcagtgtttatccaaatatttgtgaaatgcaaagacattatactttcttgtctttcagtgaattcacataaacattattaggccacccctttaattcatgcattattgacaatgtggttgatactggttgaagaaacagtcattgaggaatactaaaaattgtcctttgatctaaaacctaaaatatcagtcattgtcaaagcttattttaaaatttcttgctattactggtgataaagttctacatttaagaaaaattatttgtacctcacttgaaaagaaataacttttgtaagtgtaaatttaggatggttaccaaaaaataaacttcacatactctaatagtggaataagcttcagaaccatttataaaaatgactaatgcagcattatcaagacttagctacatgttcacttgttattgtataactctcaggagcatgcatggagctttgtctggcatttaattaagcccattttatgtctgtcatgaaagaatactggcttgaaaaaatgattatgaaaagtcatgctcaaccctacgttcaaagaatgatgcacgcaaagctacaaacaaatgtatgcccagaaatggccagaaaatgttattggggttgtacagaaatgagttgaactgacataaaaaattaacaatagtcactgatatgttaacagatgctaaaagccacatttgcttgggtagtttacccatagttttaaaatgtttaaataaaatgttttataaatgcaaattatacatttattgagaacttggagcttaatcagcagtttgaaactttgatcactccaaattatcagaatagaataaggaacagaagctagtctctgcttctttataacctggtcagctgtgtaaacatatagaaaaaagaatagtatgaaccgagtgagagataatatttatcaactctacatttttcagagctccaacaaattccagcaggcccagtgtagagccagagccaaggacaccatagaaaatagttggcagcaaagacaccaaagaaaatagttggcagcaaagacaccaaagaaaatagttggcagcaaagccaggcaaaggaaacaaattagaaaatggtagcctaccttatttgaaaccagggtaagcctgacacagaatattgtatacaaattataatttttccacctcaggaaggatatgtttaaaaattcaaacaggtggagaagcttctatcaagtaataaaagattaacacctttagattttagtgacagattaagatgaactagtgagctttcagtcttctctttactcactttctcatcgctgactagagctctctttccaaaccacaaatctgcttttgcccatctattagccatttaggaacttttgaattcctatgagataaagcctactttcttcaacatgccatgtcaggtccaccacaattaagctgcaaggtaaggttttacctgtaattccactcatattcgatcccctcacgtttagtctattcaggaatatccattattcccccaaaactccttgaaattttactatgctattattccctctcgcagaacaccttctttctccgttcccttcccttcccttcccttcccttcccttcccttcccttcccttcccttcccttcccttcccttcccttcccttcccttcctttcccttccctttctccctttctctctctctttctctctttctctttctttctttgctgtctttctctctttctttcttagacggagtctcggtctatctcccaggctcaagtgcagtcatgccatctcagctcactgcaacctctgccccctgggttcaagcaattctcctgcctcagcctcccgagtagctgggattacaggtgtgcgccactatacccggctaatttttgtacttttagtagagacagggtttccccatgttaaccaggctggtctcgaactcctgacctcaagttatctgcctgcctcggcctcccaagttgctggaattacaggagtgagctactgcgcccagccccttttctaccagttagactttagcacctcattcaacaccaaatgacattgtgtcaggagagtaagtgttctccctagtcttcacctatattaacaaccttactttttctgtagcaatatttattctctgcgttgtccatattaacaggaccacacttttcccatagtagccatgtacccctcttaagaaaaaagagacattgcccagactcttttataattatgtgtggcccagaatagacaatgagatataagtggaagtcatctggggggactttcagggtctttttacctttcctttcctttgtgacttaccttaccttaccttacctttcctttgtgactacaaagcaaggtcacatgctgaggagagtaggataaaaatacatagaatctagttccctggtgtcattttaagatgctgcacttctagatttcttgttacatattaaagttaattctctcatttgtttgagatgtttctcagttatattttgtgttactccagaattataattatttgtttgcattttagtctcctccacaggagcataaattcatagaaatgtgttcatctttgtttccacaaagtataatatctagcacaaagtaggtggtaatttatgagtagtggcaatttgattgctgctattaaaaactttattgcatgaaaaggacatttatgtctctgaccagaaatagactggtaaaagttttaataaatgtatggaacatgggttaataacaggtgattgatggtagaactgttgctgtagggcattataggcaacttttgtaacatcataaggaagtcaactgctaactgtcattggagccattataagtctcagaataaggaatagaaagtacaacttttacatgacctagtatgacatgttctctttttaatgaaaaaaaaatccatggaaagaaaactgtgatgttgaaagactctcaaaagagaatctttcagaagtaaaagacagaaaataattttgcagcaaaaaacatttcatgccaagaatcacaatcacattcataatttggagtctgggtcttccaagaagctggagaacctgtgcttccctctttcttctgctaatttcaactaataaccctggatattatgtgcaaaataagaagacaaaaaccctgctattatatagataagaagactgtgaaatatagcaagaagaaggcagacaggttgatgacacccaaagaatgacacgatgggcttatttttacctcatatatcccacacatggagctaaagaagctggcaacctcaagataccagtcggcacagacaactcctccctcccctccaaaaaaattttgctctcttaagccaaaggataaggaaagtggaagcctaacaagacagaagattttagaaaataacagctatatggctgggcgtggtggctcacgcctgtaatcccagcactttgggaggctgaggtgggtggatcatgaagtcaggagttcgagaccatcctggccaacatggtgaaaccctgtctctactaaaaatataaaaagtagctgggcatggtggtgtgtgcctgtagtcccagctactcaggaggcagaggcaggagaatcacttgaacccaggaggcggaggttgcagtgagctgagatcgtgccattgcactccagcctgggtgacagagtgagactctgtctcgaaaaataaaataacagctacattttagttatttatcacataaattactgtggcctgagtccagcccacaccagccaaccaagccagaatcctgggctttcaccatcaccaggtggtaatgacaaacgccccccatttcccccaccctccacaaaagtcatatcaaagaaagacatctttcctctctgagtaacagcaagtccctgtagtgtcagtggagaccaggtgggaaagctggatgtccactccaactcaacagtaataaggcatcctcccacatgttcgagtgatgtcagaagaccaggggagagtcaggacttttaacacttctcagtggtaatgagatcaaccccctaccccaagtgtcagtggggaccacatgggaaacaggaaataggcactcctacgcctcccagcgagggaggtatcatacgtttctagtgggggctggtcatcccaactccatccgtctccaaacattttatatatatatatatatatatttaaattttcattttagatttgagggtacatgtgaaggttagttacatagataaacatgtgacatgagggttggttgtgcatattagcatatcacccaggtattcaactcagtaaccagtagttatcttttctgcttcccctcttcctcccacccttccccctgaggtaaatcccagtgtctgttgtttccttctttgtgttcataagttcttatcatttagctctcttccaaacactttaaaacctaaccacatgcttctaaataatctatgcataaaacagatagcctcaagaaaaataaaaaaatatacattgccttgctagaaggaatataaaaatgtagtccaaaaaattgtaggacatacctaaagtagtgctgagataaaatttatagcagtagatgcatacgtaaaagaagaaaagtctcagccgggcgcggtggctcaagcctgtaatcccagcagtttgggagcctaacgcgggcagatcacctgaggtcaggagttcgagaccagccaggccagcatggtgaaaccctgtctctactaaaaaaatacaaaaattagccggtctacgtggcataagcctgtaatcgcagctactcgggaagctgaggtaggagaattgcttgaacccaggaggtggaggttacggtgacctgagactgtgacactgcactccagcctgggcaacagcgtgagactccatctcaaaaaaaataataaaagtctgaaattaataatttaaacttccaccacaagaagatataaaaagaaaagcaaaataaacataagacacatataaaaagtaagtaggaatgtgggctggaagaaaatgggtatgcctgtagaagagaaaataataaagataagagcagaaatcaacgaaattgataatggaaaaataatagagaaaatcagtgaaccaaacatctggttcttcaaaatgattgatgaagctgaaaaacctaacacaagactgtaaaagaaaaaaagagaagacacaaattatcaatacaaaaaataaaatagatcctgccaaaatcaaaatgataacaagagaatatggcaaacaactctacaaacataaattttaaaactttgaagaaatgtgtcaattcctcaaaattaaactaccacaattcacccaatatgaaatagataatttgaatagacttatatttctatatctcttaagtaatttaattcataatttaaaacttccccaaaatagtttccaggcccagattatttcactgaagaactcaattcaacatttaaagaataacttacatcaattctacactccatcttccagaaaatagaaaaggaaggaaaacttgtcattcatttttgaagctagtattgccctgatgccaaaaccaaagaaaagcaatataaaataaaaaacgatagaccaaaatctatcattaatatagatacaaaatgttttagcaagatgttagcaaatagaattctacagtatattaagaaaaatacatcattaccaactaaggtttattccgtgaatgcaagactggtgccataattgaatatcagtcaatataacctattatttcagcaagctaaagtagaaaatcacataatatctaccagcagagtaaaaggatttcataaattttaacatcaataataatttaaataatttcagaaaaatagaactatttgggaatagaaaggaacttcctcaacttggtaaaaagcattaatcgtaaaacttacaactgacattatacttaatggtgaaacactgaatgcttttttacaaagggtgagaacaagacaaagatgtttgcttcactgctcattcggcatgctgctgcaagttctagccagtgcagtaaggcaaaaagaaaagatagaagaaaatagaaagcatacagataataaaggaagaaataaaactatccctctttgaagaagacgtgatggattgtctatatagggaatcccaagtaatctaccaaaaaacacctacaactaataaattaattcaataaacatgcaaaaggtaactttatttctaaatattagcaatgtctacatgaatataagaattaaaaatacaataccatttagagttgttgaaaatataagaagcactcaagtgtaaatctatcaatgcatataaggagattgtatgctgaaaattacaaaatgctgatgaaagaaaaggagatcaaaattaatttagatatatgccattttcatggactagaagactaaataaacatagtaaagatattgatcgcattaaattgatgtagaggtttaacataacacctctcaaaacccaagcaagaattttgtagatatagaaaaacatcactctaaaatttgcatggaaaatcaaaggaatcagaacagccaagataattttgtggaagaataatgaagtgggaactactctagttcataatttatatagctacagtaataaagattgtgttgtcttgtcatagagatacatacgtagatcaatggaaaagaatgaacccacacaaatatgaccaactgattctgtaaaagtgcaagagttattcactagaaaagagataaccatttaaataaatgaataattggtgctagagcaactggacatccatagacagaaaaataaaatctcacactcttaagaatattaactcaaaatccttcatggacttcaaagtaaaacataaagctataaaacttttagagaaaaacatatgagaaaatcttggcatctagattgaaaacaagttcattagaatttacaaaaataacacactacattaaaaaaatgataaactgaacttcatcaaaacaaaacaaaaacttttgatttgtaagagatcaagaggatacaaatacaagcccaagcaacaaagtgagagaaaatattatcaactatttatcccaaaaaggactaatgtctagaatatataaagaactctcaaaacttgacattataaatcaaataatccaattagaaaattggcaaaagccaagaactatttcattaaagagaatatagagatggccgataagcatatgaaaagttgtttggcattattagctattaaggaaatgcaaattaataccacactgtggtatgactatatacctgtcaggatgattcattaaaataaaaagtagcgacaacaccaaatgccaaatcactcatacattacaggcaaagcaaattttgtctatttcttacaaaactaaacatacctttgccatatgacccagcaattgcactcttgggcatccatcccagagaaataaaaacttatgttcatacaacaacctatacacaaatatttatagaatccttattcataatagtccaaaactgggaacaacccagatgccttaaacaaactgtgatatgttcatataatggaatacatctcaacactaaaaatgagccaactatttttacaagcaacaacttgaataaatctttagaaaactaagctgaattagaaatgacaatcccccatgcaatacatattttatgagtccatttataaaatatttttgaaaggataaaattatagaaagggagaacaaattagttattgcctatgattttagaaggggtgtgggctggaaggatcttgtattctgtaaaacaacaacatgagaggtctttgtcttgatagacatgttctatgttaactctattaatgtcaacatccttgtcataatattttaccatagttttgcaaaatgttacccatgggacaaatgaggtaaagattacaatgagattgctctatattatttcttacaactacatatgaattttcaattacctcaagaagtttagttcgaaaaaggagaaagaaaagcattcagacaaacaaaattacttgtctcccatatttttaaaacttgaattcaatccaaatgactttgaggctttgcctgatagccacatgcaaacagtaacatataaccaacagctgatttttaattgtgcaggacaactatactgtgatagactgaatatttatttatctgagtcagggacttaagagttcaactgctcaggtcctgaagttttagcaaattattttctgccagaatttgttcatcagtaatgattatttctttgtttttctcagcatctgattcaataagattttcaccttagaaatgtaaatgtcaacaattgtgtgatagaacttgcatctataaaaaagaacaatatatgttttccagtaagagctatcatctatatttagttttcttgagtattttcaaaataaataaaataagaaataaacaaaaacaaaagatacttgagtcaggcataggtatatttggttaatggagagtcatttaactattcctctgtacatgagtagacaattctcaaaagaagatatacaaatggtcaacaaacatttaaaaacatgctcaacatcactaatgatcaggaaaatgcaaatcaaaaccacaatgcaatactacctactcctgcaagaatggccataataaaaaaaaaatagatgttggagtggatgcggtgaaaagggaacacttctacactgctggagggaatgtaagctagtacaacactatgaaaaacagtgtggagattccttaaagaactaaaagtagaactaccatttgatccagcaatcccactactggtatctacccagaggaaaagaagtcattacaggaaaaagatatttgaacacacatgtgggtatatatatatatatatatatatatatatatatatatatatatatatatatatatagagagagagagagagagagagagagagagagagagagagagagagagaggtgatggaatactactaagccataaaaaggaatcaattaatggcattcacagcaacttggatggaactggagactattactcgaagtgaagtaacaaaggaagggaaaaccaaacatcgtatgttctcactcataagtgggaactaagctatgagagtgcaaaggcataagaatgatacaatggactaatggactttggggactcaggggaaagggtggaggagggggagggataaaaaactaaaaatttggttcagcgtatactgctagggtgatgggtgtaccagaatcttaacaacaccaaagaatttactcatgtaatcaaataccacctgttcctcaaaaacctgtagaaataattttttttaaattacaggaaaaagaaccaatggttctaataataaacactttaaaccattataaccttctcagtcaaaaaagctctctttttattcaaaatagacaaatctggagaagtgacacagcaaggatcctgtcttacaaagaaaatatgctcatatcccaaacttttatttttttttttcatttgtagaaatgtctttgtgctttttccaaagtgctgcttcttcagttgggctgctgaaagctgtaaaggtgaagtggagctctaagcgggacctcgtttcataaggatgcttttttgcctcataacataataggctctaatctaaaataagaaaaacaatctttggaaataaagccatagtcttaaaatctcgcctgcctttgcagatttccttttaccaaagtgcatcagagcacttaaagtgggacctgacttccaatggaaacatgtaaaaacaataataattctagtgtcctggtgacagctctttgactctctttaggctttctgtgatttgcctactttttaaaaacatttttccgttattcacaatggcaaaaaagtgaaatgaaaacagttttgttttctttgctaaagagagaccagacatttttttttaaagctttcttcctttcaatttgtttcttgcatgttggcaccattaccaattgttctgctggtgctagtgtctaagaagcttatacaattagttttatgaaaattttccaaagtaaaactgcattcatgtagtctcatgaaattttttgtcaactgggtaacgatgttattataaaatctataaaatcatactcaagtattaaattatatgaaaaaccactagtcataaacacagtaacaatgcaatcatgacttcttaaggttgttctagtttgtaatggagtataaagtccccattttgtgtgagtgaattttcattggcaacaaataaaaactatctgaaaattgaaaaagtcatattatcatcagtatgtttaccatacttctggattcatatagtgcatcctttctttgaagttgtgtgggaggtgatttattatttgttcatcaccattttgaaggtgaaaacatctctttttattgtctacccatttatttacttatacatttttttccttttatcagaaaggcagtatagtaaaaacattgtatttttcaattcctgtggaaaaaataagagaatacaaatcagatagttttgcccaaaaatataggttaagaaatactactgcaactgaaaaccaaatataattccatacattctagcagtcaagacaaaaaaaattatccattgcttaaaaaattatactagttcaccatagtaaaataaagtataatactcagaagaatttttgacgtgactatgctggaaacattcatctttgataaatgctttgtgaaatctgaagaaatatgctttccatagactaggaattttcttttatatttcagggaatttatggaaaagctttacttttccataaatatggtttacataaaccatactatgttagaagcagaactaaaattgtgaacctgatcttccaattctgatgttttgtcccattgattatgcatagtctaaccttctattgttcttatttggagaactagtacaaccctttgaagatgaaatatgtaggcgttagaatcattgtaatatataggtctttttgaccttataggccctgaccccaaaagaggggctaattgaaccaatttggcaataattggctgcagtgagatggtttaacactgaggtaaaggcccccacattttgcatatgtctaaaattccttataggaaaagaaatccttttattttaccatcaaagtgatgtacataaaagtaaataactctggaaaaggtaataatttgccttagtatctcattaagctttaatggagaagaaaactgatagcatgaagacaattttggggtgagagaaaaaaaagaaagagacaggtgtgcttctgttgtaagcttcacaaaatacagatttctgaattacatcttcaattgtcctgctgtattatactgaatggggttccaaaagtcttcataattaacaaatgaactccttgggtaacactgatatgggctgtctacaaacttcattcagggagaccattagtgggagggagacccagaagcaaaggccattttggcaacaggatcaacaggtgaagatgaacttggcacaatctatggtttccaatctaaaaagtatcaatgtgcacaaagaagcattaattagggattattttctaataaagcttatataccataaagcatccttttgaaatagaaaatgtaggtcaggcacagtggttcacccatgtaatcccagcattttgggaggctgaggcgggagaattgcttgatcccaggagttcaagaccagcctgggcaacttgtccatatgctgtctctacaaaaaatttaaaaaaattaggcaggcttggtggcacatgtctgtggccccagctacttgggaggctgaggcaggaggatcaattgagcccaggaggccaaggctgcagtgtgccatgacagtgccacttcaccccagcctgggtgacagagcaagaccctttctcataaaaaaaaaagaagaaatagaaaatatattcaacctactctttaattgctaacttttatgtctgcttactatgtgccaggcaattttccaagtgttttcatgtattgacttatccttacaacaaactatgagggaaatgctaattaaaatcatctttatcctgttgcagcaatgaggaaacggaagcatagggaagttcggtatcttgctctggttcacagcaaatgaaacatagagccacggtctctatgtttctatgcctcaccaggcatttggtctccagagctgaactcttgaccgctgtgttattt

SEQ ID NO: 2462 - DNA, 2490 bp, Homo sapiens
ccccgagatcggggcccagactgactgtgcctgcgggttcctcccatgcccccttgctcgtggaggggccaggagggttagggaggttgccatgattgtacccccttaacccagcctttgcatcccaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacgggggcttgtgtctgtaaatagccatgatactaactttcttcccatctgtgcaacggggcccccccagggcagctaggaggtcctcccctctcctctccaccaccccctgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccacccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaacccta

SEQ ID NO: 2463 - DNA, 3115 bp, Homo sapiens
tgtatctctatatatatcctattgggtctgtttctctggagaactctaataatatactacctaatcaaattgttgcgaggattaaataaaatgatatatgtcatagtgccaaataacaagccctcaacaaatggccattatctttattactagtgggatttagatcatgtgcttcttactaaaataataaataatatttattgtttgtttcagctatgaaaagaaaacatttggaagatcactgattccttcatggagaggctggcttgggaatagatgacgtgtcaaagattgacatcaaccttgagtgcttatttgtggacttgagatacagataaaaaaaaaaaaaaaaaaacctccctagagtgagggctacttgggatacatgctatatcccaaggagttctcagtttgaggtcagccccagctctacaactcaccaggagagtgcgcgaggatgagggagagacagcctgctctggttctcttcaaggtgacaatgacacctgttgacagatgagaattccagccaggaatacagatttaggaatcatgtttctcactctcatgatgacatagaagagatgcgtctgaatctttctgccagtgtgttaaagttattctgatattgactgtagttctgagctttgtctctatcccaccaaaccactaacttctggaaattacttgtagaccaagatgggaggactccgtgtgtggctccctctcttcatgtgacaaagaaacttcctaaaatactaaaagctaaaggagattgttatctaagcttgagatggaaggttgccagcggaaacttggaggatcacagccagtcgcctgggattgaccacagggagtggcagaggcagaaagcaaaagaccagttgcaattatccagaatcctgaattgagcctgtgttcccagttcctagaaaccctcaaggttattggtttcctcctcgcttaatagaccagtggaagaaatctacctccagttctatcttcacatgagcaactgtttacagtttacaatattactctgaaaatcagttcttttcaagttttatctaacacccaccagaagaaacagaagattatgaaaatggaatttgtcaaagttcctctcccaacaatatgatatttaattttgctaacatttttttttgaacacttactatattgcagacaatggtctaagtaaagcattttatgtgcatcctatcatgtcatcatcacacagccctgtgaggtagatactattattattaaccacatttcacattcaaaaaaactgaggcttagagagactaagtaaattgtccaaggtcacacagccatgaagtggcagagctgtggttaaaacctatgtctgtctgatgtttaagattttgctgttagcattactttgaaatgacaatatgagggcattttatgtattttttttgccccaatatgatctgcagaaactatgtattttaagtactacatttcttttatttaccaaattattgtcagataagaaaccgaaataaaagtttacagggtctaggattcctccataatgaatgaactttggggtatttcagtgacaaattggctttaacgcgatcaaattccatcctacaatgaaagtgtgttagtttgtggtttcaagtttaaaaacagcactgtattgtcttccagaaatatataaatagaaattcaagaagtatttcaatgaatacagataaaattagttttgttagaacatcaaatatgtgggtttcatttcttagctcagtttagaaactgtaatttcaattttttttagcagctgtggtaaattttgagatttgaaatttcatataatataaatcctcatttattgagcatttaaattatatgcccaacaatttactgtgtacattacttcacttgttcttaactataactctacaaaatattattgtccttgatttatagatgaagatattgagactcagttaagtaacttgcttgaaattcaaaaacgttaactgtggaaggcagtatttgaacccagtgttcaaaaccccatgctctttttattatatgaccttatttcctattcagtcttcagaagatatattgtcttattagattattctcgttctctaaataagtgaccttgggcaactatctttttccctggtattttcccctgcctttaaaacaatgtgatcaaactggaagtttttcacgatctctcttagccctaaagctccttggttctgtaattccaccaatagcccatttcaaaaataattctacagtaatcagtgggactcctgtttttcccatcttttttttttttgaaacagaaaattgaaacttttaaattagtttagtaaatacatctactagtttttttcttttatagtcatggttatattatttggtccttcttagttgcaacatgtttccttgctgtcaatttataatacctctcatcaacaatagcctgaagaaatagatttgaattgctttccctaatttatagctggaaaactaggctacgctggtatcttaaattgactttcctgaggtcacgggcactcagtgccaagaggagttggtacctacgcatttgaaatttctggatttctggtcttactctgtacttagtcactcttttctttcatttggccctatggtgggcaaactacagcctacaggccaattccagcctaccatctgtttttgtatggtccatgaactaagaatggttatcacattttaaaatggtgggaaaaaaagactattttgtgacataaaaattatatgaaatccaaatttcagtgtctataaattttgttggaatatagttaccacactcattcttttatgcactgtttttggctggttttctgcctcaacagcagagttgagtaggtgcaaccaagactgtatggcctacaaagcctaaaagtttgttatagaaaagtttgctgaccaactctattggttgcttagtattgctaggcactctgcaagtcacagggaacacagcaaactagacacatgactgccttgggcttaagaagaggtttctaaacttttgaataaaaaacaaaacaaacaacaaacaaagttggag

SEQ ID NO: 2464 - DNA, 9622 bp, Homo sapiens
ccgaggccccatctgttctgtcattttctgacttgtcagatataggtcaggacaggcccgcgcctgccgggccagcgctgtagcaggtgaacccagggtgtatcagcgtttccctttaggccactcttgtcaatgctcccaacggcctcctccttcctccctgtgctgctctggggaggtctcttggctctgcccggcagtaggaacagtggagacaaagacagcttcacattctcttcagctgtcaggattgagagtggcggattcgggaggagaaaaatgagtcagtggcaactcgttgtgtgtgactgtgcagtttatctgagtccgcgggagccatagtcgtaggctgaaaatgacccttatttaagagaggctgagtgcgtggttgtggctgcccaggcgctttgctggactaggcagcctgggaacactaactgagaagtggacggggacaggagccagcctgcggtcctcagtgtcttacagtttcctggagaagtggatgtttcggcaggaagatggtgggtaaacacctggaacgatccattctgctcacttttctacttccctgtaccagtgccatggaatgagaggcagctccattaactcgtttaagatcctcataaagggagttaatatcctgtaattacacaggtgaattgcatttagcaggtccatttgaagaatggcagcgaaatggatcctgtcttagtagtgtgacctttactgggtgagttaaatcccaaagctagccaatttaaggatatggaaggaccttctgtggctttatttcttcatcacctcattttttggtttgtgtagatctttccacgttgcagtggcatttatgaagctgctgaggccttctgaaacttgacagcctgttatgcttcttttgttaataaagtttaacaaaactgttgaactcattctgagcagggggtgaaggggcaaagactgtacaggaaaacaggacataagtctgctttccttaaaagaaaaaagttaagagacaggacaagccatttcttttctgcctcttcgtattacaagttccttgttgctatgcctgttgcctgcagatagctgctaacacctcccgtgccctctcgatggcttgcctccatgcccatctgagtggcttaactcactcttctgaccacaacagcatgtttgatttggaggtgagacttcggttcctccttcttcaagtgctaaccagctggagctgcaaaaatcttctcccctggcaacctgaaggttgacttaaggctagaatatctttttcttgcatcattagtttttgggacatagcagagttagctggtgagagagatggcagtgaaaacacttctgggctaaacctactaaaccgtcaagtaaaaagtgactatgagattcgtggtgtttccttttgtccttcactctgctgaactctaattctcgccttttaagtcattcatttagactttagagtcactaaagaataagagactgaaattacaggtccaaaggtgtaaaggaaagaaagaaattcatctgaatggaaatagccagtccttgaggcccatggctccgccattctgccagccatgtcacatgatctcatttcatctctccagtcctggaaagtgggcattagtaacagctgaggacttcagactcagtgtgttcaaagtcacacaacttgggagtggccaagttaagactcaaacctgaagccactgcctttaaccgcgaagccatgaagtctcccagcaactgctacaaggggacagtgtccttgaacccaaccctgcagggcgagttgggtttaaataagcagagggaaaaaggaagagaattctgggcaagaggagtagttggtacgagcaaaagtgtgggggaaggactgtgcatgacatagaagagtgcctgctggttgcgagctccacggggcagggcaccagggcctctggagccatcttatatctcccagtgcctgagtggctatgcatagtagctgctcaataaatatttattgcatgagtgaatacttgaaaagactgttatcttctccataggctgagtaccctgagagcagggatttggtcttagaaatctttggatgttctgcaactcacagtggttaataaatagcaaacactcagtgagtgtgtcctgatgaaatgagtgaaggaacagcaggtaagggaaggtgagatgtgcttgagtgaagagtcactgatactttgagaaaaactgagcaatatatgcagactggcttggtaagggcatatcatggatggtcatcaatgccaggatgaggagctcttgtgtcctccttgagacattttttaaaaatccatctcttactgcacaacatcgtgggccacaggaacccaggcagtgctcaaactgatggctgcatattggaaccagagtctagcacagcttagaaatcatttttctgcaggactggccttaggctggccccattgtcactgtcttcccacttgagggtgaccacactgttacaaccgaaaagagccctgtgcaaacttgtgaatgggaacctgccagggaatagatgctattgctgggtcccgcagttgttttcggggtagttaggctggaaagtcccagccaacttcctctaagaggtgttctcaggccaggagttctcaataaaagcttccctctcttttcaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatgtaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagagtttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcgtgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgttaccctattctcatgctgggtgccccaggggtgtcttgatcgaatttgcaagtatagcagtcaaatcagatcttttttttttttcctcaaattagatcttgatgcatctttccctcaaactccctgccccaacttctgcctcctcttttcttgttgcctctactccacagtcagacagcagccttagctcagccagtcttccctgggttttgtttgcaatcctggactggattggcaactcatttcctggagaaacatattgtggagctagaaaatactgaaaaaagtctgagaagccaatactttttctaaaaccagcttggcctttcttcccagagtatttgacctagagggaacagttaccatatgtactcatggatgatctcatatattcccctctgattctgtttggcagaggaaatttatgttttactctgcataaatacttctaggaggcttatagcagcaacagtctgagaccgctaaagacttaataagagcctttgaagaggtgtgactgattagtcatcctgtagggtgtaaaaggagagtgtgtatgttttggttgagcctttgcaggtcataactatggtaaataaccactgagcattctgcctcaacaggtttcatgtcattagtgtgcccatgacatagcagtgcaccatcatattcattcatccacccatctacccatcaaacacttgtggagtttccattgtgtgtaggcgcttttcttcgtactagggatacagtgatggacaaataaccaaggtgcctgctctcatggagcttacactataggggggaaggctggaaatcaggtcaacacaagcatcacaactaccaaacaacactggatgaaatggcaaagtgccagtgactggagagtgaagaaaggatgacggtgggtagaatggccaaaggaggtctctctccaagtcaactgactcaagagctgagtgacaaggagccagccttacgatctgctttgtttccgatcactgccataactatcacagacttagcagctcaaaacaacatatttattattacagttcgttggctggaagtctgacgggtctcactgggctgaaatcaaggtggtgtcaaggctgcattcctttctggaagctttaagggataatctgtttccttacctctgccagctcttagaggctgcccatattccttggcttgtggctttcttcctccatcttcaaagccagcagtgaatggtgggttgagtccctttcacatggcatcactccaaactacattcggcctccctaggacccttgttgattacattgagcccatccagataatccaggattatctcccaactcaaggtctctaatcacatctgcaaagtcccttttgccttgtaggatacattgcaggtactgtggattaggatgtggacatccttgatgggggagggggagtctttattctgccccacagaataatgattaccacataatccttaggttttgctgcttctactgattactctttgtgggtagcaagctcccaaaagaccagcttagctactgaggaaactccttgtcctccggcccagtggaatttgatgggaaaagagaaggaaagcaagatggacaaaaagtgtcccccccagggctctgccttcacgctaaggagcagtggtaagttggctgaagctcttctgaaagtccttaaatgtccttgagtccctcagctggccagagatacactggtgtcctctctggcatgcttcttcttgtctccatccctcctcagctggactgaagatttctgtgggtactgctctgctgccgcctctgctgaaatctctctcccagcaggagaaaggccagccatgggatgtactgtggagcctgggaagatgaaactgcagcatagaagtgctggtctcagtgttcaggggagactgggtgacatggcctggggactttacggcctgacctccacccaccatggcctagactcccacagagaccatgattctgtagtcccaggctccaatctctaattgcctcattgccttctgtcaggccctcaccatccccagtctggacttacacaacttggtacttcctgtatttgtgtacagactccatctctcccttatggacattcccatttgatctaagatgcaacccctgcttaaaacttttccttggctttcgatataatccacacacctaaacttgacttcaaggtccttcacaagctggccccacctaccttcctggcctcattggctgctctttgactccctcgagttggagaccaacagcttcaccaggactgttcattgtcccaggaagctgcctttcatctccacatcccctgccatgctcccactgttccctctccctgggggccctcctcacttctccagatagaagcagccacttcaacctctatacattctcaggggcttaatccaggaagtcaagaatgggtaggatttatatgtgcaggcttagggcctcacaatagagaagtttctaagtcctgtgcattgaataaatgaatgggatggtgtaattctgatccccaccccgcccctcccaggtatgtgcagaaaggacaccgcctctctcctttttctccaggtagggatcttccccatgcagctctctccaagcatgttccaactgaggctgtgtggccaggtgacccagtgaacacaggtgggagtctgagcccttcttccaactccttgcctttgctccagccaatgtctgccacttccctgcagagagttaaccctgttcctggggatgttttgctccagagccagctcattttcttggcctgccctctttctgtctgtggtaagagattgctttgggatctgacagtcctgaggacagtgagagcacctgttgtttgctctttgaagcaatcaaagagccatctctttgaagaagctctcctgccaggaagagggagtgtcccaggccagtgaactcaggcaagagcctccttgtcctaaccctctctgcattcaggaatctagcatgagggccgagtactaggctgttcctcacaacaaccttgcaaggcaggtgtcaccctcattttgcagatgagcaaactgagccttgggtcttttaagcaatggagcttggacttgaccccaggttcaccacaagtccagtggtcatccctttctattctaggaggtaccctagcctgatagaaaatgaagaatagctaagccaggggcagaatctgctcagcttgctacaaggtaagagatgttccagcgtttctagaaaagctgaggaacaaagctgcatctcttgcttttctgcagtcatttctagaaaacctcatggcgtagggactctggtatcctggacagtaaatttcttatgtagaaaagatttcgg

SEQ ID NO: 2465 - DNA, 2260 bp, Homo sapiens
aggaagaataataatttccaagaaaaagtacaggaatttattttatgtctttttgaatttagacagagaattatttcatagacatcatttagacaaagttagactggcctgaatttaactgcaggtcctgagacttattattaaggtcatatttgccaatgtctggtgagaaatagactgggaagatgaaaagcatcaaaagatttctaagggctaccaagattattgaggggatactgaagaacatgttttttatttaaatatttcctaggactgaccttcactcttttttcagtgaatctaccattaaaaaggaagaatctgtggccatcctggaaataaacagagtgacatggtgacaattgtggatcctctcctttgggataatgcactgtgtatcccattgcaagtgcttctcagacatcagtgcaacgacctcttcagtaatctgacctaaaatgttgatgttctttcactgcgaaggatgcatggaaactgaaaaaaagacatacagaaaaaaagagctatgtcagctaaatgaattgacttacgttcagttaatagacagctgttcatgttaatgccctctcacgccgtctttcactaggctacattcagagaagaggtatatttgcacgttttctttcccacagttccttgggcatgtgttatctcttttgcatcatcagtttatatttgagctaacagaggcttccatattaggcaatttatatgacagttggtttggcccagttgtttttcaagtatctttaatatcatctttattctattatttgtgcttctgataattttaaccaggaagatataaacaacttttgaaaaaaaatggcacagctcttttctattttaatgccctttgttgtcattcctgtactcagttttcttttgtaattaaaaaatatttagtacaatcagtgatttatttccacatttaaacttggaaatcctcttcaccaatatccttatcaatttctttcttattgataacatgttcatgctgtaaattgctttagtattattaatttcttgcctcctttcttctaggaactgttgagcaactgatttttgattatttcctgagttgttctgcaggcttgaaaggatagtttcttgttggtcaaatcacagaaaagtcttatacaagaattatcatcgggtcaagttctcagacttacattgtaattaattgcttagcctcattacttccacactatataatagttttactctttgttctttctattaaactggttttactttagaattttgtttcactgtaatgaatgccataagaatattctttaattcgatcattattattattattattttgagacggagtctcacactatcgtcggggccggagtgcagtggtgtgcaatctcggctcactgcaacctctgcctcctaggtacaagggattctcctgcctcagcctcccgagtagctgggattacaggcgcctgccaccatgcttggctaattttttgtatttttgaagagacggggtttcaccatgttggccgggctagtccccaactcgtgacctcgtgatctgcccacctcggcctcccaaagtgctgggattacaggcatgagccaccgcgcccagcctcggtgtttatttttacaaacaagatagctcacatttccctccaacaccattttaaaataaagcttgtcatttctatttgaccttttgttatctcttcctgattttctgagaatgatttatactaaatattatatcttttatattgtgtacatatatatgttatttataatcccatatctgaatatctgaattccaaaatactccaaaatctgactttttgagcacagcactgacatgacactcaaaggaaatgctctttggagcactttggattttggattttcagattagggatactttacggtttcaaaatctgaaaatctctgaaatctgtaacatttctggtctccagtgttttggattgggaatagtcaatctgtaacatacatgcatattacactgtgttttctttaattaaagtaattgcattaatttgtctaagctagggatgtatcaaaagtacatatttcattttgatccttaaatcaattttgacatatttcttcttatgattaaatacacatgattcatagaagaaataaggtcctccactgggatctttttgttttgtaaaagactttcattatacagctctgttggctatttatccagacccagctcctg

SEQ ID NO: 2466 - DNA, 3493 bp, Homo sapiens
ctgaacacttcctgagctagaatccgggctgacaccctcgtcttccgcaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaa

SEQ ID NO: 2467 - DNA, 6358 bp, Homo sapiens
agctatttcaactggctatgtgttaaattgtgatttcaacattatacttcgaggagcagggtccaattgcaatttttatttcttagtcttcctgctcctccactgctcagcgtgttatctcattcatagtagttacccatacatattatttaatttgaaggaatattaaaaagtgtactttatagaaattaaaatccattttgtttccaacattggaaaacagactttttatgtaaaacctactgaaggagaatttagatggcataagccactttgctgatgtttggaagaacgacgggacaggcaattgaatgctagattcaaggtcaaagctttgccccacttgtcctgagaccatttcttgttcttctttggaagaagtctcttgaaagtcatctgcatagccaaacttagagagcactcttatctaaaaggaactgcttgtcttcatctatgactcagattatttctttgcatattaaattacaagagacagttccagctggatccatcaatgtatttataactcagccacacaatcttcctccaggcagaaaacttggcacatgggctttcagcctggctgcagcattcaaagatgagaacaaaaaataatcacagcaatttttatatcaaattttatttaaattctgaatataataggataatttcaatctcctggcacacagtaagtcaccattttcaccaaaggagggagtgagaggggcagttgaggaactcaccaagagtcacaatataatttctccacctaccttagattctattctcaatgaacaatctttggtaacaacggtgagaatgtcctgtgaattctggaaaagaaaggagtgatgacattcattaatggtctggcataatgtctagcacaaaatctagaccactgtactgggtgctatgtatacactgtctcattaatcagtgaaatagattagattttcttcctataagaaagtagctcttgaagacagcaagacttttttttaattggaaaaaaaagaaaaaatttgcctttgacaaattagttagcacgtttagtgcacagattcattttctacaatttgtttagagctttgtttcctgtagaaattatataagtaattatatacacatgtcacttaaagtgctcttatataaaagaaattgcttgtgcatgtatattagtcataaacatctgtatttttatttagcatgtaacagaaaaccaaactgaaagtggtctaaacagaaaagtgatttgtttagtcatgtaactaaatattcaggaatagatctctatcttcagttgtaccttgaacgtgatcatggaattcagaatctctctctatttctctggccatctctgatattgaaatccttctcccctcgtagttccaagattaagtcattctatacctagaaattctagcagaaaagaatcttttatttcccaataaattaaattaaaatgcttaattatcattggcctattataaggcattgagccgtgacaaaactaattgctgtagccaaatgagggattagactgagaagcccaacctggatcctatgaattctagtaagatctatgtattagttaatataattatatcaatgttaaccttgtttttgataattatactctgactaggtgagatatttatatttaagaagctggatgaaagttatgtaggaagtctaagtgcaatttaaaaactcttccataagtctaaaatcatttaaaatttttttttgaaattatacttgaacttagtgggttatatgaaaataagcactgtaatgtgaatatatttgtgagaggctttgcttggcaagttttttccatcgtttgaatttcagtctgtggtctctatacctgataaccccagttttctcttatttttctttttggagtcacagaccatgtctttaatatggatattgttgatcacaaaaacatgtactatgatgtatatatttgtatatttatcttcccagttagattatgagcatcttgagggcccagcctgtaccttgttcatctttaaaatctcagaaccatgcggagggccaggcacagaatggaagctcattaaacgttagtataataaagcactaacatgcttacttgttaactcacatcagcatctggaatcacagactattattttaactggctaatggcttgactttcgaataaatatttaaaaggaattttaatttaaaatgtgcatttaattcttctcttttatagacaccagtgtccaataccatgctacagctggggaaaacatattctgtgtctgtttctgagaataataaaatagaaaaaaatgtgaatagcatttctatctttactgctttgtgtgtatgtgagggtatgagtggcggacagcattgagagtttatgcatttattctatgataatttattaaatatctcaatgctgtgctaagatatggtccacaccgccccatcttaagagattagtgaactcatctgaagaaccaagcatttcagtgagggggaaaaatcactttaaagtgtatcatattgaaactgaactcagccttcctccaccccgccccctgcccttgtcccctgtttttggaatgagccaatttccatcagctgtggtgttgtcacatgatatgtatccatcagcaaacatgcaccaagctcctgctgaggacaagtgtcatgagattaaaaaaaaaaaaagatcttgaaaaattctcacctacctgaatatgtcttactgctgatattttgtgtacctgatatttggcattttttaactaattaaaattattaaggtggtttagatgtaagtgtaagcctgttttaggcaacgcaaatgtaacttttagctacgaatatatactcaattctatctcagggaaatgtaatcacatatcctataagggtaaatataataaaagccagaggtcatgtacgtgttgaaattcaggaagaaggaaggagttattcatatctctggggctgaccaaatgctacaggctggagatccagccctctgtgggtcagcataaagtcaaaaagacttcctgaatacacataaaagcattattgggatcagtttccatggagttataaataatacagtaactgttcaatgactgttattgttgaaactactgaaaatggaagttatcccaatccctacctgttatggactgagccctccaccccaagttcctattttgaagccctgaaccccatcgtgatggtatttggagatagggtctttgggagataattaattttagatgagatcatgaaggtggggtcctcataatgagactaatgcccttataagaagaaacaccagagtgcttgcatgtttctctctctctctctctctctgtctctctgtgcatgtcttgtgaggacatagaaagacggtggtcatttacaaatcggcaagagagccatttcagaaaccaacaatgctagcaccttgatctagaatttgtaagtttcagaactgtgagaaaataaatttctgttgtgtaaaccatgcagtgtatggcattttgttatggtagttcaagctgctaagaaactacatttccatttctctatatttaacgacaatagggctgtgaacacgtggattcaagtccattggtaaatatttttgctgtgggtggctcttccttctgaagggctaagattaaacttgatgggggggacttcaataagatgttgggggatgcagaaataatcaggattactttagagaagcttttgccaatacagatgacattttaggctttagaaaacccgtaatccaaggatattgtcagctgtgggaaatatcctgctttataacagagacctggtgaaagaaatgggatactacaccttgttttctggtttgatcattaaagttcaagtataaattgtttctatataatgttattggtgtcaaaagtacttaattcaaatggcctgtttggtttacttaaaatgattgaaataaatagttcttacatgtggggcatttattcccttttgtggtatttctaaagacttttctaaatccactgttagatacttgaggaagcactgagccttgaccaagcctgaccaagacctaaaacatatgattactgggaaaactcataatccccaaagattctggatttcagtataggaggtttggtaactgtgttgggactaaatgtttttaaaatttatttcttttgtaatattttatagatacaagtattttaatatatttatgtgactcgtgatattttgttacatgcataaactatgtaatgatcatgtcaaggcatttggggtattcacaaactcaggcatttatcatttcaatgtgccgagaacatttcaaatccttttttctacctattttgaaatatacattattgttaatatagtcaacgactctatggaacattagaacttgttccttctatctaaccatatgtttgtacccattaaccaggcctttctttatccctgcctccccctaacacacaccctccccagcctctggcattcatcattctactcactacctctatgagaccaacttttttagctcacacataaaagtgagaacatgtaatatggtctttctgtgccaggcttattttacttaacatactgacttcgagtttcatccaacatattgctacaaatgaattgatttcattctttttataattgaatagtatcccattgtgaccatttatcaccttgttattatacatttgtctgttgatggacacaagttaatctcctatctttgctcttctaaatagtgctgcaatacacatgacagtgcagatttccctttgatgtaatttattttcctttggataaatacccagtagtgagattatagatctatatttagttttatgagaaatctccatactgttttccatagtggccatattaatttacattcccacagtgtatcagcattcccttttctccacatattcaccagcatctgttattttttgtctttttaataatagtcattctacctggggtaaaataatatatctcactgtggctttgatttgcatttaactgagaattagtgatgttgagagcgttatttcacagatttattggtcattggtatatctgcttttgagcaatgtctaaatatgtcctttgcccactttttaaaaataatttgaacttttatgttaaattcagggggacatatgcaggtttattacatgggtatattgtatcatgctgaggcttgaggtacaaatgatcccttcacccagatactgagcatagaacccaatagttattcaatgcttgccctccttcctccctccacactttcagagtctgtggtgtgaattgttgttatctttatgtccataggtactcaatgtttagctcccacttataagtgagacaagcagtatttagttttctgtttcgtttgttaatttacttaaagtaatggcctctagctctatccatgttgctgcaaagaaaatgatttcatgtttttatgactccatagtacttcatggggtagaggtaccacaatttctatatacaatccactgttgatgggcacctaggttgattccatgtctttgctattgtaaatagtgttgcgatgaacataggaatgcatatgtctttttggtagaacaatttatattcctctgggtatatacccaataataggattgctgggtcaaatggtagttctgttttaagttatttgagacatcttcaaacttctttctacagtggttggactaaattacattcccgctgacagtacgaatttggaatagagatgtacaaagacacgagggaaatgcttggaagctctcaagtgcggagaattctttgcacagactccctctctctgcacagatgaacaccatgagcttgctggaaggggttcaaagaacagcccacagcagcactcgagtttgctaaagtgactgacgttggcttcagtttggaatccaaaggcgacaactgacaaggaagagcggaagggaagggagaagtgagatttgaacagttgcaaaagcccaaggcagcagaaggcaaacatcttctggggttatcaagtgctcatagcaagtggcaccagacatctttctaacagagtaacatctggtgattgaagcagccagccctaaagaaacacctctctctccctccattgtagagtctgaaacaataggcaaaacaagaatggattgtttgcattttgatatctcatttattcatctttgatgggagagttgattgtaataaaattgggaatattaaatagtgcctactgtacatcagatattattctaagtgcttg

SEQ ID NO: 2468 - DNA, 16087 bp, Homo sapiens
tggaaatattgggcagggagaaagggtgcttttagaaccgagctgttcagggtcccagatcctctaatgtaatgccagctgaacccagacagtgacttccacctccatgaatgcaggtgattgcatcctttgaaagcctgtttgcatagcagacaatgaagctgagcagagaaaaacaagatgagagacagatggagtaggagacctgagaagatggcttgagtccatgaattctggtgttccctaggccacatttgcccccatccttcccagatcctatttgtgagccattgggcatcttagctcaattcatggtgggctgactgtccatgtttccttcagccaccctggacggcagctgtgtgccgggtgagttagaggatgaattgcagctctataatgatctgttttcattatcagaggagtccttctcaactctcgtttctcgctgactgcttctcctttccatagcctgacttgagttcttgcctgctttgaccatgagaactgaaaattgaggactagtaagtataagcccttcctggggctcctatcacatggcatgtgcccattggaatggtaaaattgaggacaaatgtaaaacaaaacaaaacaacaaaacaaaacaaaacaaaacctttctccagcactaacagctggtgggcttaagaattattcaggttaagttgaattgacttcaagtttgagctgacttggtctgtgaagttgtatggacttctaatcaccagaaatcctcagctctgcctcagtctaaaattaccgagtcccttcctttgagtcaagaagataagtcaaactattctagaaaagccaccatccctctaggacctcatgtattaatgtagggtatgggctgggctgctgactcaaacaatatattcctctcctgtgcaataaggcaagtggaagcttttccccatgggttaatccagtcacataatttcttctattgcatcctcccctcaccacctctgtggagcaccaagtctctattccagctcacacacacaggaaatggcaaaaaaagaagtggggagtgaaagctttctttgaaaaatgagatgtgaaagttgcacatatctcttctgcttctatctgtttgccaaaatttagttataaggccaccccttcatgcaagggatgctgtgaaatgtacatttagctgggtagcaactgtcctgctaaaatccagtgggaagagtgctcccttattaaaacgaagaaggggaaaacgtatcttgggaatatttagcaatctctgcctcatctggcactatattttgatacctgcacaggtaagaaaaatccactcacgtaatacgaagtcaaaccataacctatctacatatttagatctatctatctacaactatctatagttcatcaattctaacacacgttttacaccatagcagctcagctctcaaactggaatgtctcttcacagttgatggtgtcttatggtctctgccagccagaaagcagtaatggtgtggttgtcattgcctgcacattcataaacttagccatttaaaggataagctctccacaggtgcgaaaaaaccccaaacatttaagaccatttgagaaaggaatgtgagtgttggccttgccttgtaatcttctgttgacacctgaaaaaaatcaaggatgttccagcatcaaaagttgcagaatgggtgtcagcttcttggaagaaaattccagagaaaagagaggaatcctcagaagaaatgcatcaccaatgctcttgatagcatgaggaacagaaatacacagaaaaattataaactttaatgattctgagttgaaaaataaattataagactttgaatgtagatatgtagaattctctatttagtgtatgttttagcatgatatatgctaaaagtctattctaaataagcccaaaagagctttaagcaatatgaaaacatcgaggctatcaaaatattatcccaaacttggaaatagacaagagagatttatttttagtgcagtgctaggtttgattttctatttggctattttataattttatagaggtagagtttagattgtagatttagtccagtagaaatgcaaatcatttctatcccatgaaatggataagcccaatgatatggctatagctttgtctgatattaatcagatttttgctttgttttcttcaaatttaacccaacaatctagtaaatcacctatatatacacccaacttctcaaatcccatttggactcgtttaatattatgcttgttctcttaataattagcaagttgaataaaatctttgatgtgcttactttaagtttgcatgagagttttcttcttcctttaacaaatcataggacacttggcagcatttctttagtgatgcagaaaataatggcatgacttgcaattgatggcatgctaagttcgatggattatggtattgctgctgcctcaatttctatttcatcagcaagctagtgaaaaggaaattagggtgaccaaatcacaaatgttgtaggcatgacatctcaaaatgttttgatgaagctttagtctggaaacactctgcaataggcatatgtcattattttgcctgctcagcatcagaaatgcattcctttgtttcgggaatttcctatctgtgatatcttatggcacattgagatgctttcccactgctgaagctaaccgtggcagatacttgcttccccagcctcctttgaagctgagacatagatatgtttacaccatcctggactataaattagaaactggtgcctcagtcaagcaggttcttcagggaatcctctctaggggtggcactagctgtcacagacagagttcttagggtggccatcgctgaagcgggagcactgggcaagtgcctagggtgggtagtggaggcagcatcagtttttggcctgagttgatctgagtcctctgaggttgtgtggcctctcaatttgcttctccagctaccttgtaaatgctgtgagccactcaatctcctttaatagcttctcaatcttctttaatcagtgagagtcatttgcatgaaacagaaaacaccaatggaacagatattgagactcggagagtcgacaggaagcagtgcttcatgagtaaatttggttttctacctgcccagttgttttgatgactcacactaattgtatttgagatgacagatattttaaaatttaatgtagataaaggagcccaaagacctagagagataggaatgttgtagagaatttatcatggcaacctgttttgctattccccaactatggccctcaagctggcctgcaaggcactccctttgccaaagctttgagggccatcctagaacctttaaaaaacactgcagcgggggaatcagagatagttaatgtagcctggttggggctaaagacagtgaaaaaacactggtttcctagagttttctcctggttctctaactcttcctctccttgataattgctctctggaggctggtgatacaggtgaaagatgctatctttgaaatggcttcttggtctcaaaagggatatcaggatccccatggtactggccttgaactaacggatgattcctggggacttggaatgctgctgtacttcccttagtcaaggagtaaggatttctttggttgtgtaataagtggaatttttagtcaagtgcaccccatagtaggcacaggggaggggagaaggggagagtctagttctttagggtataactggattaggagtagtcaacatctggcagaatttctacatcagctccctgacctatggtaagagccactatggtaggaagggccaatgaaaaacctctgaaactcctccacagaaaaattataaatcaaaagggatattggacccctagggaaatagcatgagtttacgtggttgtccagccttcccgacaattcttaagctgcccggtatcctttttaaaaattcttgttctgctgaaatcctctgaagccagtttcatttgcagtgccctgatactgctatatgattattttgccaatgaattgtataattaaacataagaaaaaaagaagttttattcttggcagttgttatatcaaagttaggtaacttcactttgaacagagaaaactagctcctgtgataaaatagtcatgagcttctgcaggcacttagcagtttaagaagtagccaagagacggattggacaccaccaacatattttacttatttgaacaatatgtgtgcacacccacttattggaccacaggcaaaagccctgaggtttggtcaaaatcagaatgctacattatgatggaacaagaatctggggaaacataaacaaatccaaaatctctaggattgcccgactacaaacaaatactcgagctttacgctgccactcctggaaaaataataactggcttctaataggcaaatagttctaggaagaacagacatttggaagacacaatttgcagagagaccagcaggcatatatttagggaaccataaaagcctctctataataaatgcagtttaattttttcaaaaggcaaaatcaaattatgctaaaagaattaagataaagtctcttgctgcagaaaagacactgtttatctttgcttgtatgatattaatttatatattcctgggtaaaagcaaaaattgagctacagaggtttttggttagtttctttggcttgttcgtttgttttaaatcagtcaccagcaattatagattctttcatattcacacatttgttcatccaacagtttttttcagtgcctgtctgtgctgggctcagggaaagcgtgggataggctggcatatgagaaaaacatggtaaatttgggcaactaaaagcagccgttggagcacaggaaacataaagggctacagataagcaaggatcagatgataaaatcctttgagatggcattagagaaacctgacattatacagtgcacaatggaaagacattacaatcctttaattaagacatggatgcaatcaggtttggcttttagaaagatcacagctgccacatggagaatgccacatggagaactggagggttcaggagtaggtgcacccatgttgcaggagcttaggagaaggaatggaggcaataattggaaggattcaagacaaatgtaggcagtgaaattaacaggaatttgttaagtaagtatgtgtgtatggggggaggtatgaggccagattctgacttgagaaataagattgttggtggtaccaatctcaattataaattacacaagaaaaacagagttgggagtggtgtaaatgatgagtttggtgtgttttattccaagtgcttgtggcacatgaaggttgaaatatccaaaaggctgctggatacataaatcacaaagaagagatctgagctgaagacatggcctctgaaatcatcagcatcatcccactagtggctgaaaccaagggttgatgggagaatagcaaagcacatagaagaggaccttgaggaacaataaacataagggctgtggctagaaagaggggaccataaagatgactgagaatcagtcagaaccagagatgtcatggaggccgaggaaagagacttgcaggaaggggtgggtaacaagtaagttacagactgagaagtagccaatgaatcgagcaattaggctcttttctgtgagttgtttctggggaagagagttatgctgcctatcataacaaggcagtgtttcttctccttttctttctcctctaccatctcttctttctccttcatctttttcttcctcttcattcccttctcctaaccctcccctcctccttactcttcttcgcagaccccccaaattcttaagaccaatgggaagtttaaaaattcaactatgtaattcacatcctatagttgcttttggtggaaacactttctctaatatattcaagacagactttctcatctaagataatttgccctgtcatctgtaggtgattatttgttctagggacagaagagctcctgaataacaggagtattggtagggaaagaaagaagtctgttgcagtgttctaaatgtgggagttgggggggattcagacatcaggtttcgggaataaagagtatttgagtgttgatctgagaaagaagaggtgagaggaaatagaggagatgagattaagagccaggcaactgaacacgtgcaaaaggagggtgaatgtgcagaagtctagatcttgagagcaggggaggaagttaagttttgaggttgctagagcagaaacacttgagcaatagatgccaggctggcggccgtggttgggtagaaaccaaagacccatgggcttttgctccctgagggcactgactaaaacttctctcctctcacctagtttctctttgatctttgctgtttggactatccactacctcattttcaatttgtttattcacttatttattcaaaaaatgcttgttgaacgtttatacgcattaagaagtggttgttgaacattcactacgcattaagtagcagatatacagatggaaacatggcatccttggcctcaagctatgctgtttaaagtagaaattggaagacccatgaacaagccttccctctgactgtgaaaagtggtataggggaattcagtataagttctgtggagatcctcaacaggaggacacctatgtctttctgggccatcagagaagccttcagagaggaatgaacttctgtggatccttcttcacagtttcaggtgcctcttactttgagtagcgtctgggatgcccttgcctggagaaatgatctctcctgtctgctgctttctttgtcttactgaggctttagggattatgtctcttggaatttttatgttgattttttgacctctcattcagatctctcattttggtattttgttctagttctctattagcaggttgcaagttttggattagatgatgtctgctctacacctacttcttgggttattccatctcaggaactcattacttcacaaccagagaatgcatatttcatcgttttaagtttgtttcatactcgtggtggtggtggggaattctaacctccttgtctctggccaaacctaatgacattgatgataaaggacttggaaataataaatgaaatacggtcactctgtggaccaggataatgttctcctaggaatgtcttcctcagttacacacaacaagaatctggctcttagaacttcaaaattaaacatccaagtctactgataatggagcattttaagttagaggaaatagtattcttggaaactaaccaaaatagttagaaaataaaatgggtttagtaggtgctttcaaagggtgtactacagacattagtataaatgagcttggacaaaaatcccctgtctctggtatatgtatgtcactccacactatccctttctttctcgacaaggagattttgttatagaatctgcctaatgagaaaatcagaaaaagaaaaggtgatgttctcatttcaaaacaaagcttaaaaattatatcaatgcattaacagaaagatatgttagtgtactttaatagattttatgtgattcattcacagctatgattttattgtgaaactgatttcttcataaactgggttcctatgcagtttttcccaggaaaatgaaaatggatgatcaaaatgataaatactataaattagtgacagccttctgggtaatcaaaagattattttaaacgtgtagaaaatgctaaaatgggtcttttcatctctcaatttcaagtgaggcaacaatatgatagacattagacaccaaagtgggtgtgaaacagattgtcatatgcagactttacaaaaggaatgctcaaagaacagtttcataactttgaaactcttgagtgcttaatttactttgagaatataaaagtgtaaagaaagaggagacacgcggggacattatcagctgattttctggggagagaattatggctgtctgtgagtttccacctctcttccctacaggaaaagaggggtgtggaggggctgtcttctaatgtcaggttgcaggagagggaatttcacgaggtcatttggcaagttttctgtatactcccttgcagggaactgcagttggaggggtcagggactggtgcctgggaaagctaaggaggccagtggcagctagaaggaggtggtcactttgtctcagcatttgtcagtaggcggtaaacacaaatgtttcctgtggaccagatgtagagagagatgagtccaaactgttttaagtctgtgataggcagctttcaaaaatggcctaccatgattcctgtcttctgttattcatgcccttgtgcaatctcctcccttggagtgtacgctggacctagtggcttctttctaatcaagagaatatgataaaagtgatgggatgtctctttcatggttaggttacaaaagactgtgatttctgtcttgctgggcactctattcccttctcagcttgcatgctttggtgaagcaagctgccatgttggagaggactacctggcaaagaactgagggtgacctccagccaaaagccaggaggagctaaggccctctgtccagaagtctgtgaggagctgaatcctgatatcaactatgtgagtgaactgggaagcagctccttttcagttcagccttgtgatgactgtggccccagctttgtaagagaccctgaagcggaggacgtatctaagccaggcctagattcttggcctatagaaactgtgagataataagtgtggattgttttatttaattaattaatttatttgtttattgagacatggtcttgccctgtcactcaaactggagtgcagtggcacaatcatggctcactatagccttgatctcccaggctcaagtgatcctcccacctcagcctactgagtagctgggactataggcatgtaccaccatacccagctaattttaatttttttaaaatatagtactagaaatgagaccctgatctgttgcccaggctggtctcaaactcccagcctcaagagatcctcctgccttggccttccaaagtgttgggattacagggatgagccactgggcctggctgattgttttaagccttaagtattaatagtatggtaatttgttatccagccatagctaacgaatacaaattcctatccaaaaggacaccctggggaatgaggaagctttaacggtaagagtctgtgtagagtggacaactcaataaccagtacagagtgggaaacagcagcgagggggacagaacatgtcactcatgtcaaggaagcccagcagaggagcctctgatgagctcttagaggcacccatgagagaaatgatggattgtaacatgtatcaggcccaaaaagagcaaagccataagcaaagaagacttcccttggccctctttcccttccttcatccctcataccactctcagaggggctgaggctctggtcagcaaagaagaaacaaagaggaagtgagtaggtggcaaccacacccctgggcccttctacaagtggtctgcttaaagcagctcccagatgaggaaggaaagaagattttgctctaacttcagtttagatattaatatttggggctagccaatttctgcttgtgaattgagcttgccttttgtgacttaaaatgaccagaaaagccagcgctttctttcaggtactgaggaaaatcatccccactgaggatatatttaaagttgtgttttgatatatcaccaactgtgttgtttgacatgctggttacaaatatattttaagtctttgaaaattggtagattagttattctgtctatagcaatgttcctaactatgtcattccattttccaataattttaggcaataatttactatattattctttattttgtttctgtaccaggaacataccagaattctttaaagttcaggatacaatctcttgggatttttaacataatgtttacaaattaaaatctggatgaatgtgtgcacagaggttgtttaaagcagtgaaacttctctgtatgatgctataatgatggatacaagtaattataaatttttcaaaacccacaaactgtacaataccaagagtgaaccccagtgaaaattatgggctttgggtgataattgatgcaggtctatcagttgtaataaatgtaccactctggtgtagggttttgataggctgtgcatgtgtgggggcagggagtatatgtggactgtctgtgctttctgctcagttttgctgtaaacctaaaactgctctaaaaaataaagccatagctgagcatagtggctccagcctgtaataccagcactttgggaggctgacatgggtgggtcgcttgagcctaggagttccagaccagcttcagcaacatggtgaatccctgtctctacaaaaaattaaaaaaaattagccaggcatggtggcttgtgcctgtagtcccagctactcaggaggctgaggtgggaggatctcttgagtctgggagtttgaggctgcagtgagccacgatcacaccactgtactccagcctgggtgatagagcgaaaccttgtctcaaaacaaaattaaaatataaaataaaataaaaccataaaaataaattaagatcgctcccttcttggctgtatatgggatgttattaaatatgtaataaatttgtaatatccttagagaacaaagagaaagaagcttatcttactattgagtttatttggattcagcaatgaaagtaaagagaattgaaatctctgagggggagtacttaggaaaaagtaaacagaacataactagcctgacaaaatagaggagaaaagagaaaacatttacacagttacagatggcatcttttaattaggtgaagtggtaagccagcccaatgcattctctgtcctcctctgctctgtgccccaagagactggcctcactggactctattgccaagatcccttgcactttggtttgcagttggatttggctagtggaggaaggtcacatggccacttgttgtcacacccccttgccctggcactgtcttaagagcagccatgttcctctatggtcacagagtctggagggctttcttcttctatggtggctgctcttaccaagctctgataatattatttcctgtcccctgcctctttaggcctagtgatagtagtggcttcttgccgctggtagtttttgggttcctcaacacccgccgtggttcccttaatcctggccacacctctgtgaaggatcccaccactaaaaatgtccttcaaaatcccagctgaatgtgctgtttctttcctgccaggatcctcattgacacacgaaggagccaattacgttactgaaagatccagaaactgcaatgaaataacctaatctggttaatagttttattatgtagaaagtatttgctttctacatctatccacgtcttagaattatacgacctgcttacttttgctttttgtattatttgacagcaagtgctcctgtaaccttctttcaagaccttttgattagaggagattattttcagttttttgccagagtggactctgaaccattctttccttattggactcttgtcgagctgacacttgctgtacacattccacaaaggccttgaacctggcctctgacctcctgagatccttggcagtggctacttttgttccacctgcacctaaccatgccatgtcggggggattttatgctttgaagtctggattcagcaactctaagctggctgtaggaaattaattatatggaaataaagttgaaaccacaaaatcacctgctaaccaaaatttgctaaaatgaaatttccttaaaacaccagtgttaattcattcctcagatgcatgccaggtgtgacaaatgaatcctctatgctgtggaggttgacagattcagactttatggaaagaggaactatagccaatcccaaacctgggtcctttccagaaaagaaagctgtgccttctggcacaagaccaaattacccaacctgggatctgtttgtaggattttgtcttattaatttttatggcattttgcctaaaacaaagggcacacacaaaaaatctgtatttggttgatgtttcagatgaatggaagtttaaattaatagattaaaatccatccttagaattctaacaccgtcaagatgtggctggttaataggtaatttaatgtagctaaaagaataaaacttgtttaaaaacaggaggctctattttccaaaacaaattttggtggtcactagtgttagttacgaattttatctctcttcttcaggattgcatttcctgcctctttgagattaggcatggccacatggcttgctttggccaatgaaacgtgagagaaagtgtcaggtgtcagtcctgggtgaaaactttatgcatgagtgtgctatgagtcacactttctttctttctttctgatgttatatccagaaaggcttgtgatagtggctactgcattggcctgaatccctgagtaagggccagggaagtagagtccctgtcaacccgaggtgatcatgtagcatgaatgagcaatatagctttgttgtttgaggccagtgaaattctgggattatttttcccccatgtaactgagcccatgcaggagtgacaagttcctgataacctcatgctaaaacacaaaaagaatagtctcacaaaaatactacatgaggaatacagtagtcccccctcatctctgggggatacattccaagaccccctgtgaatgcttgaaacatggatagtacccaaccctgtatatgctatgtttttttcctatacatacctacctatgataaagtttaatttataaattaggcacagagatgaaaaactaataaaatacaacaattataacagtatgctaccataatcactcttgtgctttggggccattattgagtaaaataagggttcctcaagacaagcactgcagtacagtgacagttgatctgataatctagatggctacaaagtgactaatgggtggggaggcagacagcacggatcccctgaacaaagggatgattcacatccttggtgggacggagcaggaaggctggagatttcatcaagctactcacagcagcatgccatttaaaattcatgaattatttatttctggaattttccgtttaatatttttggaccacaattgacctcaggtaactgaaactatgggtaagggggcctactatattatatttgggagttgcatttctgatcaaggactaagcagcaaataaacctaacaatcatacatatgacctgtaggtgttatagagaaacaattttactttagagtagatatatttataaaatagaaattcaacagctataaaatttcattataatttaaaagtcttttttatttttttgagacagagtctcactttgtaacccaggctggagtgcagtggtacgatctcagctcactgcaacctccacctcccgggttcaagtgattctcctgcctcagcctcctgagtacctgggattacaggcatgcgccatcacaaccagctaacttttgtatttttagtagagatggggtttcactatgttggccgggctgttctcgaactgctgacctcaagtgatccagccacctcggcctcccaaagtgctgggattacaggtatgagccaccatgtcaggacataatttaaaatagtcttatgcaatgcacactgattctgtaagaaaccccaactatgctgtgtcattagttttaccttccataaataatagaattttagaaacttgattttgttgttgttgtttctttttgttgtttgccttcctttcctgagctttgaggagctctggtggagagcagggaatggaggtggcaggaggggaaatgagttgatgccttttttatcttatgacaaatattcctgctaggttctaaaatcattcaaactactctcaaaattgcatttgtctgtttcaagaagtcatggcatccaaatagttgaagacctctttgagtattttcattctgcacacttgtagggcggggattcttgagttggatttgtctggtccactttcttagcaggtttgttttcctctttcttcttcccattaaacaacagtgggttacatttaaggtaaagaaattggatcacagagtgtccgagggctgtgggaaggagggagatagtggcctttgcacgtctgctttgaggataattttgtgtatttttcgaaaaaccgttccgtttattttttagcactaggtggtaaagacttagttcccacaagcctccctgagttggttcctagttctggcagcagtggcctctcaggaagttactagaaacttcaaaacagccaaaagagagtcctgagtgttcttcagtgaagtactaggtttaattttccatgggttgcctattttaaaactatgcagacaagattaacttgtggattttttccaaaagaagctgcaaaaaatttctgtctcatggaagaatcatccctgaaaagtttcttgcctggtaagacatggaccagttattttttttaaatagatacccagattctcaaaatttttttaaaaaatgagtcctaacatcttactgtttaccttattaattagtaagttaaataaaatatatgagtattctttttatatttgtctgagagtcatgattgcagcaaaggcaggcagggaaactgcattgtccatcttcatgctggaccatggcagaaatttaaagccaacaaagccaaattaaaagctgaatttaaagccaacattgatatataattcacataccataaactttacctgtcttcagtcttttaggactggaagtagttttcaaatgatcgaaaaacattctaggaagagaaaaactaagctattcgagggcagttttgctcagtgtctcaggacggtaacatcacccctaggtttctgatggtcgttggattaaggaaggtgtttgtgaatctttgtttcccataaatgtcatcagggctctgcttcacacaggggttgtatccaaccagagcattctgttttatttggtctgagtttgctgatgttctgtgacaaccagctccggatgttttataaacaattaacctgacagtttgatggatgagggtaacatttgggtatcatctgcactacaatgaaagacagatgattatttttgacagaaacgatcaccactcacaatgtggaaatggtgaagccagatccccgaggctcacactgtctatagaattagggccagatcaaaacccacttgagagtaggcccaatagcctgggtgacggacccgatttgggcattggatgtgagctgcaaaggcacacaatgtgttttagaaaagcctatgtttgcagttccaaatgtgagtgaaacaaagagaaagaaaggcaagtccagctctggcaacactaaaatcaacaggccagcattggccctgggattcattttaattcacaacgtagtttttaatgttctttaagttttgtgtcctattttatttcttaatcaatttttaaaaattggcatataattcacataccataaacttcatctgttaaaatgtacaattcagtggtttttagtattttcgtagatatgtgcaaccatcactctctttccagaatatcctttccatcaccccaaaaggaaagcctgtactcattaacagtcattttcccccaaaccctggcaacatgaatctactttctatctctatgggtttgcctattctggagtttcatgtaaatggaattatctaatattggtattttgtgtttggcttaattgacatagaataatgtttttgaggttcatccatgttgtcacgtgtatcaatattttattcctttttatggccaaataatattccatcatatggatagaccctattttgtttatccattcatcagctgatggacattgggcttgtttctactttttggctcttatgagtaatgctgctacaattattcatgca

SEQ ID NO: 2469 - DNA, 1807 bp, Homo sapiens
ccctcggctgcggggtagcgggcagccctgcgctgccggccgcctagcctgcaccccccgccctgggagggaagcctcgctccagccgcgtcgtttccgcgccgaagtggcagttgctggagtaccagggcaccaagtggaggatgtggtagacagcctctaagatgcgccccctgccaatgatctctgcctccagggaggagctagaaggcagagagaaagccactcaggacttcccatcccagaagataaaggtgaggaaagcagcagcagcagccacaggccagtattccagagcagctttgggttcctgtcaagacctgctttgagaaggaggtggctgtggggctggagggctgggcctgttcctgagctggctgctggcagcacagcaatgaggcaacattgagaactgcgacacgaggcccagtcctgctactaaaccaactgtgtggacttgcatagtcacttcacccctcgggcctccatttctccactttggaaagcagtgttgggacgatgttaagggtttgcaaccttccaacatgaagacttatttttaaaagcaaaacatttcaaagagtccacatgacagtagtgttcattttggcatctgttgatttaacaaatacaaaattaggctgggtgtagttgctaacgcctgtaattccagcactttgggagaccgaggcaggaggatcacctgaaatcaggagttcgagaccagcctggccaacatggtggaactccatcactaccaaaaatacaaaaattagctgggcttggtggcacgtgcctgtaatcccagctactcgggaggctgaggcaggagaatcatttgaacccgggaggcagaggttgcagtgacctgagattgcaccactgtactccagcctgggcaacagggcaagactccattaaaaaaaaaaatacaaaattaggcatggtggtgttcgtctgtagtcccatctatttgagaggttaaggcgggaggatcacttgagctcaggagtttgagtttgcagtgagctgtggtctgcctgtgaatagctgctgcagtacagcttgggcaacatagtgagattccatctctagtctttaaaaaaaggaaaaatacggccgggcgcggtggctcacacttgtaatcctagcactttgggaggtcgaggagagaggatcacctgaggtcaggagttcgagaccagcttggccaacatggcgaaacccatctctactaaaaatacaaaaattagctgggtgtggtggcgcacgcctgtaatcctagctactcaggaggctgaggcaggagaattgcttgaaccaggagggagaggttgcagtgagccaagatcgtaccactgcgctccagcttgggcaacatagagagatcccatctctatttttttaaaaaggaaaaatacaagggataccagagcactgggccagtgcttgttataaagtccatcaatgggccaggcacggaggctcacacctgtaatcccaacactttgggaagccgaagtgggtgaatcatgaggtcaggagttcgagatcagtctggccaacatggtgaaaccctgtctctactaaaacttggtagttttttgtaaaattagctgggcgtagttgtgggcgcctgtaatcccagctacttgggaggctgaggcaggagaatcctttgaaccccggaggcagaggtttcagtgagccgagatcacgccactgcactccagcctgagtgaagagcgaaactccgtttcaaaaaaataaaataaaataaaaaataaaaaaataaagtccatcaatg

SEQ ID NO: 2470 - DNA, 10934 bp, Homo sapiens
caaccaataaatcatatttattctagcatagctctaataatccaggtgtgagtccattgtatattggatttgaaatacataagacttgaagttgtcctgtgctttatcaagttcgtatcttgaattcatttaaaataaaaatccttgtagagtgcttcaatctccatggagaaagaagacctatattaaatattagattaatgcatgttgttatatagatgcactgtcaacaactttgggaaaacagtgaacattcaaggatggctagaaatgaactgcatttactaagctaatattttcctttgaagaaacattttggtcaatatttgatgccctgtagatttgagcaagaaagataaaggcatttaggtttgtgattgctcttggcaagaaagctagtgtctgtaagaaattaattacaaccaaaaaaaaaaaaaagaaagaaaaaaccaaaaccttaatgggtggagctcataggtgaatgaggacctctgcaaattgacatggatttcaggtttaactttcttgtaatggaaataaaatacaactgaacatgctctcattttttaactctgtacaaaatacctactcaaggcatctttgtattttggttccaggttctcatcagagaattaccgaaagtcaactctgagcagttaccaatggatagttttaagcaaatcatatatcagagaaataatgtaataggcattttaattagccattctcctggattccctaaacttagtccctgcattaagaaagatcattaggaaataatattcctgaacccatttcatttccctgaagaaatatcttccctgagtaatgccttaaagttttcttctgcaacttttataaacaacagatatataaaactccactttgaacaaaatggatgtgccctgtgcaaaatcccaattgaaaacttcacaggatctgttaccctatatctcttaaagagtcgcatagttgatgcctctttgaattcgtaccactgaagtatgtcactgcagatgagcttgtatgatttctattagtaggcagcatgaagtcatcatgtcttccattttgcccaacgtaccagaacacccagaattaaaacagtatattaattaatgaaattaatatgcctgtaaacaaaaagtaacatggtatttgtctcattgcttttttttttttttcttttttttttttttttgagacagagtctcactctgtcagccagactggagtgcagtggcacgatctcggctcactgcaacctcctgcctcaacctcccgagtaactgggattacaggtgtgtgccaccatgcccggctaatttttgtatttttagtagagatggggtttcaccatgttggccaggctggtctcaaactcctgacctcaagtaatccacctgcctcagtctctcaaagtgctgggatttttacaggcatgagccaccgcacccagctcattgctacttttattaatttcttttaaaattatgtttactttttaaagcaaacttaaacaaagcagctcaatctccctgcaaaaggctagggtacctttcagcagcagccccctggtggttgttataatgctgtgcccatctttcctgaaagaagtctagagatgaaattacatcaaggaaacaaatctgagtatcatcacagtctggtactcttaatcatacccttggtccttttcaccgtgtccagtggcaggtaccttctagctggaatagtgatctgttcttatcacatcacgggatctgttaccccatacctcttacataaagaaacacaatggatgcctctttgaatggagagagccatttcatcactataaatacttgctttgggctaggcagtaatttggctaactggaagatatagtaaaagcaaaattttgtataccttcacccctaggacatctaagctatataaataaaatcttaagaattttttcgggtgtactatagtttctcaatgtaatgtgaaaattattttaaaattatctgaggatgtacatatatatatataatgtgtgcatgtgtgtacataaaatatatgagttacatatatatatataatgtgcgtatgtgtgtacataaaatatatgagaaaatgaagaaataaaaatttagaaaacctagattgtgccaaagggcacagtagatgttaaaagaaatgaatctaacgttaatgaaatggaatttgattttgaataaaaatggtagaggttggcacaatcatgatggggtattatacaaaagactctatagttaaggcctcacttaaatcctttacttaatagtaggtttccagttttataattactgtttaaggctgtccattcccttagcacatcactcccctgacatcagatcagtgtccttgaaaatctatgatcatgttttcccaacaactttacttgtagttcattttgttccattctctgagcattcttagcttatactttaattttatcttcattttatctctcttggacatgagccagtgtgttatgccatgacttcaagggatggcaaacaaatactgactaattgaggcagccacacagctccaactctagctcaggtgtgtctacaatcacacacacacacacacacacacacacacacacacccctcctcctgtaagaacataatgattctctcagcactatctcttctaatgtatccactgcagctttaaattcattttctttagggaagctttatccaattttgcaactcttacccacatagtctcctcactacccctatactcacatatcttccccagtcattatcactatggcttatggtcaaccaccctcttgaatctagcattatccttacattctagtgaaaactattctcagtgatctataggaaattgcctttaaagcctttccggttatcttccaccctctgttttcaatcacaattaactacatgcaatcccctgactactccagactctgggtgttattacctttcctagaaacactcctatccttacagctccatcccctatagctcttagtattcattattttctctgaagactcaaagcagagctcaagtgtatctcatggcaaattttacataactctctgatatctcacaatatcttgtaactactttttagtgtatagccaccccaaacctctaccctccatgtggctggaaagaattctatgatggcatagtgccagccataaataggtgctcaatatatgtttgtagaatgaatgattgatcttcatacaatttctcacatatcaaaatttccaaatcaagttattaacacttgttagagttatagagatattactagtttggaaagaagtaaaattggcactaagatgtaatgaaatcataatggggaagccttgtttagattactttttagcaaattttccttgattcagttcgttccaaaagacccactaatgtgacaattgtggtatttatgtgttcattaaataaattatttattgagcacctggaatattcctgacactgagattatatcagaagtaaaatgggaagacaagtatagttactgcccacataaaagttagagaggaaggtgaaaattcatacaattgcctgaaattagaattaaagtgataaaacaggactgggaaacacaatcatggtcccacacatactttgcttctaaaaaggaaacaaacctgttgttctgcaaaagcaagataatggaaacaaaaatatctttttattttctccctcctgtcccactcagaaaaaggatatgaaccaactaaaacattgcacatgaattctatcactggatagattctgctttttgaggcaagcagggtgatatttccttcccccttcccccaggacatcataccagtctctatatccacaaagagactgcagtgctcagaaaacaactggccagaaaatagaaacagttcttaagtacatgcataaaaagagaccttggagtagaatattctgagcattattcttttacatttattgcactgattcaagttgttacagaagaaaactaaaatggggtatcttgagcagagagtgccatatgattgaacctcaatagggttgtattaggtaaaagcctctcaaactccggaaactgaaatagaaactgtgtggtataaatttctctcttgccatgcctgtcagaagattgaacaaacagaacaaattctcaagtgagtggtaaatgagatcaaaggcaatccatatactctatttgtttacaaacaacagctgaagatctatttttttcaacgaagagtaaacaagctagttaaagagagcctatgaagaaaagctgtaggacacactagagcaagataatgaagactcagaaaaaggtataggtcgaacactaatttatcatgaaaatcagaggatcagcccagaaaataatatgacctctatgacacagaaaacccaaacaaaaatcacaggttaagagacaattacaacatgtgagagtgagtgttttgaagatttcaaagggaaccaacacaataggaaagaaaaaagagggagaacacaaacaaaacaagcaatgagtaaaggtcaaaaataaatatataaagtattttttttcttaattggaaaggaaaaatctgcataactctgtactaataaatgtaaaattttaaataaaatgtattatatttggagaaatataaatggcctagatttgctcataaggaaatagaatggctattactattaaaaaataacgatcctggcaaggtttcagagaaaaggaatgcttatacaatgcaggtaggaatgtaaattagttcagccattgtggaaagcagtgtgacaatttctcaaagaacttaaaacagaattaccatttgacccagcaatcccattattgggtaaatacccaaaggaatattaattgttctaccataaagacacatgcatgcatatgttcattgaagcactatccgcaatagtaaagacatggaatcagcctaaatgcccatcaacagtaaactggattaagtaaatgtgatgtatatacaccatgaattactacacagccataaaaaggaacaagatcatgtcctttgcagcaacatggatggagctggaggccattatcctaagtgaacgaacactaacaccacatattgtgagtgggagctaaacaatgaatatacatgaacacaaagaaaagaacaagacacactggagtctacttaagggtggaggatgagaggaaggagaggatcaaaacactacctattggatactatgcttattacctgggtgacaaaataatctgtacaccaaacccccgtgacataccatttacttatgtaacaaagctgtatatgtacccctgaacctaaaataaaaagttaaaaataaaaagttaaaaaaaaaaagaaaaagaaataacctgaaagtgccaagaatgacgttttctcttcttttgtgtaaggtcctcttctataaccaaatgggagctgagatagatgtgaatttaggggagggaaagaacccctctctgttctcagtccagcaaaccaggattctctgaggaaattccacaccaagccctgacggcaatgaagttttgcagtcttgtctttggttcatttcctccttgaacaccttgggaagaagagagctatggtttgaagaaggattttgttcctctgagactccttgaataatactacctaatagccaaccttgctaagatttgatacagttcaaatgtggccttactaatgaagaaattatcagaaaagtaactcaaaagggggttcactgctattttctgaggagagtgatggctcatgtggaagagaaagttaaatgccctccaaaattgccagaatacagagacgactttgggaagtggctccacagacatagatgacattctccaccctcccaaacaggtaggtgggcacatacaactagtccttattagactattaaatcagtgagaaataacttctcacgttaagctactaaatcgtggtggttttcattgttgtagcagctactctgagcccaatatagaccataaaataccactttgcctaccagttattgtgtttttttttccccatggaactccgtacacacacatttttttgtttctggatacaatgaagtggtaaaattaatagtttgtcactcaggagttccaatactgcttttgaagtattgtgttatgcaacaggatttgcaacatttggctgaatgcattatcaaagtgactctgctgactttcctgctggtgacagttttgaagtgcttgctcaaatctttagaaaagcatcatttttctctttgatcaatcataggtagatatatcccttcacattcctctcttcctctcatttattctccttttgccacccacacttactctgatgcccttgatacttatagagattcctaaccaaatagctcaatttttaactgcattttttacaatgaacaaatcagcatttttccatatctgatgaattattggcaattgaagaagtgggtattattttgcatttaatgtataattgttgcattctagctgtcactggtattacctattggaaactattaccatggtgttgatcatttaagagacaggtaggctgcctttggaaactggactaactctttttatgttataaagatgtataaatcaaatttcctttgtatgtatttagcacaagttcagatttatgcctttaataagacacagcagtgatccggttgcatatctgaaactaacagtctgcagaattttccctatgggttccatttgcctgcaagccatgagtaggaggctgcatggtcccaaacagagtaaaaacattttccagaatcctgctgggtaagtcaacagtggaatggacctctaataaggaagtgggtagttagaaactctgtaatcacttagtgatcatttctatctgcaaacatttgttgttggctaagtgccatcacatttcaagaaatgataatttctttactatttcaatggattcttgattcccccatattcttggatctaaggtctcaaacttctcaaacagattatgagatcctttgtgatctagccaaaatgtgcttttctaggtctatctctcatactgccatactttctcacaatgactccactcttacacacacacatgcacataccttctttgctccaagaatatgagctgttggttctgtatacattcttgtgcacatttactctagttcccaagttggctaacaatttctctagaaagactttcttcacggtttaatccttgaaaagaagactgacacaaagatcactctgccagaggacttttagaaataactttgaggatcagtatccgtagatggaaaaagaagaaatcagattgagcaatgagagaaggccagctgtgatgaaattcgaacagaaatctcagatgattctatgaagagttttgaagctgacccttcagcattgccccaagctgggggaaaagggtcaggaatttatatttgatgtcaatcaggcactggacacaaagtgctgaaggaagaaatgtaaccttgagtgagtcagctgtcatcatccaagggagtacctgaagggaaactagagctgtaggcaatctgccaggaggactctcagcagctgaaggaattaagtcattttttctagaagggaaatctagaaagcacatcacagaatccactacagtccacccttggctccactcagatctgcctttttttataaactgaaaatattttagatcaaaatgtataggatgcaactaaaacattatgctgaggaaatacatagctctaaaaagtgatcaaaaaatctatcacaagtagttagaagataaatgatttcaaagaatgatgggcccccaaatgggcaaaagctgtcagaatcacatttgtcagaactttggaaagattttttttaatcaaaggttcataataatcaaggaaatgtacaattataaaatataagggcacttacacacagtagaagaattttgtgtcattttaacttacccttgcccaactccaactcactgacttatttgaagacagcatccgatgtttctgatgtgtctttggtatcaaagggagaaaaattaaccttgttctaaagaaattgtgtttgtgtgttttgacctgtgtgggaattctctgaaggaatgacataaggtcttgcctctgtttcacctaattcagaactttctcagaacggaactggatatgctgaggtcattttctgaaaacattgaaaagcaaatgagcagctactgctacctatgacaaaatatagttgttgaaacacacacaagagacatgccaaaatcctgggagaaaaaagctgaggaaaatgtgttaacaaaatagaaaataaatacaaaattgagagtgtggtcaggagaaagagatccagttttagtcatgaaacaacagaaattattacagatccaagagcaaaaattttgaaatttgtagagacatattctgaaaacatttcatcagaatagacacagtgaaaaataaaaaaaactaaaattaaaacctgaatatggtttaatattaaattaatcaagtcggtaatgtaaaacttcctaccaaaaaactccagatctagattgtttcaccactgagttctgccagacatttaagaaaaaataattttaattgcatacaaactcttccagagaattgaacaagtatttcagttttcaactaattcaactggttttgagaattaacactgcctggatagcaaatgccaacaatggcagtaaaagaaaagaaaattataagcctatctcattcacaaacataggtgtaaaaaattccaaacaaaattttatcatcttagaagcagcaatatatgaaaataatactatatcatgaccaagttggatttatatgtctatcataaatttggtttaacatttgaaaatcaataatttaagtatgttaaatatccagaagacatataaattacaacttctaaactagcaaaagcaaataaataatagaaagtggggacaaaatatttataaaactttgataaatccaagaaggcagaaaagggtgggggaagggaaaagcatttaagtggagaaaatgaaaacacaacatgaaattgtagaaataactccaaatacaccagtaaccattgtacatataaatgcactaacttgtcaagtttgtcagattagaaaacactgataaatcaagaaatagtagtagaagcacattatttaaagccgtgaaagtaataataagaactgaaaatagaagatattaaagtctttgcctctgaggagctatactaggaataagaagcaattgttaggagtttccctccaacttccttccaatttgaagtttgttactaaatgttaattataaaactcactcttaaccattcaagaattccactcatttacaagtgctcttttttctgtaaaacaattaaagtgcttattatttctctctaagcattatacgtttctagtttgttagccctaaaatgaatgataaactgaatcccaacttttaaattcttctttacaacaggtcactggccattacctagcagctctatatgggggtaacagattcaaagttccaaatcatggtcttattaaaaaccactaatcttccctttttgaatctgacaataatgttctcaagtttctttatttgccacatggacttttatacagaagattataatttctgccagcagaacacagccccttcattttgccaaaggaagattaaaactgatgattttaattgtttcaaatatattctgtggagaggtttcctggccacaactagatccagcaaagccacaatggaactatacccattttaattgtatttactatgccccaaaagctgaaaagctaatgcttttttttcagtatactgaattactgaaccatcacaaactctttcacataataaacaacttgtttgctctgggaatagtattttgtgaaacgatacagaaaacaattttagaactggaaaggaacttaagaacattcattttgtccaaatcattttccagatacggaaaatgaggcccagaaaatttaaaattcctttcttaaacttacagagagctaatggcaaagtcaggctagacctgagtctcctcactgccgcttcctctgtgtctacacaattagagaactggtaccaaggaagtttgagaagatgaaaatctggtaaaaaaagagaaacttcaatcataggaatcatgccccatcttatatcaagaatgtatctattgaacaacaattacagcaaaagggaagggcaggtcaatacacttgtgggcaggtcgtggtcatctcagtaggtcttggtcatgtggtccagatcacatggctgttatgttaatttagatcagagcatttatggtcaacatcacctagtgtacatgaatgataattgggctttctcaaatactcaagaaaaagccataattaaactgttttaaataataattttgtctcaaaggaataacttattaatgtaggcataggctgaatctaagatttaattactaaaagctatgtgatattttcagtgatgaagacctgtctaaaagtcttgagagaccatacgatcaccatgaagcagtttgctactgagtgcagcaatattttgttacaaatacaaaaaattgtgttaaaaacataaaatttcagccccacctagacctaactgcaagtagagccaaggatccgtgttctaataagctctccaagtgcttcccacacatgttcaatcgagaggttttcaaccatttttgcacaccaggatcacattttaaaacgctaatgcctgagtcccatcccatattcatatttattggactggagtgtagcc

SEQ ID NO: 2471 - DNA, 1309 bp, Homo sapiens
gctcttccaccctccatcccttcctctaggaagcccagtggtggccatgggagggcgtgaagttgttctcagacccacagggatggctgggggttgggggagggactcttagaccctgcctggcatccacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccatga

SEQ ID NO: 2472 - DNA, 68461 bp, Homo sapiens
gggcaaggcttggacaagtgatcattagtcatgctgtcagagaaccatttctttctcctgcaataggcagcatggagaacagcttcttttcatccacctagtcccattccatctccttagtgaacatctgctgtagggacctgcagtctctgtttatggcaaggactttctgaatattgaatcatctttcacattctacagaagtcacagaagccaacacacaactccagagttaaacatattaaacccctgtcatcagagagaactttcaaaaaatcttgagatgggacccattggctcagactgagtcagatgtctacccttggaccaatcaactgtggtctctgtgaatgtaggctactattattgccctatttgagttttcttcccactcatgagccaatcaactctagacagaaaagggaatgatctgaagcttggaagttctcacaggaaccctataaatgaagaagaggacaggacatgttttaagacaaagaaaaacgctatgcaaccaaaatacatctactacaataacagtgattattaaaaagtcatttaatttctctaagcctcaattttctcttctctaaaagtgtatgaattgtctattgctatggatatgtatcaaataagatactttaaaagttttaaatgacaaacttctatacagttctaaaaggttgctctgattattacactggtgtcaccaaagtggtttctagattctatttctgcagagctttcatttgtaaaattggaatgattttctctactttttatggttatggactaattaaagagaaatatctaccatttatttattgatggtttaatatatattatggtaggaggtttgcacatatttccttttttaattttcaccacagtcctataaactagatagtcttaccaagcatactgtaatgtaaacaggttaagatgattaagttcctaacatgaattagtgtcagagagaggatttaaatcaggtctgagtgattccgtgattccaaaggcaaggtggggattttaaagagccatacaataacactcttatgtgttataattttattgttcatttttataattcaattataattggtttatttctgagctagtttccttaaaatttttaatattttgccattacatttttaatgacctagtgattatattaaaaatcctatcttttatgaagatataatgatgccatactgtggatttgccaagtgatgctctactacttgttgggagaaattaaaattttaattctgaatgagaagcttgatatttgtaaacaattgcaagaagagagggataaataatcacaacttgttcagaaacagtatgtcagcatccagggaggtttctggaagaattattaacagcaggttatcatctttggtcttaacagtggaaagtacaattaaggagtagttgttagaatttctgggttctgatccacctggacagaatacacattttcttttgtaatttatattagaaataagatacctggcccatctgagcatgtatgattagtttggtggaattgtgttctaatcagaaacattagagtattctgaccatttttgtaagaaaaagagtctcaattgcatggcaaaaaccccccaaaaaatggtattctacttttatgttcttaatttaatgacatgttagatactccagattccattcaaagagatgagtgggctagcttttgtgatatttctcattactgagatatcatataaccctttcaggtatttctgaaaacacatgagacagaatcctctcttcatgaagtaatatgtggaagtcctcttcattatatcaatgctgttagtgtttacctcttgactttcagaaagtttctgtgcaatgcctttcttttttggcttcactttaggtctctcttccattaatcttgcacatatacttaatgattctctttcaaagagtgtttcctttaaggattaagctcctttgggaattaatccaaacttgtaggtttacatagcagtctaaaatcatgaatttttgtatctgggacaacaactccatccacaacacattatctcatcatttactcagagagtattcagatttctttggacctgactccttgaaagtgagctgtccttcttatgtatccaaaaagtctcaggtgtattatagctttgctatttgaaaataatatcaaagacagcatcttacgatgttcaaaggcaatgttacattatttgtttttcagatgataggactgaaattttgaaggctgaaatggcttgctatggaatacaatgtcatgtggcagattgggaaggaacactcagggcttctggctcctagtccagagtaatttttgtgctctctttacatgtcaccttcatctgcactgtatcatttggttcataaaataatatggcattcaggcagaaacagatttggtcctccactagtttacagataagaatattgagccctagagggatttttgtccaaggctatatgacgagaaatgttttgcccccaagtttaaggtatttccagtacaatttgctggctttccaacttaaaaacgttctctatggcccattaataaattctacaatctctttttattttaaacgcccttcatattttttagatttcttatatttataatattttaaaatacatgttttattgaattaataaagcaataatttccatagtggtccaccctgaactctccagggaacctgcctgctgctcttgtagtataagaacagcagcaaacagcttttttgttggaagtctacatgagttctgttgctaataaaatgaacatttcttttttaattttaatttgagttggggatacatgtgcaggtttgttacaagggtacatttcatgatgttgaagtttggacttttatagtcccatcacccagatagtcagcatagtacctaatgggaagtttttcattcctttgaccatctttaggccccctagtatctattgttcccatcaatatgtttgtgggaactgaactgaagggaacaaactgaaggtttatctctcacttataagtgacattataagtgatatttggttttctgttcctgcattaatttgcttaggataatggcctccagctgcatccatgttgctgcaaaggacatgatttcattcttttttatggctgtgtagtgttcgtggtatatatgtaccacattttctttatccagtccactgttgatgggcacctaggttgattccatttctttgttattgtgaatagtgctacaataaacatatgcatgcgtgtgtgtgtgttgttttttttttggtagaatgatttattttcctttggttatatgcccagtcatgggattgctgggtagaatggaaggtctatttttaattctttgagaaatctccaaactgatttctatagtgaagtaatttacatttcctccaacagagtataagcattcccttttctctgcagcctcaccagtatctgttgttttttgactttttaataatggtcattctgactggtgtgagatggtatctcattgtagttttgattggcatttctctgatgattagtgttgttgagcctatttttcatatgtttgttggcctttttatgtcttcttttgagaagtatctgttcatgtacttggtctactttttaatggggttactttttttcttgttgatttaagttccttgtagattctggatattagttctttgttggatgcatagcttgtgaatattttcttctattccttaggctgtctgtttactctgttggtagtttcctttgctgtgcagaagctctttagtttaattaggtcccaattttcaatttttattttcattgcaattggcttttgaggacttagtcatacattctttccctaggccagtgtctagaggggtatttcctgggttttgttttaggatttttatggtttgcggtcttacatttaagtctttaatccacctttagtcattttgtatatggtgataggtaggggttcagtttccttcttctacaaacagccagttttcacagcactgtttattgaatagaaagtcctttcctaattacttatttttgttgagtttgttgaagatcagttggttgtaggtgtgtggctttactcctgtgttctctattttattccattggtctgtgtctatttttgtaccagtatcatgctgtttcagtcactgtagccttgtagtatagttcgacatcaggtattatgcctctagctttattctttttgcatagaattactttggctatttgagctcttttttggttccatatgaattttagaatagttttttctgtgaaaaatgatgatgatttgatacaaatggcattgaatatgtagattgttttgggtaatatggacaatttggacaatgttgattcttccaatccataagcatgagtgttttttctatttgtgtcatctatgatttctttcagcagtgttttgtagttctccttgtagagctctcctaccaccctggttacatgtattttatttttttgtgtatggctattgtaaaaattgtgttcttgatttggctcttagcttgaaaatcactggtgtatagaaatgctaccaacttttgtatgttgattttgtatgctaacactttactgaagttatttatcagatccaggggctttttggtggagtctttagagttttctagatatagagtggtattgtcagcaaagagagaaaatttgacctcctcttttaactatttggatgccttttatttctttcccttacctgattgctctggctagggcttctagtactaggttgaatagcagtagtcacagtacacatctatgaaagctaacatttcttaaatgatgtacatgagacaactttttaaaatgtggaaattattttcatctaagccaaaacaaaaagtttttgtaatttttttccttgaaaactaattgatgttaatttaagaaaatcattttctgcatcttttcaaaacatttgttaatttgctaatgtacattaggaagcagttcaataattattaccaggaaactatgggtatattccaattttcccaataataaatttaaagataatagataaattaatagtacagtattttgcccctaatatttttcctaaaagttgtagactctgaggaaatcacatctctgttcactaaggttctatatgcattttctattgctgcccttatcaattacaacaaacttagtggtttaaacaacacacatatattattttatatctcgatagggagtaaattggacctgatatggtttggctctgtgtccccaaccaaaatctcatcttgaattgtaataattctcatgtgccaagggcgggaccaggtggagataaccgaatcattggtggaggttcccacatcctggtttcaatatagtaagttctcatgagatctgatggttttattaaggggcttcccccttcgtttggctctcattctttctcctgccaccatgtgaagaaggacatgtttgcttcccatgccaccatgattgtaagcttcctgaggtctccccagctatgtgaaactgtgaatcaattaaacctcttttctttataaattacccagccttgggtatgtctttattagcagcatgagaaccgacaaatacaaattcattcccttgaagttgttagactgaggcaccattctttgctggctctcagctggtggtcattctcagcttctagaggtggcctgtatttcttaacttgtgggcccttttgtcttcaaatccaacaatgtaagttgtcatccttctcctgccttctctctcctgcttttttatgtgtcatcacatctctctgaccattgctgggagaggttttctatgtttaagagctgatgtgattagattaggcctattatgataatccagcataatctccccatctcaaaattcataaccttgatcacatctgcagagcctcttttgccacaaaaaggaacattcatatattctgggaattaggatataaacattttggggtccattagtctaccataggtcctttgtaagattctgtgactcttcaattcaagtttgtgtctgcagaataactccttttgatttcagagaaataaaaaatattgggaatattgtggcttctgtgatgaaaagtcttttaattttattacaattttaaaaactttatggaaaaatgaaatctgcctcaatttatgctaagtatatatcaaacacaagcctgattttttgttaattcaatcagttattcaatgcaattaaaacaattatactcttggttgtttagtgtcaaagtgactgaaggtccattttcaaggcgtgaagcaatgccatgcaaacatagcgttgaggcaaaaaaaaaaaaaaattaaattccagattgtcccccttcttccttcttcttttcgtcctaaggaagagaggatggtattatgggataaaatggtgggatttcaaataagatacagattatttaatttggatatgtttcaaagtctcatataaggaaccaattgctcttgaaataggaaggagactttccttctggtagctcgtaagaaaggtgagctgttgcagaggaatgagagcaatggtactgtaattattgctccacacaggaccctcccgttctttttattcatttgtttatttactcaaccatattcattctgagtttatctaaaccaggaattataacaaagccagtcattctacctatagccttctttccagcttgtctttggccactctctcagaggaaaacattatgctgaattttttgtttatcttttctttgacaaaaaaatatttataggccaggtgcagtggctcacgcctgtaatctcagcattttgggaggctgaagcgggcagatcacttgagcccaggaatagaagtttacagtgagctgtgattgcatcactgctctccagcctgggcaacagagcaagcaagaccctgcctctaaaatgttttttttaaatataaattctagaactgaaaaattcaataattgaaattaattagtcaacagatgcatttattagccaattggaaaaacaaaagataggattagtgaaccggaatataggcccacagaaaatatgcagactaaagcatgggccattaactgccaggcattttcaacttgtcttacgtggtacctgaccaataaccctgaggcaaagaccagaatggggagtgccagggttgtagactgggctccaagtctgctaaatgaatttttctttatgtatgtctaattttaaaaagcaagatacaacttttttcctgacctatatttattatcaacacttttgacatcaaatttgtgggggttttctctataccaatatattctccaactctatggacaccaactttgtgtcctatgattgaattcaattctgacgctaactctcctatgttagcactgagcccacagattaaagggctcaatcctaccaagcttcacctacttcagatggcaaatgccagtcccaggttgccatctttgcttttggccaaccagttataaattggagttttctatgtcccccttctcaagttccataatttgctagcatggcttttagaactcaggaaagcactttactattactagtttattatgaaggatgtcatacaggataccaatgaatagccagattaaaagatacatagagtcaggtatggacgaggtgtgtggaacttctgtgccctctcagggtgttcccaggacctcaatgtgttcattaacctggaagctctctgaaccccattgtttagggaggtttcattacataggcatgattaattaaatcattgccctttggtgattaactcaatctctggccccactctcttccctgcaggccaggagttgaaagctctaatacttcaatcatgccttagtcttcctgttgcctagttccaatcccaaagctaactagggaccctcagtcaccagtcatctaattagcatacaagagacactcatttctttatgcagattccatgtgttttaggagctgtgtgccagggactggaaacaaagaccagatactttttataaatgtaatatgttacatttccttttaatttgatgttgtcctttaatttatgattctagtacatttatatttattgtgattatttgtatatttggagctatttctaccatttaaaacttatgttttctcctcttccttttctgtgattgagttttcatttgtttttatcctccttttctcacatcttatttgcttagaatttatacatgtaacttctcttctttagtccttagctttataattgtattgtaaacatttactccaatagagccttaaagctaaacaccatcttgatccctctcctatatgataaatgtatattaaaacattttaggttttatctttccttccctaccaatgtagtggcaagtattttggatgggatcttgtgattaaaccctgtcagtttttatctgaaaatatttttattttgtccttattctgctgcaataattaatccaagttgacagttattttctctcatcatttggaagttcttattccataatcttcaggctgtaattttagttaagaattctgctggctgggctcacacctgtataccagcattttgggaggctgaggcgggcagatcacttgaggttaggagttcgagaccagcctggcccacatggcaaaaacctgtctctactaaaaatacaaaattagccaggtgtggtggcatgtgcctgtagtccctgctacttgggaggctgaggcaagaggatcacttgaacccaggaggtggtggttgcactgagccaagatcacgccactgcactgcagcctgggcaacagagtgagactccatctcaattgaaacaaaaataattctgctgtcattttaattgatcttcttcttttaaaaatatgagctgtgctttttctctagttgcttttatgaacaagagttctttggaaaggattttggaggaaagaggctttattccagtgaatagtttgcaaactggagaaacatagcagtgtaagacaaagatacattccaaaaacaaagagagggtttgggttttatagcaaatgttcctgtctagtttctcaaccaggttcacttatgcaaaagaagaattgaactttgcttagttatgattggtcaatacagttaagccctaattggttgatatagctcagcccttggactaggacaaatgagctctgattggttggtttccaaccctcaaaccagaaatctgtcagatgcttctttcaaatgccaggtgttggaggatttctggaagcagtttatcctgacactaacaacaataactggtctgccttgattctagaaagggaggtcctatgataacttttacaacaactttctgagaacgcaaactgtgtgattgctccctcacccagccatggccacctgttttaactttgagcacctcagccacaaggaatgtattttgtctgtaagtaggggctcactttaacacgtttaagattttttttgtataattttattatgatctgtcaaatatggatgtatttttggatctgtggtttcttattttgcatctctactgggaattttacagctattattgcctttcttttgttctcttcattttctttctttttatatatttttttgatcttcaacaaaatccaaagccttctcattttgtcctctatatcctctatatcttttattttcttttatttatttttttgagaccaagtcctgctctgtcacccaggctggagtgcagtggtgcaatctcggctcattgcaacctctgcctcctggctcaagagattcttgtgcctcagcctcccaggtagctgggattataggcatgtaccaccaggcctggctaatttttatgtttttagtagagatggggtttcaccatgttggccaggctggtctcgaactcctagcctcaagtgatccatctgtcttggtctcccaaagtgctgggattataggcgtgagccactgcacttggcctctatatcttttaatgtttacttgttttgtctcattatgctacattggggataaattattttgctatgtcttcctctaatctattattcttttttttttttgagacagagtttcgctcttattacctaggttggagtgcaatggtgccgtcttggcccactgcaacctccacttcccaggttcctgcctcagcctccagcagctgggattacaggtgcctgccaccacacctggctaatttttgtatttttagtagagatggggtttcaccatattggccaggctagtctcgaactcctgacctcaggtggtctgcctgctttggcttcccaaagtgctggggttaaagccatgggccaccacgcccagcctattctattattattactatttgtttgagtcggagtctgctttgtcacctcactagagtgcagtggctcaatctcggctaactgcaatatctacctcataggttcaagcgattctcctgcctcagcttcctgagtagctggaattacaggcatttgccaccatgcctggctaatttttgtatttttagtagagacagggtttcaccacgttggccaggttggtctggaacttctgacctcagggatcctcctgccttggtctcccaaagtcaaagtgctgggattacataatctattattcttttttttggcagggggagacggagtctcactctgtcgcccaggctggagtgcaggcacgatcttggcttcactgcaagctccgcctcctgggttcatgccattctactgcctcagcctccccagtagctgggactacacgggcctgctaccacgcctagctaatttttttttttttttttttgtatttttagtagagatggagtttcactgtgttagccaggatggtcttgatctcctgacctcgtgatctgcccacctcagcctcccaaagtgctgggattataggcgtatgatctattattctttaaaaaaattcttgctatttacctaatatacttattggcctttattgagcctttaatttcaacagttataatattttatttctgtaattactatcttttcagctcaatgtgcttatttctcatgttttttactctatgcttctctttgtaacttcacttttcttttacaaatttcatgcatagctattttcttttttttttctttttttttttttttttttgagacggagtcttgctctgttgcccaggctggagcacagcagggcgatctgggctcactgcaagctccgcctcccaggtttatgccattctcctgcctcagcctccggagtagctgggactacaggtgcctgccacccacacccggcgaagttttttgtatttttagtagagacggggtttcaccttgttagccaggatggtctcgatttcctgaccttgtgatccacctgcctcagcctcccggagttctgggattacaggcgtgagccaccgcaccaggcccttatagctattttctattatgtcagtttcaaggtctgcaattccttcactttaaatctttgtttttttttttttgtctgatgattctcatacatagcagcttgattttctgtgtatttgagaatccttgtttttaaggtcatgcttgcttttaatctgtaggagacttagcctacctgaggaaagtttccttcaaggagggcttgcttctgcctttgcctgtgggtgatttatcccaggcacttcagttgctattctttcagttatggctcaggagagggctctgagacttcaatttccgtcctggtgctatctctacagcattgttccctgggggcaccgctttccaggggcacctgttgatttagtccagctcgatgccctctggctgcccactgctctgactaactgctgctttagctcagacttcccttctctatgggctgggtcccgggatgtttttcctgaagccttcagggtttcctgctttgtatccagtctgacccagactccctgtcctggaagtcctggaattagcaatattttgttggcttgtctgttttctttttggtggtggtggtgttgactccaggaaatgtttcctaccttttgtgacaccagtggttgtctccaaggaggtgcagtattttgtctggttatgaataaaatgattgctcataccttttaaatactagtgaccctggaagtaaaaacaaggtgatgacgtcttggcactgtgatatacaagtggcagtcccagaaagtagctatgtttgtatatggagagtaaaagaaccatatttaagatgttatattttgagaggcaaatgttggcattagtatctttcttgtatttgtgaccgtctaacaagaagcagcagccagagatttgtcaacattggaaaggtaaaaagtattggtagggcacagtggctcatgactgtaataccagcactttgagagactgagttgggaggatccctcaagcccaggagtttgagaccagcctgggcaacttaaggagatatcatctctataaaaaaaattaaaaattagcagggcatggtggtgtgcacctgtagtcccatctaccagggaggctgaggcaggaggatcacttcagcccaggagttcaaggctgcagtgagctatgatcatgccgctacattccagcttagctgacagagctagaccctctgtcttaaaaaaaaaaatacagtcaaatttgtgtttgctttatggaaagaaagaaaagataattccaatgctgttaagaatattctaattattaaagtattaattagctttaaatataaactattttcccttcctactagaaagcaaaaaaactgggtaatatattggccgggcgtggtggctcatgcctgtaatcccagcactttggaaggccgagacgggtgaatcacttgatgtcaggagttcgagagcagtctagccaatgtggtgaaaccctgcctctactaaaaatacaaaaattagccaggcatggtggcgcacacctgtagtcccagctactctggaggctgaggtgggagaattgcttcaacccgggagccgagatcgcgccattgcactccagcctgggtgacagagcgagactctgtctcaaaaaacaaaacaaagcaaaaaactgggtaatatatgaatgatataaatgataatctgaatatatttagatgtataattttagaggagttgatgttacattgtccaacatatgtagataatgtgtgaaaggcttctgagaattatataattttcataattcaaaatgatcatcttcatttagcccctgcaggaaactcaattaaataagggaaaatgtcttgtttaaatatggagaatttatgagtcacacagccaattcagcacaaggtttttatttccagactggtgctcttttttattgtaacctgctgcccacagggatgggtgaagaggacctttagggacaagctaaatggaagagcataagtctttttttttttttttttaatctaaaactgtagttcacttcatttaggcctctaacaaaaagtactaattagtgaagaaatgttagcaataacaaatctttcttgaattatcactgattgaaatgtcatgatgtctgttgattaaaacagtgtgtgcaaaaaaaggaaaacttacagcttcatttcttcctaatgaagtagaaattggaattcatctacaaatacgtttaattttcatggcccttgtttccatcatatgctattgaatagtcgaagaaaaaatatagggaattagatttttgtcaggaacaataattataacaggcactttatagtattcacactgtgcccagcagggctctaagtgatttatgaatttaatccatgtaatccttataacaagtccacgagttgcgattataatctctattttaaagaagaagaaacagaagcaagagatagatctacttgctctgggtcaaacaaacaattaaaatatgaacagtatgtcccaatattagtttccaaaatgaagtgttttagtaatccttatatatttaggaatgaatggcagagcaaaaatgactttagaaatctaaatggactgtttttttttcctatcagtgcattatatggcttctgaaaccatttttctcattttaaatatgaaatctcaaagagctactcaagtcaattcattattttgctgattttttcatttttctagactgcacttgttaatactcttcaatgaggcccagttttactacaacaaacattgacatatatattaggttggtgcaaaagtaattgcagtttttgccataaaagaaatgacaagaaccgtaattacttttgtaccaacctaatagaaagataagcaaagtcaaggaaactttatagaaagcaagggactctgtagagaagtgccaatggtgagatcattgtgaaatctctatattaatacaagtggggtgtttccctaaggagttatactcttatttaggaacacagtatcctgtactagtttcacatgattgtcaccttaagtgaagtgacagatgagtgatggcagttataaaacgaagactggtttcagaaaatctaaataaaaactaaacaattgtatacgacaatagaaaatgatgttgatggcaagaaatgtagagactgttggactgaataaaaatatggtcttgcttattcaaagctcttatggagataaatcagaatgtttttctaacatttggcctgaataaattgtagtacacaaaccacagagtatctaaaacaacaactaatgtttcaatcttaatttttgtatttggttcagaaatgccacttggaatgttatacataaagaatctgacattgtgtaaatggctgcataagcttaatgtaaaggaaaattgtggaagaatttatcagcttggactgaatatttcctcaattcacaaaatgaactgcaactccaatagaatgcagagtgaaaaatttcctgtctttttcctattgggtttgtaggacgattgataaacacattgctgttgtgtttgtagggatattgataaagacattgctaaggatggtatgtcacattttttcttttatgttgacccacagaagaaatgtctgacatatttccatgacatgaaaagttatgcttcttttgaatgattgccttttaaaattatttggacattatatgtctgatgagcaattttgtttctctttttgctttggacactaggaatctcaaagctgaatttgaaaagcattttatttaaccgtgtaatatcctgtggaattcaattttgtgtactaaatttatctaataggccagcctttattatcctttgtattcattcttggatttgtttttgagcctgttgcattatctatatttctgtaagaaaattcaaatcattttgaaaggacatagggtataattacctgaacaaatgttgtatttttccttatcaaaatttataagtgcaataaacagtaacaaggaatgaattatcaactatgccaaagtgacagataaaaaatcacataccattattttctgaatacggactccaaagtatgaagatcagaaatgaaaaaatcttagtgttgttattccagtaatggaaagggagaaaaaaactgataattcatgttatcatgaattgtgaattcatgataaaataacacatgctattatgcatgtgttattagaaggaattaggtcatcagagtcagaatttaaaatttttaaatggttacatatatttaggaaaaactttgacagttacctttgagatgtatgagctttgtaatctaccttgcttaatgtaaaccctacattaaattgccctacttgtttttccatgttagccaatgagaatatttaaggaatcaaatcaaatttgttgtacattcactttggctaattcaatggtcagatttttggaaccaaatcacaatagcataaataacggtggtagaattttgattaaagaccaggcagtttgcttatcccattcttttaagacctgtcctatattgtttatatttgatggggtgtaggaagttaatatgtaataacaaatgacccccaaacttagaggctttaaaccataaaagcttatttctcatttacatctacatgttcaccatgggctggttgaggctttgccatctgttgacttcgtaactggacccgggctgatggagattctgtcagggatattgcaaggctcataacagaggggacatagaatcatggtgactcatgagctgaattgtaaacttctgctgagaagtatatctcactttttgttcacttttcattgtccgaagcaagtcacatggctaaacctgttatcagcagagtggggatgtataatcctcccactgagagcaatgaatattttgaataaataatatattacgttgctgcaagcaaagggttttacctcttgtgtttttggttttgcctgattgggcctggtacaatgtttaatacctagactgtttgactctctagcatatacaattacagattgtctagttttgactctggtacaaatagatggcatttctctccccccatatcttctaggatgcctattttttgagaggataaaattaaaaataaaaacctctcagggtagcctgtttttttgcactcttttctaaactgctttataaaggacagacatatttatcctttataaagacatatgtgtatatacacacacatatacacatacatacacatgtgtgtatatatatgtgtgtgtatgtatacatatacacacacatacatatacacacacaaaatatacatgtatatatacacatttattaggttggtgcgaaagtaattgtcacttttgccattgaaagtaatggcaaaaaccgcaattacttttgcaccaatctaacaagcatgtgtgtgtgtgtgtatgtgtatgtacatatatatatatgtacatatatgaccttggaagagatctgaggtatggtagaggtttacctcttagaattgtttcgaggattaaatgagatgatttttaagcagcctttagcagtgtttgtgtggcacatggtaagtgctcaataaatattatcttattagtattatttcaagcgtaatatattttgatatctttagagctcaattgatacttgaacagtcatgaaaagaaatgatttactttaaaaaacacttgaaaaactatcctattagatgaatttatattttattataacaatgcatgtagacacacgtacatacacacaactagaaaggatatatgtgagagacatatgtatttatttagtcacaaaaagagcaaaataaatgtgccaaatcatttgaagatcatttgcaagaaatctgcaccctctaatccaccattatctttcaaaatttcatggttactttcttggcgtacatggacaaatgtttccactccttccataggacactaattctaactttggcctcccattaactgcaaaacatctcatgcaacattattctgcaggtttagctgactttattggttaacatcaagaaaatcacttaaatgttaataatttgaaatggaattgaactctcttgaactaaattttttattaaagcacacatggttttcacattgaaggaacaaaatattccataaaatatgttttaaatttaatgaactcaagactgttagcaatcatttgaatcacaatgaaatcaacatgtgtggcaaagatttgtctactctggtaagcagcaatgcatttgtgcaccaatttttactttaaattttatagaactataacaaaagagaatttcagctcagttcttgaaatcatggacaaaactttgcagaaaaataaatgagtcatatcattcaataccatacatacagctgagttgacttttatccaaactcattatatattatcattttagtattgtcccctgcattttctttgccttctcctctaagaaatattttccttatggtagaaatccaattattttttcccctgtaattgaaattttctgttttcatgaggccaaagccgagcaaataagatagaaatggagagtagtgagcaagaaatatttgcagaacagaattatatgggagctccttccttgtatgtagggggcacaggtatgaatgcatgtgctagaacaggttttcctcactgaaacaagtcttatcacagaatcactatgtgaattaatattttggaaaatgaaataattccttcccactgatttataactatagagatatttaattcttttctgatcaacctttaacattgtgaccacattttccaactttgaaattatcaatcttgaatgtgtccataagaattgggaagtacagtatagaaccttaagatccatcagtgcttttgtaaagtgaaataaactaatttaatggtagtgataactctcagttgctctcttttttaagttgatcttttaatgttttgtcatatgctatttttcttggcagtgaatgtataatgaaaaacctgtccataatatgaatgattaccctataatttatctcctttgggggtgtagacgaattgcaagttaaatatcaggaaatgcaggatggatgaacacttctctgggattgagaatcagctgagtctaaggaattttgccagaatagtatagctcatgatgttggtgggacacatggctccataaaagtcccacccatcttgtgtaaaggaggactttcaccttttcatgccctggttcccatggtgactggtatattattagtttttggcataatagtggcattgtggcatatcatgttaaattatagctagggactcagctgcaaatgtttttgcttcctgatttatgggagatagcatgattgagagaaaagaatttgtaagcagtaattagaggagcagaggtaaagaagtgcactgagatatatattttttttcagagaaatgcagttaatggagcatgtcaatgaaaaggattttccatttttaggctggctggtacgtcccctgtttaataaaataagactgaagtgtgccttttactttctatacagtctgacaaaggtaatttagaatggagcttttcgatgtctgtaggctgctgctgccaggatttatatcttcatgaacgaaacacaattgcagatgccttctcaagctgattgataggcaataaaaaactgaaacaagagctcaatctccaagaaacaagaaaaagttgtgtgtgttaaatggggcagagagatatctgctatcctcttgtgatatttgtgtctattttaatgcctatgtagatttgtgctgtggcacatgaaaccaggtatatattaccaatgtaacatgcttcatttgatttgcaacattttcagtgaactgcatatctcatagtgctcagagccaacctaaaatttctgactgattagaattgtctgcatttgtaaatcactgaggctggacctggaaagaaaagggatttggctcctctggggcccctggtatacattgtgcttaatagaagaattttgattcagatccttgtttgatgctgaaattattcttttttctccccatataaaatctcctgaaaattgaaggcaaattctataaggggcacaatatagatcattgtttattatgcaacacattccttcttccctcccttcttccattcttaaaaatagtttttgcatctttgcttatctttacttaccctacaaggatattgctatctgctgtgaagatagacaaaactgaataattttgatgcaatgcatctggacaataatagataatgtttgttatagaggattaggtctgtgtaagacatctggagagatagagtcagtaactctgttaggactggggatgagtcaaggaagacttcacctaagagcacaagcagaaagaaaatttcaggcatggagaatagatggtaactcaaatacatgaaagagtaatgtatttccagctgattagctctggtcaaggctccaaggaaggctgaataacaaagggtaatgacatcaaccttcccatactactaagctggtttaccaagttgccttgatattgtgaacattgatggacctttaggacaaaagatacggtcaggagcaaagactcaacattaaatgtcctcttgatgaaagtctcaggtgctggaatgactgtaatatgaggataggcaagatgcacattgataaagaagttccaaatatttggtgcagagagtaagaagctccccagttttggagaaagcattaccaacgaaaggatggttattagtaaaaggttattctgagacttctgtcttggattactgatgatgttgatgcaggtatagaacaagttaagtctgaagtactgatgagccaagataactgtcttatagctagaaatatgtatttcattctagggcagaagctgaaattgcagatatagatttgagaatgtccatcacagagctggtagttaaagccatggagtagtggatgagaatacccaaaattgctgtacatgaaactctacaaagccacaaaatttacttcgcggtcaagaaggaagctgagagagagttataatgattggcatttgtctgtggtcagctgagcaataatttccccctttccccttcctaactgtgcccaggtttttgtttgggtatccatacatcttcccattatgttgccgagattccttaggaatctgtctcaaacacagctctagggatgagccatggtttatacagccattcagactaaccttatatcactgccataatgattaattcaaataacccaagcctaagtaacatggcattttcaggatgggaggggcaaaagatctaattaaatttaattggacatgatgggaaatttgctggatggaggtttctggggaaagtatatcttctgaaagacagtctgttcattctgaaaggtgtgacatgttaatatgaagcttggaactgttacaacataggataaaactgacaccagagatgcagaatagaaggaaagaaaccaggtccttggacaagctgcctaatccaatcagctctgacctctgccttatctggaaatttcatttacattaacttatatgttgttattatttagaccaattttatttgagttttcctttgtttgaaatggaaagcaccctgatagctgcaaatgaacaacatgaggaatgtagttaataatattgtattgcatattgaaaatttgctacaacagtaaattttaggtgctcttacgacatacactcacacacccaaagtgacaatggaagtttctgctgtgtatgtatataaaacaccatgctgtataccttaaatatatacaattaaaaagggacatgttgaaataagacattaagaaaagtgtcaaatgccacagaaaccttaggcatgagtttggcaattgcagttctttctctgtctttgctagattagccctgtttggggagagggatggaagcagatttcagtaggtagaagagtgaacgggggaaaataaaatgaagacagcaagtttcagtagggcaagcatttttgtctttttaaaatgtatgactgaccccccagcccctggaagagtacatgagaagcagtaagcacttaccatgtactggacagtggataaatgtgcagacattaattgcacatttcccatttaagaagtgtcagaagagaatagaaatagtgtgtcaacatactgaaagaagaggataagtaaaaaataatttaaaattagaaaaaattttagtttgggatggtccttactatgtaattagaagacattcaggaaaacgtaaaagataatagaaaaagttaagaaatgtgaagaataggcctataaaatttttgagaaggtaaaagatgcaaagagaaaatctggaaagtttctaaagaggcaaaaaaatattaataagctacttacaatggaagaaaaatgagattagaattctggaagcaaagagattgtggactaactggctgcagatcagtaggaggagagggctacaagctgggaatgtggatataattcatctgctaaaggaaaagaaagatatttatggatttgtgagaattcagagaatatgtcatgtatatgccccaaatgggaaagattaaaaaaaaaaataaagctttcatcagaaggaaactccagcatgtggtggcacatgcctctggtcccagttacttgggaggctgaggtgggaggatcacttgagcctgggaagttcaggatgcagtgagtctgtcttgactgtgctgtacaatgcagcctgggtaacagagcaagaccttgtctcaaacaaaaaaaaaaaaaaaaaaaaagaaacttccacataggtgactataagtcgaaaaacaaatagcaagcaagcaataaaccttaaaatgtgtacaatgtacctaaaatatataaccaaggggatacaaaatgtttataaataaatagtagtgataagataacaaggaatgcatgttttaagtgctaaatacaaattgttgaaacagaagggacattcagagaggaaaaactgcagttactaaatgttcatcaaaacttaggaaggctcattctacagggttcatcactaaaagggagaatagagaaagaaaagtctctcagtggccttcttagggaagaaaaaaacaccaccaccaccaccaccaccgtggggaaatagcacatctcagtcaggaaaatagttgttattttggtttcatataaaaagagatagatgtaagaagttggaaaagagaaagtaaacactcgtagaatggaaaactacagaatttcatattaagtccaaggaaaagaaggaataaatagtaaaacatcaaaagcaagcaaaaaaatagtgtaagcaatattaaagaagcaacaacaaagtaaaacagtagtaagcagtaagatgtaaggaataaaacaaagtaactaaaagttatgttaaatacgacttggccaaattctcttattgaaaaattgacactgagagacttaaaaaaaaaaaaaaaaccacccagatatagtcagtaatgaaacactgaaagttatgaagaaagtttaaaaagagaagccagacaaaggcaaagaaagagacagaatggcaatattattaggtggggtagaatttaagattaaatgcatcaaatatgtatatgtgaacaaagaatgagttagatctgtcaactctcttgagaaaaaagagatttctatgtgcgaaatgatagatgtagagaaaatattgtgaaaataatttttgtaaaacaatcttccatccctaagtacgtgtaaatgtgcacgtgtatatgtaattctatgagcaaaaggaaaacgtggaagactgcagactggtgtttagtattggccacctagaagggactggggcagcttgtacaggatcaggtgcaggtgaggctggaggaagaaaaataaggtttcaataacagctgacttgtggcaaatgcattggtaaactgcccatcagctccttcctaaagacttaggatacaggccctggattcaggagacattggagaatgacatcaaagctcaggacgagtcccatagaaaaggttctagaactgactcacagctgcctgcttagccacactacttaggagaataaattcctttttattttgttgtatataagtatacaaataaaactgcaaatagcattaaaaaaattaaagtgtaaaaacagatgcttgagtccaataacaattggttgggttcccttgaggcctagaaaattttcaaaatgttctggatgcatacgtgttaaggagtgttattaagtcaattttccagaatcctggtatcatagggctaatgtaagacccaagggtcaagtgtagagagaacagcagtatgcactgaacacttgggatctgtgcttcactgacatttcccacctgcagataagttttgaacggatacacatacagattttcctgttgtttccccagccccaggtaattgctttgaacatcctgcgaaggtctggagtcacttgtatttgggtgatcgtaagtaagaaacaatatagcatataacatcttggtaatttagaattttctctatttcaaggtccagtaattatgaccatgactgacatgaatatcgaaggacagacaagctttctaaccaggacataggaaattacctgatatgaaaaagcagattaactttgtgatatatttaggtcaatttagaggtgagatggattttttttctttctacagctagagaaggcagccagccagaaagccccctgcttaacagagaatccacaaaagggatgagttcatttacagagggctggattgattataagggtgatgctggtaagcacacttataaattaagtgtgtaactttaacttctgataacaaacattttttatttacatgggtgagtgtggctttctataacaaatgtttcataaggtttgtggttattaaaagctttatggttaaaagtgacattcctttgtgattaaaccaaaaggttagttaagcagttgaatattaaggcgaggagctttgatcgtgctaataagaaacagagcgtgtagatttcaacttaaataagacaattgttccttatggctaacctctgtatcacaggccacattgctctctgtcatcctttaggctctaccagcagaagcagtggcagggtattgaagactggaggagagtgagtttttgagtatttatccccccagcttcctccctgacctactgccataggttggctgctttttgtctctggaagtcacagacttctgtccggcagcctctttgcatacaactctctttggattccagtaacctcccctttcctgtgcaccttttggcttgtgaatgttaatggccccgctatagcccttggctactgcactctgctctaagctgtacatagcaattcattactgagatctcatcaatgcctagtttgtgcctaatggttactgttaggcccctgactgatgccatgtgctataaccttctagatgttattcacaagtgcaattttaacacaggactttttaacttgtgtcaacaagatagttctcaaaacaattctcatcaaatacaattgtaccttacattttcacaatccaggccaaccaaagaattaaagtttactcatcctgatttccagagttatagcttgctttgtttgtggataatcaggggccatttaattatgatgtggacattataacctacagtgtattattactgtgaatactcccaggtttactactttatctctttagactgtggaattaacatgttgacattttctggcaatgatttgtgtttaacagaatcttgggcaggtctaagtgacaataatttattactttgtccttgttcgtgagcctgtcaggctcagtggagcttcttggagtgcataagagaatgcatgtgtatccactctaaagggaagacatatccacatctgtgcgttgtgggtgatgatgcagagtgactctgttcatctatttatttattcaattaagaatttgtgaacatagggaagcttgcatccatagatagtgaactggagattttttctagctccagacccttcaatgtagctgatgacagcaatgtgtttctcaaactgagaaaatcctgaagagcttgatggacgataagcagccactaatgggtgagttacctgacagcccaacaggcaaattgatgaagaatttttgcaaatcttaacctctgaaaggttggtttgggtataggaaaaactcctgccagtaaatacaacacacggactgaactgtgattgggatgtggcttcttcttgacatgaaacagatgatggaagcttctggatatgatttttgaccacctaattagtggtgcatggttcattgctggcatcttcttccagagaccttgctcagagatgggataaggaaggaaggaattggaaattgtattggtctgttctcacactactatagagaactaggtgagactaggtaatttacaaagaaaggaggtttaattgactcacaattccacaggctatacagaaagcatggttgggaggcctcaggaaacttacaatcacggcagaagggcaaagggaaagcaagtaccttcttcacatgcggagcaggagagagaaccatggggaacaaccagatgtcatgagaactcactatcatgagaaacagcaaagggaaaatccaccctcataatccagtcaccttccagcaggtttctccctcaacattgggaattacattttggcatgagatttgggtggagacagagccaaagcatattagaagtgtcccagccagaggcctgcctctgtttagaggcattctttgagtatgatggtgtaataaacaggagaaatttggagccccaagacaattttcccccggataaagaaagaaatgagggctattttggaagacagtgtggcagtttcttaacatagtcttaccatacaatccagcaatcacactccttggtacttataagttaaaactcatgtctacccaaaacccgcacatggatgtttatagcagttttattgatagttgccaaaacttggaagcaaccaaaatgtccttcagtaggtgaatggataaatgtgggacatctagacaatggcatattactcagcactaaaaataaataaactatcaggccatgaagagaaatagaagaacattaaaagaatcttacttgacatctcacttcaggagaagccaatctgaaaaagcaacatactgtatgactccaactatgagatgttctggaaaaggcaaaaccctagagacacgaaaacaatcagtggttggcaggggttagtgaggatgaacagggagatttctttctaggggatttttagggcagtgaaagtattctcatactatactggggagtacatgtcattatacatttatctaaacgtacagaatgtataagatcgagagtgaaacctaaggttaatgaaagactttggatataatgacatcagtgtaggttcactgactgtaacaactatactactctggtggagatgttgatagtgaggaatactgtgtgtgtggaggggagggcagggggcaggtgaagacaggggtatatggggactctatactttctgctcaattttcctgtgaacctaaacttttctttaaaaaaaagaaacccagatttaaacatgaattgagtaggtgaggcagtgtgtcttttggagtctgtggtcacacataaagcagttcaaacagcctctgtctaagccctgtgagccttccacactgtgtatcacactaatacagcaggtgtcagactgtaaaagaggagaggtcatttagcagtcatggggcatactcctatctccaacttattctcctgaagcattctatgcccatgagaatctaagcttactgatggtgggaagtttaataaacactctgaagctattaaaaggtttctctacgatttctaaaaaccatgcctaaataactgcttgacacacttggggatgttctatttctagagacaaaggatccatcattcattgggtctttcggagagaaagagaataagatagaatttgtattcacaccaaaaaccagatgaaatattttgtgctgtgactgtacatctttggaatgctggggctttggggcaatatttcctgaagcccttaatctttcagtagctgccaactggccaagaaagaaaaaagcaggagggtacttttctgtatattactattcataacagttttggatattttccccagagtagttgatgctcctttgacagatagtaaataattaatcatcatctcattctcgcagagcaaaatgacaggttttttcgatttcacagatgggggaaatgtgatcactaatggagaggagactggcttaggacatgggcctgggagaagccccagaggctttgtttcatggtcagtttgaacagattagactactggatgctcacagtgctgctggctgctgcttccaagaaagattgacatgtttgtcttgacatctcgcttcaggaatggatggatacacagggaagcataaatttgggactaaagtgttctaacatttctcatgctgtatgttcattcgtctcttcgggcaattcagcacatgcgtttatcccattaatggctggagaaaaagttctgattaccttccaatttacatgattcatattagtgggttggagcagtaatggtgatgaattcttctctgcttaggttgtgcatgtgtttagggcccttgaaatctgagaatagccacactgtaagtagctgagcctctttctctagcacctgctcagatagaatttgtttgtaatttaaacaaactaataaacaacatattccaagctggagaattctgaagatgatgattatggcaaattctacttccaattttagctgtttgtggtgctttgccttgattttatggatttaaatttgctttaggttaaacaataccttaataatacacacacatgcactcatatgcatacacaataacacaatgtcagcaagcctagctagtttgatcttcagaacattttgttctagtgttttatgtggctgccataagaatgttatgggcaatgtggggaaatgtcagcatcctattgggagagcagcactggggtaattttttatgtcaagtttatttccctcctgcaagctgacatggagaaagaattggacaggttcttgatctaaggctctttgtctcctgtcttggttatgcttaggccaagtacttttggaggaatggttgagctgagccttctgcagaattttgattctaaggtcccaaagattttttttttccatagacagagtctcactctgtcgcccaggctggagtgcagtggtgcaatctcggctcactgcaacctccacctcccaggttcaagtgtttcttctgcctcagcctccaaagtagctgagactacaggtacatgccaccatgcctggctaatttttgtatttttagtacagatggggtttctccatgttggccaggctggtcttgaactcttgacctcaaatgatccacctgcctcagtctcacaaagtgctgggattataggcatgagccagtgcacctggccagatcccaaagattaaattgtataaatggcaacagcagcaagagccagagacactgaaaagtagtgtagagtagggattgagaatggctttggattttggagtttcattattaaaatctcagctttgacctttggtagttgcacaattttaggcaagctttaattttttccataaacacttaggatagtttctgccctatgatgaatactcaatctgtagtgcaatgatattgatgattgtatggacaacagacttactttctttttaaatcagaacctggcaatcatttcctgcctcctttacagagttacagattctgaatatctaagattagggccaaggtgtctgcgttttagaaagttccatagatggttgtgtaaggagtggatagaaaattatgtttctggtgttgggagattctctgacctcactcagcttggtctctgaacatctatctcagataacattaggccttactccatgtagctaaactcctagtcccgactcagcccttacatgtttctatacaatccctgcctcactgccacaacgatttctctgacctgcctcagaacactacacttcagggaatagagagagtgctgctaggaagatagtatttgaaatgaaatgctagttagactgaggcagggcagatctgtgtagatattaagctgatgaggtgttaaactaggagtggtagaatcatataatgcatgatgaatcttgcataggcaaagttgaaaaacaaactgttctgattcatctgtacttgttgctgaaatagttttatcttaactccctatttttctgtgtgtgttaggtctgcaagagggtactgaactaaaatcctcagattggaatttgctgtgctaactatatgcattgtttggagaacagtgaacattcaaaattgtattcacatatgggcagtcccaggttcacagaggtagcaggatggagactgagcgcagaaccagcatgatgaatcccagatgtttcagcaaggctgtgtttcctaggctcactggatcgtgaaagtgagtacattcaaggaagggaaacatttaaaagaactaggtgtcaaaatggctgaggggatatttgaatattggttcacttgttggggagaggtggtctctttaaatgaacatctcctttcaggttttatctatgttaagacaaaaatctgatttttgatttcctcaataatatatcttgaaacttcacttacatttatagttgccaaacagatttttgaacatctacttatatgcaagttcatgcagttggaaagacaaataatagtccctgcctttgatgattcagtttagcaagggagatagtcatgtgaacaataactacaatcaattataactgctggaatgaaaggctgagcacagaaagtatcaggtcttcaaaagaagatgggaaggtttcatggagtaggagacacagggctcaagatctccatctgaagtggcattcagctgtgctcttataatacagcaacttccacagtatggtaagttccatagatcactggacaatttgtcatgccacaaaactatatttagaacagcaacttctgaaatgaaaaactaaagtattttgacaatccagtgtcacaatggtgaaatcttgattagtaaccttatggccttgccatcctttggtaaagctcctagaaaaacaataaatattttagtatttcccacaaattgtgctttccactaaaggaatgcattcaccttttgcaacctttttcttgctctcatgaatgcctgatgctgtggacaggaaaaaaatcagaaatgttctgagttcaaaattactttagaagcctttgggggaaaacacataccttttttgttttgtgtttgtttgtttgtgtttatgttttgtgacctactttagttttcataaaatctgctccatttttcccccaaggaaatctactctgagtgaaaagaaacaaaacctataccctaaggagaggagcccaaatgccctattgacagcaattttgaaaagaattaaatttattattaatagcatggataacagaaaatataaggctgattattacacaaacggttttcagtgaaaactaatgggccatcaggctcaaatgtgcttatctcctttctttatccagccatgagcagcactttatcccttttgttttcaacaaaggaggtttactgcctccttctctatcatccagtgctaaactgcccctaaactcctatcaatcctttacctgaaataacagatatgcttgtccccacgttcagagattctttaaccagcagataagggctattgtctgggacaatttcctgagattccagcccttcttatccaatcaatgcctacttgtctttcaaaatttggggtttagatatttcctctgaaagaactcccccagtccttccaggctcattaagatccacgtgctacctacatccctatgattctgtcacatgaccctcatcacacctgtaattacatgtgtagggaagttcaaacatttcctctgaagatctgagatttcagtttgttgaaataaactggcaatagacagattcacaggagaaaaggcatcacaaatttatttgatcatagttttacatgacatgggaggcttcagactgacgaccccaaagacccagggtgaactatccatttttatgcttaggtagatgaagcatggccagccatgtagaaagatgattaaacaaaaagggtgtgatctaatagtaatagactgaggggcgggaaacccagcaagccctgcctgtttggattcttctccctgcagcattccttccttctgagtatggggcagggccctctttggaatgggggtcttatgacctacaatcaaacaagggaggccagagaatttctttatggccaattctcacacagaaaggtgggggaaagttggagtcacatttttaggttttatgtctggctttggggaaaacgggttctggtttttatggctcaccatggggaagaggaattatagtttctatggctagcctctgtggagaatggggggtgagagacaggaggacaaagatagaaactttgctttcgaggctgccgctttggagtatcattttctgagccccagtacatgctcagtgttcatcttcctcacctgattgtaagttccaggacagccagacctttttgtgtctgtattcaccgctgtatttctagatcattgtgttcactcactaaacacttgttgaaaagaatacaaatattcttaatactgtaccagtttaatccctcataatgtcttgctggatcagtctaaaaggtatttctttaaagccttctgcatactattctctgtctggggtgatgttcccacaaatgattacttcctgaccttcaggtttcagctgaaacctcatctcttcatggagatcttctgtcacttaggtgggtaattttcagttactttaccttatttgttttcttcatagagctcatcaagatttatagttatatattaaatttttctttacttatttagtggctacgctgagggaagggctgtgtcactagggcccagccaggaagatgctttttgtttttttagttttccccaaataaatagaagttgcatgtgtaaatgtttggtgaatgcctatctaaatatattgtcagtttcaggcttatgggctgtggttttgcatcatgattattctagtatcaagcgtggttctttacacatattaggagctgaaatttttattaaatgaaggaatgcataaacaatgtcttagaattatctaaatcataggacttttgcaatatcttatataaaacttgccatttatacttattagcaacaaatccaagtgagatgagttgcaaatctaagaaaagaaaacaccaattaccaaaatgtatctatataacttttattcagtgagtattaacacctggtgtgcaaggtgctattgaacctctgtgaataagacagatcatctactacagtggttttattattgtaactggggtgggtcttctctctatatttcaggagtgttactatgaacataggataagatgattgacactcgtttcctcatctattaagaatagtagcaaatccaaaatcatcctttttccagaggtcccctagggctacatactcagagccagactcccagtgctgcccttggggaatgggaaagtgcctcagagaggaaattctgatgtgcagagcctgcggtccccaggagtgctaaggcccatcctattctgaagctcctgggcagagtcatcaggtactcgggagcttgggagcttaggggctgaactgggtcttctgttgaagacatggtcaggtgcatggtgggggtgggggtgatgcctctttaaagaagttctgtcacttccctggctacaggacagtatcagagtgtgggtcaggattgaggtgcacatctactctgccaactcccaggctcagagccaacagtcccagtcctgaggctgctctgattttaaactaaaaaataggaaaggcttagttctgcttttttttccccccaccaaggacagtggggccacctagtcacaccaatctttgttaagtaaaatgattttttagtgattccaagtagttttctctctggaaaatatgagtgatgagttggcgtttccagagtgactgcaggattcccaccccagtcacccacccagcctcttccaaagaaggtaggactcattgtttccttattcttttaccctttttaaaagtatctttcttgcagaggcagagaggggagaaagatttcaagtttaatctgtgtcaggatgatccacatatagtaatattaggcaagatgagatgtttgcagatatagcagtctccccttcatctgtggttttagttacccatggtcaactgtgatcagaaaatataaaatgggaagctccagaaataaacagttcataagttttaaattgcacgtcattctgagtaccctgaagaaatctcatgctgtcctgctttgtcccacccaagacatgaattgtctctttctccagcgtatccacacggtagatgggacatgcccattggtcatcaatatcactgaggctcagtgacccaggatcatctgaagcagatgatgtccttctgatgtagtatcagaacttcaatagcaacctaacgctatggcacaaagcctacatcagtcacgtccccacagtttatcatgtaggcattatttcacatcctctcaggaggggtgagtataatacggtaagatattttgaaagtgggatcccattcatataacttttattacaatatgttgttgtaattattttgttgttatactctttttgggtttgttttgagataggatcttgctctgttgcccaggctggagtgcagtggtgcaatcacagttctaatcacctctttgggttactctttgctgggtgctcccctgtgtacctgtgtgatacaaatattaatgaacttttttttctcttattaatctgtctttgcctagttcattttatagtcccctaagctgaagaacctaagatgagtggaggcagataattttttcctttcttatagtgccataaaattagtagaaatagaataataacacttggcatgagttcacaggtgggagatatcacatttgcttgtaggaaccagaaaagttgtggaaaaattggctttggaacttcactcagagatcaggacagggcttggccatgcagcaatatggcagagagtggagagaaagcatggggcatgattgtggtgaaagaaatggaaagttagtgctagaaccagctcatagatatcgttgactagtcaactaaggagatttggctttagttaggaaaaagaattttaagcagagctatggtatgtgtgtagaaatgatggattgaggagcatagttggaaacttaaaatattcccggagggaagttaatgagagcttgatttaaagtagaagcagtgggaaaggagaggaaaaagatggacgggagtgaaggaggcacagcaatggacgtaaggagggcagagtcaaaacagcaggtggctcctcatggaaagatcagctgggggcacagtggactcaccccagggattcagattcctgttctgtcccagggaacaactgtttaacatctcctgaaaagttcctgaattttcagagtcagagtataatttactcagagcccatgagctttccttctgccaggtgcaatgtcttttgcccaacaaacaagaatttcctttgatgcatttatccttatgaattatgtttgtccatttccataattaggaaaataataactcttgacatgaagctggtctttagagactttaagtagttttcatatacttgttctcattttatcctaatcaaagcatgccatgaggaaggctttggtgcccttttataagtgagaggcagtgtacattgtgtagttgtcatcgatattattggttaaactaaaaagtagtaacaaaatgccacctgtgagtagctgcagcaaactcatgaatgtgaatccccatgggtacacgtgggcagctgtagttttaaagaacatgaggcaagaaccataaatacgttgtttcacagcccaggttctatgggcagactagaaataaactcctttgcaaccagttagcagcagcataaccttgggcaagttacttagcttttctgagctttagtttcctcatctacatagtggggttacatgacatcatcattcgatgaaaaaaatactcgtgtcagcaacagctcacacactgcatttctgatttggtaagtgccaggcattcaacattctctaagttttgcatgcaatatctcaggtaatccttgatatggtaccttagaggagctccaagttaccccgagttacaggtggcgtatctgtgtggctccgcagcaacttcagtccttgctttctcagaagaaagactatgaggagcgtaaagccgacaaagagactgaggcaagtctcagagcaggagtggaaatttatttaaaaaggttttagaggccgggcgcggtgactcacacctgtaatcccagcactttgggaggcaggggcgggcaggtcacgaggtcaggagttcaagaccatcctggctaacacggtgaaacccgtctctacttaaaaagaaaaaaaaattaaccaggcgtggtggcgggcgcctgtagtcccagctactcgggagtctgaggcgggagaatggtgtgaacccgggaggcggagcttgcagtgagttgagatcgcatcactgcactccagactgggcacaagagcaagactccgtctcaaaaaaaaaaaaaaaaaaaaaaaaaaggctttagaaaaggaaagatagggaggtgcacttggaagagacacaggcaagcatgtgaaggttaaagagaataaaagaggcatttaaccttgatactgggtctgttcaggccagaccatgattcttcccttaggatgggcttcccgcatgcgtgatgccttccttacccttgggaattgagcaggcacagtgtgtttaggaagttgtatgcatgcctatctgaggcttttttcctttttcctgcggagtgtaccgggaagatcgtatttcactattttgtctcgtatgcgcacgcccagaagtttcttctccttggcatctacattcaatcaatgctttaatgttaatagctgtggatcatcagggaatggcctctccctggatccctgggtgggctggcaaattgtcatttttagagaggcagtgtgacaattgtcaaaccatcacttggcattcctaacaccgagagagccttctcttgccctgctcatgcctaactacctgtaacaaaaatagccctggaacagataatcgtatcattttatagagaagaaaattagaggcctttggaatattaatttgtctagattacaaagttagtacatggcaaaactgagatttaaatctgttttctgatactagattgaagattttaaccattattctataccatctttgtgtatggaaagtacttaacatggtgtctggaattcagtaaatatcaaatgtattttactactactactactattattctcaagtcaaattacaacttcagtggcacaatagatgtattctatgaactatttaatgtttttggacctaaggctcctctccagtctacaccagtctaaatgtaatttaatgttatggacgtaagatttaagtaaatattgacagagcagaatcagggtgaaaccaagtgtttgaagttttagtattaagatacaaaatggactttagaatggattagaaggttaagagagaaagctgataaggagacctgaaaagaaggaggaagggaagggaggaccagaaaaagtacattatttgtgttagtatttttgtcacttttcccaatgaatgaaaaagcagtggctgccatggagcctatacgacagagaacaatgatctcaccactgccaggatggcctgtaagccagccatctaccctgcagactgactgaggggacagcatgaattgcatataaaattcatatatgccaatagctaccagaactgtgtgaggcagccaggacaggacccctggagacagaacagcagacattcttgcttaaaagggcaacacggaatgctgcagcattcttgctaaagggctatataccacaagggtctgtggagtggctcgatagaaacaatggactgaagctgccaggctggagagaaaccttggcttgtgaaaaggagaaggctatggcttccaccagaggcaggatgaaatccttggctggaagttcttccgagggcttaaacttgatgtcagtcagcacagggtactatgtgggggtggcatccatgagtgcaggagattttatagcaccttcctcttgcctcaaagggattgctaatctgaagagtgccaatgaccaggtacttaatgccatcgaggttcagtatctgtgccttattctctaatttctactatgttcaaatatctgcatcgaaccacattctaaattaagccagacctccaagttgtatctgttttacctgtatcacttgctgatccatcctgaaatgtccagagcacttggctttcccaggaagcatcattcttctgggtcatgctcaagacagtggtacttttcagacctatctctgcctgacaaaagtaaactttcctctgcctgacaaaagtaaactttcttaaagaaaactgacaccagacaaagattgaacttcattgaatatggttagtcattccaaaaatatagttgaatccatatttaaagagttcataataatatatgtatactatgctatttggacatggttttttaaatggaatttaaattaaccagaagattatagatatgtctatatacaaacaaatttgatttgcctggtaaaacaagtgtcatgttttgtttcactgaactatccaatagtttggttgattttactgaatgaatgtgtcatttttgtgctgttttggctgtagaagttgtttcatataggctgtggacacagtgtacattaagccatgttggtccaaataagcaaagaatgtggttgctagactcatggagttcacattgttttgtgttttagtcaatattgttcatacttagaacatttaaatgtgcagaacccttcactgtaaagccttttcacatgctgaatttcaatgaaaaaaaaaaatgcaagtgctttttaatgatccagatgggcaatctaacagctaacgttttacaagggatagcatacaactttgtgcctcttcttccactttctttcaatgctactttcaaatacgcaatttgtgctgtagaaaatactgcaaatttttagcaagttttgagtgaaaacagagttataatagaaaccattatgcatgcctctgctgctgagatcagacctcatgtttttgtagtcacccattgttaatgcagcaggagagccctatcctggattctttgtgtctccaaactactttatttcctttcttctcaccatcagagaatgtttcctttttccctatgtctcagagcgcatgagactctatgagtccttttggctctatttcttgctatttatcttattactttttctgtttaaattctcatattctttctgcttctgtataaacaaggctggatttgctattaaatcaaaagctgagggaaggatagttaattatttctgaacacctgttatgtgcccagcagtatagggctttgcatactttatttacaataaaataactatatgcacatggtattaaatccacatttaaagttgcagatactgaagcacagggattaagcaaaatgcctaagatcatgctgccagtatgtagcaaagctcatggaagacatcaggactgttgcctaccaaagtctttcctcttctttattatgctatggtctgtctaccaggtctagcttatggtggggtcaccttcccaggcatgggacactcattttccagtgacaaccatgaaacttttaccataggatagatttccttgattttgctcccttttcttttgctagcctgtctgggaaccagaactctaactgtgaacctactagacttaacactcttgtctatcttcaaagactctgctttttgcacccagttatacttcctatcagcatgatcagtcagttattacctgcccctgcccaccaagcaccaaagactacaataaagtgcttcagtggctgaatttcttggcaccaaagactacaataaagtgcttcagtggctgaatttcttggaaatgatttaccttaaatatacctcagttgctcttttctaagctgttcttccacaggaagtatcagtaagaatacagttgcaagaaacaaaagtggctccctccaccacagtaaagggtaggaatcacaaggctacaacagtggactccacaactgctgctgggcatccctgtggcagtgattgggcactggagcaccatttcagaaagacccaatgtctctggctatggctgtccacagaagacagcaatgaagtagatcattgccctccaacccacttctgttttctgcatcttgcatgagtggatctcatgcgtggaacctgcttggcatctagaatcctagctgcaagggagtttgaaatataattttttagtttttcagtatttgcaactcaaaaacatactttagaaagtagagggaacagaacaccggtaagccaattcttatttgccagaggggtattcagtaaacattagacgtgttttgtattaaaatgaggagaattttaggtaaatagttataataatgtgaataaaacaacactaaaacacaccaactggataattggtgtcgtatcctactggatgggtgttaatatttgtgtttttttgttatagtatttgacaaaaagttttcttaaattcataaatgatctcttaagtggagggaatttgtcttaatcaccttgactccatgtagagtgactcaaagtgtagaaagtaaggtctaccatctttatagtatggagaaactgaaaagaatggaagtatatcttgttgaaaactgctagacttgtgttatatctcggattaaaccaagaaaccatcagtagttcagggaatataaaagtaactcaaagcaagctaatcaagaatacagaagacaaattaatattggaaataccaagtaacaacaacaaaaggctgaggttacttatgtaaaagtgaaaaacttttctaaagatttcagaaatggtaacattaatgacctaattaaaattggcaacatgaaagctaatatgtaaaggtctttaaattaggcccgaagctaagtgctccttaatcaatttttgccagaaacaagttattggaataacaaggacatatacctcataagggagattttttttcttggaattatttttaattggactctaaactagccatctcaaacagttttgttaaaaaataaatgtataaagcagagtgcaagagacaaaacattaatctttgaagaagttagcttttgagaactgaaatctaaatataataccaacttttgttatctgtataaggtgagattctattttggttcctttttcttgtctacttcctaaggctaactattctgatccattttttaaaagcactttaaaaaatgtttttattttaatttctttttagacataaatgatttaattttatttcccataagcctatttcattaaatttgatcctggaaatttgatttttaaaaatatatgatgtatatgaatacaaatgctaagcttgttgtagttgatttcatttaccttcacaaactcgtgaaagtgtttcaatagattaattatgcaattatatgtccccatttgaatgatactatgtctgaaatcaaaacaatctgcattctagacatttaaaaataaatgcaaagttattactatcaaaagtagctggcagaattgcttatttccaatagagttacaagagaagcctggtttacttaacaggattcttaggttatgttccctaaaagcagagcctgagacaaggatttagatgcagatttgttgagggagtgttcttcaggaaaaaaactctgtaagagaggaagtgaagcaggagagggaaggtgaattagaggggaaagggcaatgccctgtgggttgaggcagctcccatcagctgaggacagttcctggagaagggagggaatcatactcataggagctgggagagggtgcactgcctcacaatgcagacaggggttatggattacatgctattgcaatagacaaaaaagaccttcaattggcatagcagacaacagccatgatagttgcttccttctggctcagtctaacatgaactaaattgtcagcaatggctgcagagtgggtaggtctggatgcttatttttctaccatgggattatcaaaaccatatatggcttgatagggtaggcctcagaaaaagatcaattggtacctatgttgagcaatgagttatgataagactaggtttcaaagatgagctaggacaatcagatttcttaatttggatatttgaagtaggctatattggaagcagaagctgagaagccatgatgacctaatgtacaggctggagttctgagggaggcagatactatgagttagcagcaacctcgaggtggaaaaatggcaagcagacagcacagagcgaaaaggccaattgttggagaaacggagaatgggaaacaaagcagaaacctgaaggggagttgaattacattagtagagcattggaccaaagaactacaaagtcctgatggtgaaatacttttgttttttcaagtaggagggaagatgtcaaagagcatgctcaagaaacactagactggattgatgtgtgattgttctctggggagggtagatacggttatttgcatgacgtagttttttcaatcactaaaatgcatctggtatgccttaaagtggaattgttttgtgttgatgataaccagggaatcctggaggccaggatgcttcttccaaaaggagaatggtaaagaagggaactttgaaaaagacagattcaaaagcagaattttaaagttataagtagtagattgtgtgatgtaaacctatttaatagtgattttatttttttatttgcagaagtgtaatttgaccatggggcggagggaacggttgacatttggattacacaatattgtttggtaaatgccctgagagaggtatagaggtgtgcaagaattccaagtgaaatcacaggaaaggtgcttgccaatctaatttctacagaagcaaaaaccagagagagactcacaggatggccaggggttggtttggtgaagaggaggagagctcaggtcattgattgggacaatggtgaaaaatgttggacttgattgtgtcaagggtcttgctagctttgagtccgtgactttttaatggtgctcttcttgaatgtaagatcttaggaatattaatctcctttagcagggggagagagaatcttaggaatattaatctcctttagcagggggaaagagagtctttcctgccctggctcagggtgtagtgaggagagtcatttctactaggctatagtgtgtctaaaccagtgcgtagggagggcgagaacccagttatcacaatccatcctgtgtcacttgtgagaatatcctgtaagtgctattaaacataaaagtttttaagttaagaggagcggtaagctctctagaaattgttgtatcttcattagcatttaaatgatcaaatatttgacccaagaagcatcatgtgtacatgcctgtgtacaagtgtttatttgtgaaaacatacccacaaacccatttttatgaggtcaagagaatcttagacacacttgattgtttttgcatttgctctttgcatttaagctttgatcaattgatttcctgaatatggcattaaaacaggtttcaagataatgaagactacaaaacatatcataaaatgaaataataaaacaacaaaaaaatgggtagattgagaacaatctcatagcataaagagccctcatcgtatttggtggtagtatttttttgtgggcatctaattctatgattagagaacatttaatataaattcagcagaaacatctgctgatctcatcagtgattacctagctatgaaattcttggattcctcttgaaagcaccgtgtaagtctactacagatatttcttccatcctagattctgaagaatatctaggagataatttcacagtttctggtgctaacagtgctaaatcatagatacttagagaatttaattttaagtggaaattttcgtctgttctgttgtcaaaaatgaaatacaaccactacaagaaaaagtattaatgagatcagttcaaggtcaaaacttcaatggaattttctaaaaatcaaaacagggtgcccctaatgtgataatatgtacttacaaacagagctttgtggtttatgccatcaaccgctttgcaaaatcttgccaatagttttattgccataaaaattggagagttgatcagtgggttacttaaagctgtaatcttagcctttagtggatttatttaaatctaatttaaatggagttccttaatatttattttaacaaaagtttacttagaaatttaagattggaaaatagtttcaaatgagtactgctggaactaaaagtagttggatatgtggcgtttttccaaggtggtcagatttccctcaaggccaatttgtcattgatgaagcatctgtccaaaatcattcatctgtgttttgagaacctaggatcaatcaaactctctgtttggatagtcaactattgttttctgagtaaagatggatgatgataggtgaatgtaatattttaggtttaactttaatgatgtctgtttttttttctggaattagaaaaataccagggtggtattttggacttttgccttatctcacaattaagtgcttattggaaactcagaaaagaaaacagttgaagggtatttagaagtcatatgaatttcttcattttgcgctaatggcactttttaatgtgattgttgtttgaatatactggtaatgatggagctggatatttatgaaaataaacactgaagattagtctattttgaaaccttttttgaggcaccaaaaccatagtgtcattctactgttgccacatactctatatcacctagatcatcttccctgttttagccacagacatacatgaagaatactgtgctaatatatgcataaactgaaagttttagccttcaccaataaaggatatataactttaaaatggaatctctagaaaaagataggtactatagattaagctttttacttaactatttgttcatttatttactaaacgttacttgaacacctgctcagtttacattgcattatatttatgtgtttaatgatctgtctcttaccagactgtgagaaacttctattccagtggctggattaatggctaatatttagtaaactttgtatacacatgtgacaaataaatgaatgtaagtattcagaaatgattttttaaaacgaagggaagagagacacaacatttttagcatgtagtatatagtttgttagattatttgttaatcaattcaagcatattatcttctttgttttattcaattattacagtaatcatttgaggaagtaggaacataattgaacaagtcactgaatctttgattctaagtcattggactgggaagtcagggctgggagttgaacttatgtctgtatgatcccagggtttgtgtgcttagattgcaacagttggctgccacacacaaactcttaccactttaccaggttaaataagaaagaacttatttgactactgtttacactaaaaaggaattctagtaaatttcaaaattgatattttcttttttttccagtagccactattatgtatccttcttaaaattgagatggaagaacagtaagggttgttattataaaagttccaatcaattaaaaaggatacaaagcataccttttgatagtaaatatatgaaaataaggaaatatttgaaatttgtatgcttggatacctagaagcatcagaacacaaaaatgattaaaatttgggtgaattaacttaagtggctagatgtataacatgcaaaacagcagtatgttgtatgggaagctattagatttgagaataggtctggcataatcccaacacttaaaggcccattctaagagtttttagaaaccagactgtagacttgcaaggtagaacgcagagaggttatttaggtgggttgtacaattttccaggatgaagaggacttggaacaggctaccacctgggtagaagtgagtacattttgggtgtattttgaagaaagaaccaacgagtttcattgatagattgtggcacaggagaaaaagaggtaggataatgctataaatttgggcctaacaggatgaataaaattgacatttactgagaagaatattggggaaaaaaccacgttgaaggtaaggagaatcggaaagttttgaacatgcaagtgttaggtgctttttaggcatctaagtgcagacgttgagtagatagttgcatgtatgagtctggagactggggctagagctgcacatttaggcatcaccagatcatgaaagatttttaaactgaggctttgatgatatcacttcagaatgagttggttagagaagagcagagcactgaggtttgagttatcaaggcattctgaccttcagaaggtggactaatgaagagggactagctaaaggatcttgggaaaaagtggccaggaaggtaaaagacttgtagtaccttgtgtctcaaaagtgaagaagagtttttgtagaaggagttaatattattaaatgctgccagtggaccacatatgatggagactaatgattgggtttattgctgaggaagtcactggcatccatgaaagcctgtttggaatgggcccgagagaacaggagaaggaatagagaaagtgggtataatcaactcctgaattttgttctaaagacagttgtttgtaggaggacataaggtgaagggaaaggctttatcaatattagtgatattacaacaacttgctatacacatgagaattattcagcagagaaaatattgaaaaatcaatactgtaggagaaagaagataatttcctggagtgaggttcttcagtgaacaagaaagtctggtgcctaagtggaacatttggtcccacaacgaagtgtgtatattttagctattgtaacaggagaggaagagagtatatgaattcaggcgtgtgtgagttgatagatttgtaggtgtgatgatgtacacattctcttttgtttccattttctacataaaaagtagaagagttttttcagcaagagggagattctatgaactaagttgtggaaccccacccctcccagagattttgtatgttgaaatcctaacctccaatgtgatagtatttggaatggggactttgggacataattaggtttaggggaggtcatgaggctggggccttcatgattggatgacttgctcttatgagaagaaacaccagagagcttgccctctctctgccatgtgaggacacagggagaatgtggctgtctacaaaccagaaagagggtcctcaccaaggaaccacattagtcagcaactagatcttggaattcaagcctgcagaaatgtgagaaaataaatttctgttgtttaagccacccagtttgtgacattttgttacctaaagcaaactaaaacagaagaagatatgttagagatttgaggagaaaatatgtaaaagtaatataggagaacaataagtgaattgagcagggaaatgtaatagtaagtttggcaggcagttctgagggcttacctaagatttttattcataaatttaaagttggactgttcagcatagtttcaggttttattctagcattattcagctactttagtgcacagagaacagtgttggacaaggaagtttgagttattgggatataatatgatggagggaaagaaggaaaaggaattagggtgtttacaatcatatggtaagtatggtgtataaagatcacgtcaatggtggcaatatgctaataaacaattatgagtgtgaaacatgtatgatctattaaaaattctaacagatagggtgggtttgtcatctgtcaacttggctaggctcaacaatatttcccaaaattccctttcttgtatattgccagttagagtgggccactagagaatgttcataggatgtttggggaatggaaattaaacagaaatttaatttgtggttcatacccagtggggctgttttggatcttggtttggacagcaactgggtctgcagctttaattccttcccctggatcctcctcctcctcttggcaggtatgtgtctagctacatgacaggtgccatctttctgtgcagaacactgtgtcatcaagattgcaggcagtgagaactggcatgggttttattctttcctcatgggttctagttggtccttgatctcccctgtattacatccatcttgtgtccccaactttctgccctgcagacttcaagctccaacatcaaatggaagacaacagccttacaaatactactgagccagctcccatgattgtgtaagattcaatcctgataacatgtcccttattttacatgcagtggttctgcttctctgatagaattatttctgatgccagagatttatagcacatgtcatgttgtaaactgagatgattaactattgggcaggtgtcaattctccctgaaagcagttatgaatttaatagtcctgatacaaatccagttggacacctccgagaacttaaaatgtcagtaagaatagtttaacagtaagtatgccacagaacacagaaagtctctgcactgaatctctgaggctccctggtgggagcataaggctggaacaaattaatagaagtggccaggttctgtaccatgctttgaagcatgacatagttaagttgtgtgaaaggtctggagcaagcaaacataaaccagaatgcaagatgttcatttcagatggcaagaattaagtggaataaaacagtagttatagctagcacatatggtatatctatgtgtgagacactcattttctaagtgctacacacacatactagctcattttatcattacagtaaccctatgaggtaagtattattgtttctattttacacatcaaaaatggaatcagagagattgaagaacttgccccaggtcccaccagtaagtagcaataaggtcacgccagagagtgatggaggttagagctcctaccctactttctcctatttttcttcgttttgacttcagctctgctatttgagaaattaccctggtacaggcaggaaatggagcagctcaatacccccaagataccctttagagcaggggtctccaaccacctgagctctacctcctgtcacaccagtggtggcattagattctcataagagcatgcactctaaatactattcttagattgacggatgtaagtactagatccctgcacatacaatctagtacttttgcacaatccatggaaaaattgtcttccaccaaaccagtccctggtgccaaaaaggttggggaccactgctttagaggaaggtagtaacaattaatcttgtaactaagtgaatgaacttggaccactgaagatggagaaaatcaactccatgagcagagccaggaaaaacaggtaaaaacaattgaccctgtcattaatcttatgtgttgctgggctattggcataaggctggcagaatgacccagggacagactattgagtgaaacatgttaaggagcaaaaaccaagacaaaagttgttttacatccttatgtgtgaggcatttcagtgcacaccaacataaggacactccttatcatgccaaggtggatggacagatcagcaatcagaatagggagggaaggatgtcatgctgctccaggcctgtacacaggtggtcttactgttaaaagataaggcagcatcagtggctggaacacattgcctttgtgcagtagggaagtagttgggcagggatttaagggattatcatttttcataaaagtccttgtaagatttttaagcctacaatcgtcttcatatatgtctctgatgaaagagtacgcactaaaagttataatagaatccaattctttgcctttcaaattagcaaagatattagtgagcctgggatgaaaacactagtaagtaagtgtgtgatggaatgcactagttattgctgctggcagtgttaatcggtatgacctttctggaaagcaatttatcagtatttatcaagagtcctaagaaacctgatatcatctgaacagtaatttcaccctggaaaatctactgtaataaaataattccaaatctagaaaagagctttatacccaaagaagttcagaggttcaccattaattattgtgaaaaactggaaacagaatatccaatcataaataaatgaaccatggtatacccactcaataaaatagtaaatgccactaaaagtatttacaaagattatgcaataacatggctaccactaatggaagagtaagtgaaaagaaccgaacatgaaatcatttatgccatatgtaagatacatattataaagacacaaatatatattttttgaagtacacctttttttttgtcaaaggattagaatacaaagaccacagttgttagaaaaaagtagttgaaggtagctggtaggaaaatggatagttttccttgctttgtttctacttgtgtgaattttcaaatgtctgttaatgtctcaaatgaaaaaattaaggaagttatatgcaatgacagtagtgtaaatttaattttcagaaagaaagggaaacaaatgaacaaacctaagccccttcaacccaacataattaaagccaaagtgaagtccccagacttccaaaatgtaatttaatgttcccctattgtagctgttacaggaatagctttcaaagtaaagcccataatagaacctaaaataaataaatgttctgaatgtgtagcagagcttggtttattttgaatcagttggctgacaaactttgttgtgattaacctgcatgggcaggcagaaatttaacctgaatatttggttagattgcatccatcttgcttattccactgaagaaaaattaatattttatagggaacaggtgagggtgggaagtgaggagaaattacagacaagtgtgttttatattagagactcttctaggccgtggctccaaggtagaattatttgttggcacaactactcctttgcaaaactgtttatggtgcaaaagcaatggcgtgtgggtgcacctgcgccaggtttcttcaggttctctcgggagatgacagccagggcttctcatttgtgacccactaacatacttttaaaaatttcttctgaaggactggttgttattaatgcctagctcttcagaaatgtttaaaaaccccataaatagcatttttcggttgttgccctaaaactaggcttttaatgtgtgtatatatatacacacacatatatatacacatatacacatatatatgtatacacactattttttctatatatttaaaatatgttatatataatgtattatatatattttcaaaagtttaggaaaaataaatacttggatatatacatataaattccatggactcacaagatgctgtatgtaatttcacttttgtttaaaagtatctcctgcccttttccaagtgtgaaattagttatttattataaaagataatatcaaagaaagtatgacaggatagttttgtctgcattttggacttctgaaaatttttgaagatagacacatgtaatagaccatcaggtcatttcatatttgctcttctttttctgcatacctagtgagataattatattatgggaatttgtacattctgtctatgctgacactactatttttactttcaaatttgactgctgccttcagcattgtgcaatgtttggctaatatcacattttggctgtgtcaagagtttcttggtatacattattgcaatagattttgttattggttccagatacgtttatatgtctttcttgttctcagtttctggaggttaatctgcctagcatctttccttttcttgcagaaaggaatctaggaatccttgagagctgaataaaactgccacattattttttttaaagagctgaatgaagtttttggagagaaaactataaactgactcaaagggaaaccttgctaggtatgaaaaattgcagacaaatttagaagtatttttatatatagtccttttccattcttgctgagaatcacaagttgaaaaaaagtgttcaatggtaggcattcaagtgcatgaaaagcatcttggtgtacagacgtctaaagttgaaactagctctatatttggccattaaaataaatgtagcatggcaaaagtggccagtacagtagttttcattttgttttggctaatcaatatgataaacagatgggtttatcttgcaagctgttccagccaaccaagttttcaaaaaaagcattcaattttaatccctgtctcaatataagcaatgcattaatacatgtgagtgactggatataatctaaacagttttatctttatctcttatcactccttttaactttatttagttggggaaacctttcctctattagatgaaaatttagcagattctaaatgtttatgctcacacttaaggtatgtagttactgtaagagataagatatagtcttaatgcataatttaaaaaataatccagagaaatatattagcactttaatcaagagtgaaaggttgagttctatagatggcagtctgggggatttgcagaggaggaagaaaagcttattagcacccttttcctgggcctggattctctagctgtaattctagattctgccagggaagaagggagaaatttagggagacaaagaggcaagttgtttcctaactggtgataggtactgtcaaaacctgacttcttactccgcaggtgtttgcaactaatgctttttcttgtgagtatttgaagacctatgactggccctgtccagcagcagctcccacagcacaggtaatgtttctcttcctgcctcagccctggtactgagactctgtccatctcagggctgatccaaatccttttgtgctccaggcaagctctctccctaacgtgcccacatctggtccatgggaaacacacattctttgatttttaccagtggaaatatagttacatcacaaacacaggcctctcttctctctattgtccctgcacaagccatttaactttctcagtccatgttattccccctgcagagaatatcgggccctccaagtgaagcccttacttacattgagatgtgtgggcaacaaactcttcttttccttgggtagtagaggtaaggctcaagcccagcttttcccatgggaaccttccccacaacattctgtttcattctgtgcacactgtcactttttaatatatccttaatctgtctcagaagctcaagtgtgaaaccagtttttgcacattttgtttgtgaattctgcattttgtttgggccttagctttggcatctttgtgatgaagttcaggatgtggtaccccaacatatggcaccttggcattttgagtatttcaaactaaagagatttgagaaaacgacaaaataaggaaggtctctttgccccttgggggcagtttatgaaacctaccagggattttttgaccttcccctgaggcagacaaaacactcatgtgagaggtacgctccctctacccataggaaagaagcatcttgacctccaaatacagagttgctaaggagaatctgaacaggccttgctaaattagatcataatctttttgctctatcatattgttccagaactctccattcttcatcaaaccttctgtaaaaaaacactcacgtttaatagttactttgggtcttcatttccttatgaaaactcctgtgtcacataaaacttatattaaataaatgagtttgcatttttcttgttaatctgtcttttgttacaggggcctcaggcatgaacctaagatggttaggaggaaaaatatttttcctttcttttagttgcctgggtcaaaactttcagtgaacgcactgttacactgatgtgaacgccaatgacagtcatgttactttgatcttggactaagatttccaaataaaatacaggacatccatttaaatttaagataaacaatgaactatttttagtacatgtcccatgaaccattcaaaaatgcatatgctaaaaattattcatatttatctgaaattcaagtttgtgcattctgtattttatttgctaaacctggcaactgtatcttagccaaagccctgtacatgccactggaagacattctgatgaacatttcattatctgcagggtttaatgtatgtatatgtatatgtctttcatgtccaaagtagataactgttcaacaaatttgttttgatcgcaaatactacacacccagaagcagcaccacatctattgccatcttcctggctactaatttgttttgaggttagaataaagcctgttttccattagccatgttgaggcttggtttcaggaggattctaatatattttgttacaggaaataagctgtttgctctgctattaaacaattcttaattgcttgcatttatgctttaactcaaatacttacttataatatgtcttgtaaggagttcaaatacattacaaatgcatccaattaaggctatctgattctactgttgatattgttagatactgtgctatggtcatacttttactaataaagggattgagcaatgaggttacaaaaaaatcatagaataaggatgctgtttaccaaattaaagtttctacttaatattttttattttacattaggagacttttttcagctcaaagttttcttaacatcttggaactttgtggtagacagagagagaggtgcttgagaggatgccatggaagatgggatccttcttagctgcaaattctgaaaattttagcagaaaataacatggtgaataaaatttttaatggaaattctttggtgatgctttaaatatataccaaacgttttctttcaaagctaacattactgttttctttcaaagccttagcgtctcactggaatgacttttatttttaaacttaagaggataggacctcaattgagattaagttgtgtttgtgagaaaagcatagaatggaacgaaaaagaactaccttaaaagaagctaatgtgaaaaatagtgcatgatttcgacattttatgtcactacaaattcaccaggagctaatggtgtgaccacactagataaaattaatattggtatgaccacttctgtgctcattttggggtgaagtggaggatgtgaaaggattcacaatgtctttgtgaagaagatgttaaataagtagatcattagtctgaggctatctacatagtttgagttcctaagtagcaaaccacaacctaacttaggaatataacaaagagccaagttttggccaattacatgctgacaacttactgcactgtgcccaaataaggcaatgtctaactgtaaagaatcaggtgatttctctactttgcttctccatctggcctgtaaaagcttgttgctcactctgctgggcagagctctttgaaccttttctggtcctgagtcctgcccgattcatgaatcattctttgttcaaataaatattgctaaaattaatttctctaaagttgcttcttaataatagtttggcatcagaagtgggatatgaaggagacttccagtgacccagagaaggtttccactagacccatcattctttcacagtaactggaggtcatgggtaagtttcttcttggattcaagctctgcaaatttctgttttttgttctgactttattgggcaattctttgaccagactgggttcaggattggatgacatccaataaggaaaatggactgggaccactaagagaccttcagcagagaaggttactagaagacagggaatcatgggatcatttggatccaaggaatctataactcctcaatctggaattctggctaatttcatgtacaagaactatggatgcaaaacatgcttttctagtgagatgggtggaccttatcaaagataacttagaattgcagtggagaaactccttgcaaaaggacatgtatttttatagctacaacagctacagggaccaagaggacctccatgtatacattctaaaccaggattccccagccccccgggccatgtacttatatcagtctgtggcctattaggaactgggccactcaggaggtaagtggtgggcaagtgagcattaccacctgagctccatctctggtcaatgactgtggcattaaattctcgtaggagtgtgaaccctattgtgaactgcacatgtaaaggatctgggttgtgcactccttatgagactaatgcctgatgatctgaggtggaacagtttcatcctaaaactatccccccaccctgtctgtggaaaaattatctttcatgacacctgtccctggtgccataaaggttggggaccaccattctaaaccaaaccaagaggtcccaaactatgccctatgccctgagatgtcttcctttattgtaaatagccaggccactggaaaataaattgtccatgcttacaccggccatctgatagacatttttcctttggcctggaccatttcctcactagaggaaatcaagccaagggcttgattcccaggacaataattaaccaatccctccaagaaaaaaaaaaaaaaaaaaaaaaccagaagaatatttgaaaccccaattgcagaaataaagttcattttcagaaaagcacttgtaaaaattagtcctctgttttctcgaatcctgttctcccctgggaccctctctgacaaatgatatgttctgccaacattgtctttcttgttatcattgcctttgctatgccccaaaactctttcttgcaaaacaaacaaaagttaacccatctctgacaataaggcaagattagaagtatccatgctgagtgcaggcatagaaaatgcttgtcttattcttttctggactcaaccctgaactcagttatacagttaaaacacaagctgggcagggaaaccactgatccagctgaattagtctctaaaatttgtctttctggcattagaactatttttagcttattttaaaacccttttgcaagagaaatttacatctataaaggaaatctccatttgtcaaagcttcttcccagtgcagaaagagagactaagtcactagaaactcttacaatggagaaggcattggcttaaatttatataagaagccttacccttggtttaaagatgcttttctggctgtctttttttgtttgtttttgttttgaggtggagtctcactctgttgcccaggctggagtgcagaagtgcaatctcggctcactgcagcctctgtctcctgggttcaagtgattttcctgcctcagcctcctgagtagctgggaccctacaggcgtccaccaccattcccagctaatttttgtatttttagtagagacagtttcaccatgttggccaggctgttgtagaattcctgacctcaagtgatctgcctacctcagcctcccaaagtgctgagattacaggtatgagccactgtgcccggcccatcttgttttaactagacctttacctacactcctgtttcatggtttaggcaaatggcagtatttaagcctgaagtctaagctctatgcctttgagatgtaaatgttctacctgtcttctctaagacctgacagctgtccctttaaaatttaagtttaggggagatgactcattagaagaactaaaaataggtatttagaaactggacaaataaaaatgattgattttccacaaatattagtaaacagttttagccatcaggaaatcttgtttgattatccagaaatacaatttggcttcagatcttatttaataaattagtgagctttgtattactgtaccaggcacatcaccaaaattttaaaataaaagctataagatcagtttctatgtgtttatgtatgtctgtattgatgaagagtcaaactgtaaaatatttgaagagatttattttgagctaaagtaagtaaccatgacacagcctctcaggaggtcctgagaacatgtgcccaagatggtcggggtacagctttgttttacacatttagagagatacaagacttcaatcaaattcatttaagatgtacattggtttggtccagaaaggtgggacaacttgaagcagggctttcaggttattggtagatttaaaattttcaggttgataactggctgagtttatctaaagacctggggtcatagaaaggaaatgtttgggttgtgataagaggctgtggagaccaaagttttgtcatgcacataaagcctccaggtggctggcttcaaagagaatagattgtaaatgcttcttatcagaaaattaacaaaggtattcaggacttgaactcagctctggatcaagtggacctaatatacatctataaaggccaatgacattatgaagaaactatcaattaatgtgcaaagtaaccagctagcatcacaatgacaggatcagagtcacacataacaatattaaccttaaatgtaaatgggctaaatgccccaattaaaagacacagactggcaaactggataaagagtcaagacccattgatgtgctatattcaggagactcacctcatgtgcaaagacatacataggctcaaaataaagggatggagaaaaaattatcaggcaagtggaaagcaaaaaaaaagaaaagcagaggttgcaatcctagtctctgataaaacagactttaaaccaacaaagattaaaaaaaaaaaaaaagacaagggcattacataatcataaagggatcaattcaacagaagagctaactatcctaaatatatacacacccaatacaggaggacccagattcataaaacaagttcttagagacctgcaaagagacttaaacaaacaccccactgtcaatagtagacaagacagaaaattaataaggatattcaggacttgaactcagctctgcaccaagtgggcctaatagacatctacagaactctccaccccaaatcaagagaatatacattcttctcagtgccacatagcacttattctaacatcatccacataatttgaagtaaaacactcctcagcaaatgtgaaagaactgaaatcataacagtctctcagaccacagtgcaatcaaattagaactcaggattaagaaactcatgcaaaaccacacagctacatggaaattgaacaacctgctcctgaaagattcctgggcaaataatgaaattaaggcagatatcaagaagttctttgaaaccaatgagaacaaagagacaatgtaccagaatctctgggacacagagattctgctaaagcagtggtaagagggaaatttatgcccactaaatgctcacatcagaaagctagaaagagctcaaattgaccccctaacatcataattaaaagagttagagaagcaagaacaaacaaatccaaaagaagcagaagacaagaaataactaagatcagagcagaactgaagaagatagacaataaaaaatccttcaaataaaaaaaatcaatgaatccaggagacagttttttgaaaaaaaaaaaaaaaactaacaaaatagactgctagctagattaatgaagaaaagagagaagaatcaaatagacacaataaaaaatgataaaggggatatcaccactgaccccacagaaatacaaactaccatcatagcatactataaacacctctacacaaatgaactagaaaatctaaaagacatggataaactgctggacacatatgcccttccaagactaaaccaggaagaagtcgaatccctgaatagaccaataacaagttctgaaactgaggtaataatagtatgccaacttaaaaaaggccaggaccagaaagattcacagtcaaattctaccagaggtacatagagaagctggtaccattccttctgaaactattccaaacaattgaaaaggagggactcctctataactcattttatgaagccaacatcatcctgataacaaaacctggcagagacacaacaacaaaaaactttaggccaatatccctgatgaaaatcaatgtgaaaatcctcaataaaatactggcaaactgaatccagcagcccatcaaaaagcttatccactaagatcaaattggcttcatccctgggatgcaagggtggtccaacatacacaaatcaataaacataatgcatcacataaaaaaaaccaatgacaaaaaccatatgatcatctgaatagatgcagaaaaggcctttgataaaattcaacatcccttcatgttaaaaactctcaatacattaggttttgatggaacatatctgaaaataataagagctacttaggacaaacccttagccagcattatactgaatgggcaaaagctggaagcattccctttggaaagcagcatgagacaaagatgccctttatcaccatttctattcaacaaagaattggaagttttggctgggacaataaggcaagagaaatacataaagcatattcaaataggaagagaggaggtcaagttgtctgtttgcagatgacatgattttatatttagaaaaccccatcgtctcagccccacaactccttaagctgataatcaacttcagcaaaatctcaggatacaaaatcaatatgcaaaaatcacaagcattcctgtacaccaacaatagacaagcagagagccaaattatgaatgaactcccattcacaactgctacaaagagaataaaatacctaggagaacagctaacagggaggtgaaggagagctacaaaccactgctcaaggaaatcagagaggacacaaacaaatggaaaaacattccatcctcatagataggaagaatcaatatcgtgaaaatggccatactgcccaaagtaatttatagattcaatgctattcccagcaaactaccattgacattcttcacagaattagaaaaaaatactttaagtttcatatcgaacaaaaaaaaaaagagcccatataaccaggacaatcctaagcaaaaaggacaaagctggaaccatcctgctacctgacttcaaactatactacaaggctacagaaaccaaaatggcatggtactggtaccaaaagagacatatataccaatggaacagaacagagactttagaaataacaccacacatctacaactatctgatctttgagaaacctgacaaaaaacaagcaatgaggaaaggatttcctacttaataaaaggtgctgggaaaactggctagccatacatagaaaactgaaactggaccccttccttacaccttatacaaaaattaactcaagatggattaagacttaaatataaaacccaaaaccataaaaacccgagaagaaaacctaggcaataccattcaggacataggcatgggcaaagacttcatgatgaaaacaccaaaagcaatggcaaaaaaagccaaaattgacaattgggatctaattaaactaaagagcttctgcacagcaaaagaaactatcatcaaagtgaacaggcaacctacagaatgggagaaaatttttgtaatctactcatctgaaaaagggctaatatccagaatctacaagcaacttaaatttacaagaaaataaaaaccccatcaaaaagtgggcaaaggatatgaacacacacttctcaaaagaagacatttatgcagccaacagacatgaaaaaatgctcatcatcactgatcattagagaaatgtaaatcaaaaccacaatgtgataccatctcataccagtcagaatggcaattattaagaagtctggaaacaatagatgctggcaagactgtgtagaaataggaaagcttttacactgttggtggaaatgtaaattagttcagccattgtggaagacagtgtgacaattcctcaaggatctagaaccagaaatatcatttgacccagcaatcccattactgggtatataccccaaggaatataaataattctactataaagacacatggacacatatgtttactgcagcactatttacaatagcaaagacatggaaccaacccaaatgcccatcaatgattgactggataaagaaaataggcacacatacaccaaggaatactatgtagccataaaaaggaatcaaatcatgttctttgcagaaatatgcatgaagctggaagccatcattttcagcaaactaacacaggaagacaaaaccaaacactgcatgttctcactcataagtgggagttggacaacgagaacacatggaggggaacaacacacactggggccagtcaacaggtggagcaaggggagggagagcattaggacaaatagctaatgcatgcagggcttaaaacctagatgacaggttgataggtgcagcaaaccaccatggcaaatatatacctatgtaacctacacattttgcacttgtatcctggaactttttaagttaaaaacaaaacaaggtattcaggcaagaaatagcacaataaatagaaaaatacctcacatctcaatactaacattgaatgtaaatggcctaaattctccaattacaagatacggaatgggccgggtgtggtggctgacacctataatcccagcactttgggaggccaaggcaggcagatcacctgagttcgggagtttgagagcagcctgatcaacaagaagagaccctgtctctatgaaaaatacaaagttagccaggcgtggtggcacatgcctgtaatcccagctactcaggaggctgaggcaggagaattgcttgaacctgggaggcagaggttgcaatgagctgagatcgcgtcaaaaaacaacaacaacaacaacaacaaaaaccgaatggcagaatgattaagaattcaccaaccaagtatctgctgtcttcaagagattctcttgacactaaagagtcagtcacataaacttaaggtaaaggggtggaaacgatattccatgcaaatgaataccaaaagcaagcagaagcagttattcttacatcagacaaaacaaactttaacagcagttaaaaaggactaagagggactatatatgcacctaacactggagctcccaaatttataaaacaattactactagatctaagaaatgagatagatggcaacacaataatagtgggggacttcaatacttcactgacagtactagacaggtcatcaagatagtcaagagaaagtggacttaaactataccctagaacaaatggacgtaacagatatttatagaacattctaacctgcaactgcagaatatacatacttttcatcagctcatggaacattctccaagatagaccatatgataggccacaaaagaagtcttagtaaatttaagaatatcaaaattatatcaagtattctctcagaccacagtggagtaaaattggaactcaactccaaaaggaacctcaaaaccatgcaaatacatggaaattaaataacctgctcctaaatgatcattgggtacacaatgaaataaagatggaaatttaaaaattctttgaactgaacaatgatagtgacacaatgtatcaaaaccattgggatacagcaaaggcagtagtaaaaggaaagttcacagcattgaatgcctatatcaaaaagtctgaaaaagcacaaatagacaatataaggtcacacctcaagaagttcgagaatcgagaacaaaccaaacccaaacccagcagaagaaaagaaataaccaagattagagaagaacaaaataaaattgaaacaaaaactacaaaagataaatgaaacaaaagctggttccttgaaaagaaaaataaaattgatagaccattagcatgattaaccaagaagagagaagatccaaataatctgaattagaaatgaaatgggagatattacaaccaataccatagaaatataaaagattgttcaaggctactataaatagctttacataataaactagaaaatctagaggagatgaataaattcctggaaatacacaactctcctagattaaatcagaaatcagtggaaactctgaacagaccaataacaagcagtgatatttaaatggtaattaaaaagttaccaacaacaaaaaaagtcaaggaccagattcacagctgaattctatcagacattgaaagaagaatcagtaccaatcttcttgacactattccaaaagataaagagggaatcctccctaaatcattctaagaagccagtatcaccctaataccaaaagcaggaaaggacctaacaaaaaaaaaaaaagaaaaaagaaaactaccgaccagtatccctgattaacatagatgcaaaaatcctcatgaaaatattagctaactgaatcctaaaacatatcaaaacaataatccatcatgatcaagtgggtttcataccagggacgcagggatggtttaacatacaaaagtcaataaatgtaatacaccacataaacagaattaaaaatcacatgatcatctcgatagacccagaaagggatttgacaaattccagcatccctttatgattaaaactctcagtaaaatcggcctagaagggacataccttaaggtaataaaagccatttatgacaaactcacagccaatattatactaaatgtgtaaaattgaaagcattccccctgagaactggaataagacaagaatgtccactttcactacttctgttgaacatagtactggaagtcctagcaagggcaatcagacaagacaaagaagagacatccaaattgggaaagaggaagtcaaaaattgctgtttgctgatgacatgatggtatactagaaaaccctaaagactcatccaaaaagatgagttctttaactcattttttggaaccctaggagttctaaagattcctataactgattaatgaattcagcaaagtttcaggatacaagattaatgtacataaatcagtagccttgctatacaccaacagtgaccaagccgagaatcttgaactcaacctcctttatgatagctgcaaaaataaaatacttaggaacatagttaaccaaggtgaaagacctctacaaggaaaagtacaaaaccctgctgaaagaaatcatagatgacacaaaaaaatgaaaacacatcctatgctcatggatgggtagaatcaatattgtgaaaatgatgatactgccaagaacaatctacaaattcaatgcaattcccatgaaaatgccaccaacattctacacagaactagaaaaaacaatcctaaattttatatggaacccaaaaagaggccacagagccaaagcaagactaagaaaaaggaacaaatctggaggcattacattacccaacttcaaactataaggccatagtcaccaaaacaacatggtactgatataaaaacaggcatatagaccgaaggaacagaatagagaacctggaaataaagccaaatacctagagtcaactgatcttctacaaggcaaaccaaaacaaagtggggaaaggacattggcaagccacaagtggaagaataaaactggatcctcatctctcaccttatacaaaaactcaagatggatcaaagacttaaatctaagacctgaaaccataaaaattctagaagataacgtaacataagaaaaacccttctagacactggcttaggcaaagacttcatgaccaagaatacaacaaagatatatgggacttaattaaattacagagcatctgcacagcaaaataaatagcagaattaacagactacccatggagtgggagaaaatcttcacaatctatgtgtccaacaaagtactaaatccaaaggaactcaaatcatcaagaacaaaacaaacaattacatccaaaagtaagctaaggacatagacaattctcaaaagaagatataaaaatggccaaacatgaaaaaagtgcccaatataattatcagggaaatgcaaattaaaaccacaatgcaataccagcttcctctggcaagaatgacataataaaaaagacaataaataataaattttgggtggatgtggtgaaaagggaacacttttatactgctagtgggaatgtaaacctgtacaaccactatggaaaactgtgtggagatttcttaagtaactaaaagtagatctaccatttgatccagcaattccactcctgggtacctacccagcagaaaaaagtcattatacaaaaaagatatttgcactcacatatttttagtggcacaattcacaattgcaaaaatatggaaccagtccaaatgctcaactagtggataaagaaaatgtgatttatatatatatatatgtgtgtgtgtgtgtgtgtgtatgtgtgtatacatacacacatacacacccacacacatatacacacacaccatggaatactactcagtcacaaaaaggaatgacataatggcatttgcagcaatctggttggaattggataccattactctaaatggagtaactcaggaatggaaaaccaaacatcgtatgttcttactcataagtaggaggtaagctatgaggactcaagggaataagaatggtacaatggactttcgggattcagaggaaagggtgggaggggggtgagggataaaagactacacattgggtacagtgtacactgcttgggtggtgggggtaccaaaatctcaggtatcaccactgaagaacttattcatgtaaacaaacactacctgttccccaaaaacctaaatttaaaaatgttaaacaaattgacaaaactaactaaatcaactagattcccttggctattatcaatggcctggatagcaatcagatccactcctactgtaatattcaatttaacccctaataaaatagttactgagagactttcgtacctagtaatagaacctcatgtatctcttatgcttgtaatctctgcttatgactaaatactagaaggctttaacgcattatgccaaaatgtatttttaccaactaaaagccgccgcccactgggaacaatcagaactttcatcatctagtacccagagattgggccttttggaaacgacaccagagaaagactgcccttgagctctgttggaaggccatgccagattttcaccaccaataactgcagtaaaacgtcagggcctcaaatcttgggttcacatctctcaacccaagagggtaccttcagacttttggaactttacacccgttgcagatcaaggtaaaactgaccaggcaggtttctactcagaagcagatgacatccaagatgtggaaagctttcctaaaatcatggaccaagtcgtcttttctattttttgttttgttttcttcatgaaacacttgaccttttccctgtgtttcttttctgtttatacatggaaaaataatgtgataataaagatttcacaattgatagcatccatagggaacttaattgaatattggatatgttatgtcaaaactaaatcctacatgatctagatactctagttcaccatgtaacaaattgcatgtgatatccccagtgtgactatttgttccaattacacatgtaattctttctataaagttaggcttctcaatttagatgttcagattccttgcttaaatctaacagtagggaaaacctgtagtgaaattttcagttaaattatgccagaaattgaataataaaaccaaaacttacaggagagataatttgacagcttgtaggtaaatttataaccctcatatatttgagatatttgtcccctccaaatctgatgttgaaatgtaatctccagtgttgtaagtgggatctggtagatggtgtttgggtcatgggagcagatccatcatgaatggcttggtgccctccccatggtaatgagtgagttctcactctgttagttcatgtgagatgtggtggtttaaaagagcctggcatctttctatggcttcctctctcaccctgtgacatgcctgctcccccttttgccacctaccataattgggaacttcctgaagccctcaccagaagcagatgttgacaccattcttcttgcacagcctgcagaactatgagccaaataaacctttatcaattacccaggctcaggaattcctttatagcaacacaaaagagaccaacacaaaccctcattccttaattaccgtaccatctaacaatgcagtgattcaaataatggag

SEQ ID NO: 2473 - DNA, 768 bp, Homo sapiens
gtccagtccccaggggcacccccacacacttcctgccactgggtcctgccagggaggcaggggttcattccaatgcaggccagagcccggcacacggcctgcgtccctgcccccgggaaaggaaggagctgcccccagccctacacctcccagcatccctgttccaggccctccccacccagagtttttcctccaatggaggccccaccccagaggggagacggtcagtgaccctgcttcagttctgaccttggccaggcttaaagcctccccttccacccccgccccgaccggcagcagccagttctgggctctgctctgtgcttttgttcccggctgggtgaagggggcaggcgagagctaggttcctgctctcctgaaagcctcggaggcccagagcggggagcagcgggcctgcaaccagggaaccctgaaaggaagcgggtcctctgtaagatggggctgcatccctgccccgctcccagcagcatggggtcagatgcaaaaactgaggctcaggggagtgaagtgacccatccaaggtcccacagcttgtccgtggcagagctgggtttcaaccccaggtaacagacaccacggcaatggtccctgggactcagggcatcttgcaagggagggccttgtcctcatgcctgccataaagaagctgccagctactggtaacctaaaggattcttgtttccggccccaggctgggggttccctgcacagcaacttgggcctgccaaggtcacccagataattcag

SEQ ID NO: 2474 - DNA, 1321 bp, Homo sapiens
gttttcagaaggccttttgctttcttaaagatttcaaacgatgattgtagttaatctggctgcctgtttgaaaaaccatcagataaatgcccacaaggctctcatctttcagtagcttagctgctgcttgtcagattctaaactccaaagtgcttgactcttccagtgcccaaactaatccttgtttaaattatgtcttcagaagctataactcttatagtggcttgctaaatgataccctttggatctgggctgaagacttccagaatgcccaagtgaatttcaggagcgggctcaatgtttaaccaaattcacctttaccaagggctattcaatccatatctgggatgttttaaataaaactatccaggactgtgggcaatattcaaagttaatatttgttgccaatatgtttggagtgcaagataaagcattataatgtctagacatttttgaaataaaaaagtcttctggttaccaaaaggcattattgtcataggtcatgcaactcagaggtgaaacttgagaaaacagaaagtgactaccaacaggtgacacattgagaagataattaggaatttcctcaatcatacagccctcagcacccatttctcacatcaaaatagaatggtggagccgagtgcggtggcacagcctgtggtcccagctactctggaggctgaggaagatcatttgagcccaggagtactggtctggagcgaactatgcctattgggtatctgcagtaagctcggcatcaatatggtgacctttcgggagtggggaccaccaagttgcccaaggaggggtgaactggcttggtgggaaacagaacaggtaaaaactccatgctgatcagcagtgggactgcatctgtgcatagccactgccctccagcctgggcaacacacaagaccctgtctctaaaaataaataaataaatgaatggaatagaagagaatattgaagacaaggggatgaaggcatgattttaaatgactaaaatggtctgggcatgagccactgcactcagtctcttttgatgttttttaactgatcaactaggtgtgaacagaactggatttttttccccgaagagctgaggctgactggggtgtgacctccttagctgtgtagactgcattgactctactgtgcctagaatttggacaatggcctgagggaccagtatgtgatttaagcataattaaaaggttatacttgagggatagacctgaatctggaagacaactgctaattttctggggcactgaggggtttttgttttgttttgttttttgagacagggtcttgctgtcac

SEQ ID NO: 2475 - DNA, 5356 bp, Homo sapiens
ggaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaaggtactttaacatgtttttatgacatcgtaaaccagggtatcaaatcaccctttgccataaaatctgttctagatattatgtgaagttttaatttttagttaagagattaagataggttctgtaaagtagcagggactaaaaatttaaagttttggtgtttatacccaatatttcaaactattgttgaataatttggatcagtcaagattacgagggacaaagtgttaagtggtagaatatgaaatgcagctgtgttttttgtttacccttgtgtctctaataggaatttattagcgcttttaacataattagaataaggtgaaaatcttaactttcttgaaagactcaccggtttactctgttatcatatggtagcagttgtaaatttccttattttctggtcttcttcatcttctaataaatatccccaggttcttatgacactcttctagaaattttgggctaagaaactttaggtggatggccaggcatggtggctcacgcctgtaatctcagcactttgggaggctgaggcaggtggatcatctgaggtcaggagtttgagaccagcctgaccaacatggagaaaccctgtctctactaaaagtacaagattagccgggtgtggtggcgcgtgcctgtaatctcagctactcgggaggctgaggcaggagaattgcttgaatgcaggaggcagaggttgtggtaagaggtcatgccattgcactccagcctgggcaataagagcaaaactccatctcaaaaaaaaaaatgaaaaaaagaaagaaattttagatgttgataagataagtaatgcatgtaattaactctttgtctcacctctaaacaggaagtacatttcttgatatttacttgtttagaatgaagtgggtagaaaataaatcagcatttataaaaatgtttttaaaataaagttccttggggatagtttactggaaaattgtcaacattcagtctcttttatgttgccttattgtacacaagaaaaattgacatatgttgtaagttcagcccagtgggtttattaaaaatgttggtagtggtgtactaacaccagacagctctctgggatcagagtgacagtagcagcctgtggaaatttctctttgtggaagtgccgatttttctggctggactaatagggaatctccttgtccagaccccgagctttgggattatataaggaaggagcactcttactgatttgtactcttcttaggtgatctttggtgttgataagacatgctttttttctaatgtcataataataaatataagttaatgttggtatgatccagaactctcatctcagaaatgcaataccattattgtgtaaaatgtagttactgatactgaaagaatgtcagaccctatgggcctttatgggaacgtggagaaaaaagaagggaggtaaatgagtaatgaacacacccatacaaaagtagccctctttatggtcttttgcactacagaactctcttttttctttttctttttttctttttgtaggtacatagtaggtgtatatatttatagggtacatgagctgttttggtacaggcattcagtgttacagaaatcttttcaatagccaacttaagattgagtatagtgtttatgattgtgttaattgtattcaactattattagtgcttttgtgatttttgtcagtctgttttagatttgatttttatcccattgcctaccacaatgcaggtattcagtaaaactcagatatttgatgaattaattgataatggacttcttacattaaaattataaagacacaagagcattaggaaagtaacactagccacaaagctaagagccaaagaactctgggttcagtcataggtttgccatttatttgtaatatgtccttggcaaattgcttaactgctctgtgattcagggttttttcatgtattagactggcgaaaaccaactttataggtttattgtgaagattgaatgaaagggtgtgcatggaccacttaccatggtgttgggaacataaaatgttaaccaccataatgaagacactgatcatgatgatgatggtgattgataaaagcaggcctatctgttgaaggactctgagtaactccatattaattgaataagattgtggagttttaaaattatttcctatagtatttaggaacaaggatttgtttgtaatggattttttctaattagtaatgcatttatttgtttgttacttgccagataatcaggaaaaaatatttttaatccatgagtagcaccaaacagtatctataaaagtactcacaatatagcctgggaagtcagactcaaggaacagggaatgaaaggggaaagatgtaggaaaagattggaaaatacaagatgcatgtggagctggcggcctgtgtgcagatgctattagtaattgcttcaggtgccattgatgaagatgggtcagagtttccctaaccttgctttacgttaaggtgaaagaacttctaaaacttttctttacatttctgtatgattgccaacttttttgttaatgaagtagtatctttataaatacctgctgaaagattttgtggcttgattttatttttatgaatttttttacttattttgttttgttttgtttttagagacaggggtcttgctaagttggtcaggttggtcttgaacttctgagctcaagcgttcctctcacctcagcctcccacctcagcttcccaagtagctgggactacaggcatgcaccaccctacccgacttgtttactctttcactttgtttctctttctctctctgtctctctctctttttgcagcttgattttaagaacagactgtcaagtcagtcagtgattggatgtaaagaaaaatcatctaggtagaaggaggcatattttagaagagtctccaagagataattatcatagccctttatggtcattattatttttcttttgtaaagtttctcttgtaagagttttacaaattcttaaaagtgatgtattactggtactttttagaaacatttatgttatgcttgattatgtgtggttatggtttgtatctgtataattaggttcaatagactgacataattttctcttaaaagtataaattactagacaacagtgttgacctttacagctatataaggcagctacatataagtagcctctttattttcctcattcaaactttgtgcctgacttcccgaaccattattttcaagttttttttccccttttttaaaaaatagccaatctttttctttagatttattgtgtacgacttgtcacatttgtcagctaggacaaggaaaataataataaacattcattatgagataaaatgatgatagcagtagtaccttttccctgatatagtaatcatttctatctatttagttacttttaaatgagaaataagttgatcaaaccatgttttctgtatgcttgaaaccatctcccataaaacgttttttaaaattggaattcacttcaaatcatgtctgttgcaaatttgctctgtttggggaaccttgccagggactgcagtggttttaaagtctaataagactgtcgggccggacgtagtggctcatgcctgtattcccaacactatgggaggctgaggcggcctgatcacttgagcccaggagtttgagaccagcctgggcaacatggcaaaaccccatctctacaaaaattagccaggcatggtggtgcatgcctatagtctcagccactcagaaggctaaggtgggaggatcacttgagcccagacggcagaggttgcagtcagcccagatcgtgccactacactctagcctcggtgacagagcaagactctgtctcaaaaacaaaagcaaaaatctatcctctggatttaaggaatttcaaggcaaattagtgatagtacattttttaaaactttgtattttccttgtgcctcaacatccccacaaacaggccgtgaacactctgccctggcaaccagatgcaccagtatgataaggctggtccctgccacaagttccccttcataaccttccctggcagtgccctagtgaaatttaacgaaatcacctcatgccttttgtttgtgtatcctgacccccaatacaagcatttgcctacaggtcctcactctatcagttatacctatttggctgaacccattctttgggcttctcccatatggttccctgcatggtgtaccttgcctccctctctaggacctttgagtataataaatcctttaatttcatttacctctccaagtataattcccacagctatgttggagtgatccttgaggaccccacagggagacttactccctcccccatttaccacacagagagttatagatgataagctgattattggtggttgttgccatcagcagtcaaagaaaagagaatgcccagggtttttttgtttgtttgtttgtttcagaggatagagaagaaaggcattttgagtttcatgggacaagagtcatttgaaatgactctataaatagtgtgtcttaccatatgtgatatattcagtgattaagaaaaactaaacctaaatctgatcaagactctagctccaactgccagtttgcaggacatacaaagaactaggcacatattctaaatgatgtgatggggatacaaccagcaaaatccagaatgtggaagattctacaggacatacaacccagtttctttagcaattaaattagaaggggaaaaaaaggaaaggggatgggggaaatcctataaattaaaagagatttaagagttatgtcggccaggcgtggtggctcacacctgtaatcctagcattttgggaggccaaagtgggcagatcacttgaggtcaggagttcgaacctagcttggccatcatggtgaaaccctgtctctactaaaaatacaaaaaattagctgggcttggtggtgcacacctgtaatcccagctacttgggaggctgaggcaggaaaatcgcttgaacccgggaggcagaggttgcagtgaaccaagatcatgccaccacactccagcctgggtgacacagcgagactccatctcaaaaagaaaaaaagagagagagatgtcaactaaatataatgtatgaaccttgtatgaatcttcattcaaacaattcaactgtaaaataaatttggaacaatggaaaattttaa

SEQ ID NO: 2476 - DNA, 12475 bp, Homo sapiens
cccctgtcccgagcgccccctgccggcggagccctgccaggcctttccgaccccggccggttgaggacccccggaaagaatctggaatttccagaattaatgtgttgtccctaaattgggctccacgaggtgcccttcgctgtgttccccaggccaagcagggcagcccctcaaaaggggacgcgggaggcctccagagggccacaccgggggccctgcttcaaagctatctgcggagacaggcctgggccctccctggacagacagcggttgcccgcgcgaggtggggccccgcagttcctcgtctcctgactcctctcctagtgcgtttgcttgaagcagagcgcagagttgagcccacaggcgggggaccgcggcttcgcccaggccagcgcccacagactttcagcaggggctcccggggagcctggaggccggccaaccccagcctcacatccccaccggccgtctgtccttcgtggccccagtccggctccccttccccctgtgctcccaggagcttcctttctcccttctgccgtcactaaacatggccctgtaccgaccgtcttgtcctcgtgcggtcagcttcctccccttggttagtctttgtgtgccccctgccctctgaggcccgcacacctcctcattgtccaatctcctgggccctttcattcctggaagctcacttctggcttcctctccaccctcaacctgtctgtcctctagggaatttgtgtagtacagggtcacctacttcctccatctcatctccagtgactccacctcagccatcaggtctcagggccaaagcctgggctgtgtcatccctcagaactgctccatcttggaaatccgaagctcaggtgcccccctgtcagacccgactctgcagtcctttccaccttcacagtcccactatgtattgctcttcctccagtcccttgataccttcctcttcgcccaacctaccagcccctcctggcttcacctacttccctcccagctacatctactgcttgactcctggcccctacccaaccaccttgcatttcttccccactgcttacaccagctggtcttgctgctcagtgacatggacaattcagaccaccacatcctaccatgcacactgcatacaatgagcctttgtagctggcacccactcacttctccctccatctggacacagtgaaacaggtgccctccagcagtcagagacaatgcttccaccagggctctgtggctccctcccctcctgtctcctcaaaggtcctgctccaggtgtcccccgctttccttggtctccttgggttggtgaccgtcagtctaaaaacattcttgtcttcctcctattaaagatactgataatagctgggtatagtggcacaggcctgtagtcccagtgatactcaggaggctgaggagggaggattacttgaacccagaagttccaggccagtctgggagacatactgagacactgtctctagggaaaaacaaacaaacaaacaaaaagcaggcaaggtgcctcacacctataatctcaacactttgggaggctgaggtgggagggtcacttgagccccgagtttgggaccagcctgggcaacatagtgaaacaccgtctctacaaaaaaattaaaaattagcccagcatggtggcatatgcctgtgatcccagctatttggggggctgaggtgggaggatcacttgagtccaggagattgaggctgggccaggcctggccccaccaatgagcagtagccaagatcacgccactgcattccggcctgtgcaacaaagtgaggccctgtctcaaaaaaaacaaaaaaagtactgataatacccctccatggactgggtgtcccctctaattcccaccccacatatctgctccctgtcttagtcaaacttctccctcaaggttgtctagattcccccttttcccatttgtacctcaggctaagcctcttgtccccccatcttggtgtcaaagccaaattccttctccaccttgacctgcacagtgcattctagagataccctccctgttcacatacctccactctgccctcatcacctggcacatctcttcttcactccataagatcaagtatgcactgcagacccaggggacacagctgtgaacaggtggataaggtctctgtgagctcccactctggaggaggccatggacagcaagcaaatagacagatgtataaacaagaccagctacagagaggtgctttgaagaaaataaaaccggaagtgactagagtctactttccatggggtggtcagggaaggccttcctaaaaaggtgacatttaagctgtgataccagaatgacaaaaaggagccagtcatgtgaaggtgggcataaacttgttgtcctttcagacctaggctgtacgtcaccccttccagcacgtcccccctgacctcttaggttccccagagcaccctttgccatccccgagctcactagactgctattgtctggttatgggtctgtcaaccccgacacaccgtgagatgctaaggtcatgtcttggtctttgtgatccctgccaccagcacagcacagccctccctggccaacaccacaaactgcctccatgctgccaaggcccaacagtagattggaggcttttttgaaatgcagccttgtgagatctatgagggcagagaatctttattttgctctctaatgtgtcctaagtacttcgaacagtggctggcgtatactatgtgttcaatagctattttcaatatttaaataaatgttacatgattgatattccattatgtgcatatgccattatcctcatctcctactgaaggatatttagattgtttccaatctctttctggccatgtccatcccatgtgagtacatctttaggatgaagtccttgaactgagattgctgtcagaaatgtgtgtatttgtaactttgatagacaggtattgccaaattaaagacattatttttggtgggtcccttccaccccagtaaaattgcaaaatgatcgaaaatgccagtttaggttgcagatttctaaacaaggatgctcaaaaaagctccctcataagacagaactgggcggagtatgagctggccttgaaaatgtatgggatgattgacttggaaagggatgctgagctgccactgtgggcctgattagtcattgttctggaagccctggagacatggatgttttcaatctatccccattctctagagcactgcggccttccatggccacagctgccccacactgtaggggagaaatgccacaggaagagtcatgaaaattatccacattgagatttcagagccatcagttagctgatgggaaaaaggctcatgattggcttctactgcctttgagccgccacttgggcagtgagaatgatgatttgatggaggcaagttgagatagtgaaggaatgctctatcctatcttctgtcactgtgccttacacacaatgtctcatgtaatctttccaacatgaagcagatattattttcctcattttatggatgaagaaactggggcatggaaaggttaagtaacttgcccaacgtcccacatttggaagtgtcggggccaggactggcctaattccagtgcctggatttctaatcgctccatatcactgcctctccaaattaccaatttcggcttctatcattaaaggatctgtttcttcaggactcctccttttagagttgtttccggtcagacagctcgatatatgggaggctgccacatccccttcaccagagactcattgatgaacacctactaagtgctaattgccaagagccatgatgatttccaaagggacccttaatgatagctatcacgttctttcctgcagtcaaatcttatcttcttcacttctagctcatcaacaccaagagggtatgggccatgtctgatgggctggtgcttagtaggatctcagaaaactgctgtctgagagtctaaccagcactggaagtgtgagccagtgcaccctacctgacccttgtcctggcacaaacccaaccatctttgggtttctttaccaccttgatgctatagctattggcttggctgtttcttcttctttttaaaattgtatttttcttctttgttcacaccattgtttcagcaatggatgttccatatttttgtgtctggaaataatttgaaaacttttaatgcttttctattgtgtttactgaatatttaggatttatcttttattttttcatgcattttactaacttttgtaaagaaaatatttgttttcacatttaaaaatcagaatccctgctgacaataatagataaaatgaattacatggatcttctttctttttttaaatcaataagtcatttcactcttttatttatctaacaaatactcactcatttctgctgcctgccgtacagcttagacaagaaaaacagcatgagccttattttgaaactgctattgccaacataaaaagtgaagttggttatataattttggggttgggaagaatattttaaagatgaaatcaacagcaaaatctgtaggaaaacagtttatagatgtgcctgcatgaaaagtaaaaacttgtccatatcttaaaacttcataaatccaacatccaaaaaataggagacctagcaagatcagaggaaacagagggaagactatcaaataaataatacaagaattttctcagaactgaagcacatgaatttctaaatggttttactggcttccagcacacacacaaaaagacccacaccaagacatgatatcttggcgtaccgtaactcttggatattagagaaaattgtttccagattttccagagaaggaagaaaaatagtcccaaagactctgtaattggagtgcaaacagaattctcctccagcaatgctacagattagaggtaaacagagcaatgccttcaaaattctagggagaatggtttcccaactcccagagtcttgatcaagtgtaagaaggtggaataagaacactttaagacatacaagctctcaaaatatttgccttccatgcaccctttttccaaaagttactagaggttgtgctccaccaaaatgaagaagtaagtcaagaaagagaaaggctgaggacctaaggaacagatccaacacaaacataaggtgatgggagcccgcagaataatagtaaaggtagattctgggatcacagctggtgagtaggccagaagagacaccagtccagacagaaacaggaaggcagagacctaggagggaggcaagaaaggaacaaaacccaaagaaatagagattattggctctatgaacaggaacccacaaaggcttaattgcaaaccatctgaatgaccaattgtaacacctcgtggtagagacaagacccacaggcctggctcagctcagctgcctccctccaggctagattcaggatctggatgttcttaaggtgagctgcacataatgatggaatgggtggcaggctctggagttaaatgtagttgggttcaagtcccagctctgctatgtgttttttgtttgtttgtttttgagatggagtctcactctgtcaccaggctggagtgcaatggcgcaatctcagctcactgcaacctccgcctcctgggttcaagcaattctcttgcctcagcctcctgagtagctgggactacaggcgcttgccacaacacccagctaatttttgtatttttagtagagacggggtttcaccatgttggccaggatggtctcgatatcctgacctcgtgatccacctgcctcagcctcccaaggtgctgggattacaggcatgagcactgtgaccggccttttttttgtttttgtttttcagacagggtcttgctctgttgcccaggctggagtgcagtggcgtgatctcggcttattgcaacctccacctcccaggttcaagcgattctcctgcctcagaccccctagtagctgggattacaagcttgcaccaccatacccggctaatttttgtatttttagtagagacagggtttcactgtgttggccaggttggtctcaaacccctggcctcaagtaatccacctgccttagcctcccaaagtgctgggattacaggtgtgagccactgcacccaaccaatccttctgagtcttaaatccttactataaaaaaagagctggtggctgggtccagtggctcatgcctgtaatcccagcactttgagaggccaaggcaggaggatcacttgagcccaggagttcgaggctgcagtgagctatgatcacagcacttcactacagcctgggcataagagctagaccccaactcaaaagaaaagggcaggggattaaaataacgactcatgatataataatgattacagtaacaccctatgacattaaaataatgccccaaatgagatgatatatgtgaaagtactttgtaaactagtgtgagtcacagtggaagttccttagcaacctctgccaacctaactcactacaacaccaccaatctcccagtaaaacacagagactaatgcccagccatgctagcccattgctactagtacagtatcgtttccttccctacattaaatgtggccctttggaccaacagcagagcatcacctaggagtttgttagaaataaagcatctgggccaggcacggtggcccacacctgtaatcccaacaccttgggaggctgaggcaggcggatcatgaggtcaggagttcgagaccagcctggccaatatggtgaaacccatctctactgaaaatacaaaaattagcctggtgtggtggcacgcacctgtagtcccagatacttgagaggctgaggcagaaaaatcacttgaactcgggaggcagaggatgcagtgagctgagatcatgccactgcactccagcctaggtgacaaagtgagactccatctcaaaaaaaaaaaaaaatgaaaaagaaaagaaatacagcatctggctgggtgtggtggctcattcctgtaatcccagcactttgggaggctgaggccagaggattgcttgagaccaggagttcaagaccagcctgggcaacagagcgagaccctgtctctacacaaaatcaaaaattagccaggcgtagtggtgcatgcctgtagtcccaactacttgagaggctgaggcaggaggatcacttgaacctgggagctggaggttacagtgagctgtgattgtgctactgcactccagcctatgtgacagagtgtgatgctgtctcaaaaaacaaacatacatacatacaaacaaacaaacaacagatatactatgtccttctgaagggaggaaggaaaattaatagaatacaggccaggcacggtggctcacgcctatagtcctagcactttggaaggccaaggcgggtgtatcgcttgagctcaggagtttgagaccaaccttggcaacatggcaaaattccatcacttcaaaaaatacaaaaatgagccagggtgtcagggagaggcaagtggagatagtttgagcctgagaggcagaggttgcagtgagccaagatcgggccactacactccagcctgggtgacaaagcaagagcctgtctcaaaataaaataaaacaaaatacagcatttaaaaacattattttatttttcaatttttatttacttattttttttgataccaagttatgagactggctaattttttaatttttggtagagacagggtttcaccatgttgcattatgttaattttctagttaaaagttgagcaaccctatgaggtaaacttactacaggttgagcatccctaatccaaaaatccaaaatctgaaatgctccttttgagcactgacctcatgccacaggtgaaaattccatacccgacacctttgctttctaatggtttaatgtacctagacttggtttcatgcacaaaattattttaaaaatatttatttctgtaaactgtttgagtgcagagatgttcttcacaatctcaatacagtacaaatttcttccccgaaacaaaatgagcaaggaaaagaaaaagagctatataaaatgtgcccatgaagaaccaagccaatctcatctttctttaaaaacaaaacaaaacaatccttttgaatgtgtcgtgcaggcctaggattgaggccgcaggcttttggggcaccatgagcccagggctttgctcaactcacagctagtgtggcaggcggagtagccccctagccccagccatcctcactgcttgcgcagaagcttcctgaacctaagggatctgttcccagctctccttaaattcccagtccccaccctgtgcctcgcttcctaacaccctcgtcgttttaggagtcccagaattgaatcctgaaatactccctccgtcaactctgggctcagacctttgtccttctctgtgtcacaaggaaatttcagtcgagagggcgggaacgggtgttttcagaccgtgcagcaaagccattgccaggcaagttttaaggcaaattttatctcttcttatttgatctgagccagacctaaccttctcaccaccaagcaatcctgcctctgctggacctacaacttaggcaactctggatggaggtgggatgagggagcccaggacagatttcgagaggtctgggaatggatgtgtgcatgcacaaaattatttaaaataatgtatagactgggcatggtgggtcacgcctgtaatcccagcactttgggaggccgaggcgggcggattacctgaggtcaggagttcgagaccagcctggccaacatagtgaaaccctgtctctactaaaaatacaaaaattagccaggcatggtggtgcccatctatagtcccagctactcaggaggctgaggcaggagaattgcttgaacccaggaggcggaggttgcaatgtgccgagatcataccactgtactccagcctgggcgacagagggaaactccatctcaaaagaaaaaaataaataaataaaataaaacaatgtataaaattaccttcacgctatgtgtataaggcgtatataaaatataaatgcattccatgtttacacgtagactccatccccaagatttgcattatacatatgcaaatattccaaaatccaaaaaaatccaaaatctaaaacacttctgatcccaagcattttgaataagggaaacccaacctttatctccaatgtacagacaagaaaaaatggagattaagtcccttgccagtaactggcagagccaggacttgtaggtagatctgtctgcctccaggtgccaggccccacagccattaccctattccctggagggaaatgccaaaagtgtagagaaaatacagatggtgcagaaacatttgagaaatgtacagccttgccagaaattaaaggaatgcaaatccaagcaaccgtggagcatttaccacctatcaaatttgcgaaggtttttgtgcttttgctatttaatttgctttacatccaagtaatacatgttcatggtttaaaagagtcaagttgtattacagaaatacaagctgaaaaccagcccactctgccctagcccatcaaacacacacacaccacacacacacacacacgcacacacgcactcatgcagtgggaggaggggaaggcccctgagccaggcctgtctccctgccatggccttgacctactgtgcttccggacctccccacttcctctgggctctccagggactccgggaatactggcctgatatttctgtgatcttcccagtgcagcaaagcaaggggccgagtggcctattgtggagatgggaatggggaatcagagggattatgcagcaagacaccaaaacttgacacagtcacctataatctcatggtgggaagttttctcaagggaaaaatcaacactggccacataatttgtataaaactacatgtggaaatgctatattttcattgcagtaataatataaagatgtatccccaaattgtgaccctctctcaccaataactgtttctcttgggagactcccctggtgtgcagattttaggagtgttgtcagcagagcacctcagggaaaactggacaggctcttcagagggaggcttctgttcacctgctgggtgggcctttgggcaagtcccctctctgagcctgcttcctcctgtgtaagtcaggatcacattccttgtctcacagagcagtcatggggaccagatgagatgatccttataaaatgcctggcactgggcctggcacatagtaaatgcccagccaatgcaaagaagctgcagtgagctatgatcaggccattgcactccagcctgggtgacacagtaagaccttgtctctaaaaacactcttagaattagaaggtgtctcattttacaaatgagaaaacagaccagaatgggacagttacttcattttacacagagtgttagggcacagagactagaacccaggccacttgacattcagtgacaacttccattcaaggaagaaaaagtcccaggcatcaggccctgctggaaggaaaccctgggaaagcatgatctaattttgcaaactttcgatcagattcccagttcatccaggctctggcctagtctatgtcttggtaagtaggttaatctcccctttcctaaccgctggggagagaatgtcacttaactgcagattccctgtctcctgggcaagcaaggcagaggcctgggagtgatggggagcctctggtggtggtgattgattgagggcaggagacatgagggagatctgccctctagggactacctcccagctcctggtggcatgttgtgcctgtgttctttttttttttttttttgagacagagtctcactctgtcacccaggctggagtgcaatggcgtgatctttgctcactgcaagctctgcctcccaggttcacgccattctcctgcctcagcctcccaagtagctgggactacaggcgcccgccaccatgcccggctaattttttgtattttttagtagagacggggtttcaccatgttagccaggatggtctcgatctcctgacctcatgatccacccgcctcggcctcccaaagtgctaggattacaggcgtgagcccggcctgtgcctgtgttcttgatggaggtaggaaagaaggaaaaggtaagtgcacagtatgccagggttgacatacagtgggagctccagactaaagttggcagagaaggtccagagagggccttcagcaaaacgggaggtcactctagcctctcaataataatcacaagaagaagagttccgcaccaggcacagagctgaaggctttctctctggaggctggttaattctcctatgaccctgatgaggggttatcagcatcttcttttacagataggcaagattaattagttaacccccggccggaggtgatggctcacacctgtaatcccagcactttgggaggccgagatgggtggatcacctgaggtcaggagttcaagactagcctggacaacatggcaaaaccctgactctactaaaaaatacaaaaattagccaggcgtggtagcaggcacgtgtaatcccagctacttgggaggctgaggcatgagaattgcttgaacctgggaggcagagattgcaatgagctgagatcccgccactgcactccatcctgggtgacagagcaagactccatctcaaaaataaaataaaatatgaaaaataaaaactggttatccccaagacacatacctggtaagtggtataaaggggaccatggtctcctcctcccctgggaaccctcccatccctaaactcataccccttccttgagtctcctgccctgcccttcagtctctgtcttgttaccctgctttgtttcattgtcactctttcccccatgagttcatctcatttatttgtttgtctttatcccccagtagaagacacactgcaggctgcatcctgcgtgcttagcaaggtggttggcacataatgggcatgcaatgaatgcttttggaagtaaacagagtggtggcagagggaagtcttttcttaggaagtgatatttgggctgaggccagagtgctgagaaggagcagccacatggtaatctgggtgaagggcattcttggcagagggaacagcaaagacaaaggcctgaggcaggccagagtggtgtatttggggaagggcctgtgtgtctggagtgaagtgagcaaggctcggagtggtaggtgacaaggtctaggaggtgggcagagagaccacagacagaggacttgtcaaccctggcatacagtgggattgcctaggcacttttaaaaataccagggctggctgggcacggtgcctcacacctgtaaacccagcactttgggaggccgaagtgggtggatcagctgaggtcaggaattcaagaccagtctggccaacaaaatgaaacccc

SEQ ID NO: 2477 - DNA, 1286 bp, Homo sapiens
agctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattcagcacgtgccttctgtgtgaatcagtttctcagtgg

SEQ ID NO: 2478 - DNA, 18397 bp, Homo sapiens
gcgacagagcgagactctgtctcaaaaaaaaaaaaaaaaaagaaaatgttctgtatgactttagagcactttacttattttctttcaccaaaataggaatattttgcaataattttaatatttctcctaaaatataagtttatttggaacttataactactgaaaaaattaaatatgtattttaaataatatgagctagttagacatattattaaggataggtacagaattctgaaggtagagctatgctcatcatatttttttgttgttgttagcagaaggaaaagattaaaagtaggaactatactgaaatgcaatatagagactgaatttgggtaggcaaagaaatagtgtacccttaaaacacaaaatgttaagtagccaactatattattttaaattgggtaggaaattttaagaggaaataattttttaaaggcaaaagcaagttgtcctgtatcaaaaacacaaactcttaaacaaatatatattcaattaaaaagtatacaaataggcacataaatgcctacaatacactattagaaatgatgagtttgattatttagaggtggcaattgtagaggcatagaagtcagaaggatggaaaagaaggaaagcaatgtattattctgtaggcactcccacattgcaaggagagcagtgagatttccccaatccaacacctccttgctcccgagcaagctctcaaaaaggaagctcctgccctctattgcccacaaaccacttcaaatgcaagaaaaacaagcagtctcttttatcagatgattgtatattgaatcaaaataaagcaaagaaaaaaggaccacaacttcagctcccagtgatcagaagcacagtacccagaaggccgggataaattgtcagctatttgggtatctggtagtcaaatttacataatcccatgtaattctaagattaatactcttaagtaggcaatgtgagacatatttctaaatatagaaaagccaaaaatcaaacccagatctgtttgattaaaaaattgattatgtccgtctctttatgttacatttctgttcagcaaacaaaaaaaatgtcaaagtgatttttttcttactttttatttagatatgttgatattgggaagccatcaccaccaataacttttaagtgtctgtgtgtgtgtgtgtgtgtgtgtgtgtgtgtgtgtatacacctcattttccttctctagacttgggctctggtataaaatatcacaaatatttagaaactttgaaatcaggacagatgccaagttttgtttttgtttttgtttcagttgttcctgaaactgttattctctgatttttaaaaatattgttgagcttgaattgtagacagcttagaagtatttgaataatattttttaagtgtgccaagtgcttttgagcagaaaatgatggcatcttttctctaaatcaattgtggagagactagagaaatttagccaaagatgattcagttgtgtagaaggagactcacaaaggctgttaggcactgaagtgggagaaatccttgactggagaaatttaaaagtaaaagatactatttggccttttatgaacgatttttaaggtatggtcttaagaaaaacggcttacaaaaatgaacttcttaaatatcctcttgtgtctgaagttatttctttttttacacaatatctactatattatctagaagaggaaaaggcactcacatatgtggagtgggtacttttagacagaagctttacattatcacctcattagaatgttcaagtccacatgatgtttgtttaaacatatttttttttcagataaagaagtgaaaaagtaataactaaaccatttttcaaacacatgagatggtatttgatcactggtatatcttttttttctgaaataattttctttccataaatccatttttgttgtggctaatttgcttgtattaatttaatggctaagatgattagaaaaggatgaacattaaattcgattgagcccataatggaattttcaggtgcttttaaaaacaattagagcttactctttctcaataacctattctgcttatacttaactgttataagatcacgatttcgttctgctattttaaaacatcgctaaaatataatgtctaatatgattaaaaacagaagaagataagatagcctcataaggtaagaattggtgtgtttataggccttaatttcatgtattacccctttcttgtcactctttggaagtgaagaaagagaattagggggcttagaaaaagtaatggctaccatgtcagatcctcaggacttatggcttctgaaagcaaagtcattgcttgcctacctccaagcatggtgacacaaagaacaaagcaaaaaaggaagggcacagttttaagttccttgcctttgtgataatgccaatgaaatgtcacaattctacactagttaactgtaccaagaatgatgacctcattcagttcaacaattatcttactcaaattcaaagctaaaacatcttacttttacaatacatgcgaagtattataagtgaaaaacacttatgaattaaaaatgttgaacatttttacacaaaatcagtctaaaatattcttctatcctaaaatataaattaatcttataattagagtttttacccaagaaaatctgttgcttttgttttacatgcatcaaactcatgaagtttagtgttctgctttgcaaaatattttacaaaatgcctcaggaatttcagttgtggcaaatgaaacttacacaatttcttcattgaaactctattttatagataaacatgccgtcctcccgagagttaaactgcttttttttttagctttcttatttatttctttatttcttatctcgattacttaaaaattttgtacagtctttctggagtatgtgtttataagctgaatttattgtaccatggcttagaatcaactgaatattgaaacctgaacaaacacaaatataatcttctaagtaacttgtgagttttaattcatagattttaaaatcgtgtcaatattctgtaattttgaaccaagtgcatacttaaatagtattttactgcttttaaaatattttgaatttacaacctattttaaaatgttgaattacagtctgatgctcacagagtgaaaacaaatgccaacaatgtttgcctggttataatcatagaacatgtctccaaagtaaatctatattaacacaattcaatgtggtaattaagatagaaaaaagcagcactaagctgtgtgtcctatcagtttccttggggagaaaaaaaaaaccactgacgtgacttgaaatgtgtccaaggggtttagttagcctccaattagctgcaaagtcctgcaattaaaatgcacaacaaataccagcctccatgtccctgaaccctttattatttaagtcctaatttcagatggttccttcattagagcatatatcccaaaagctacctttgacttacaattacactgtacaatcagtgctgtcaggtgataagttggaaggacaacagactccagggcatatcttggtgaacctcaaaggcccaggtcttaaccagaggcaaacaacagaacaaaggcaaacattctaggaacaatctaccatgaaaataggccaaattgttgcccctgtttaaccttgcagtttatacctgtcatgaaatccatatagtaaattcaagaggccatgcagaaatatgaacacagcggatgtgtaaagagcgggaaattggaatctgtcttttctcaggttcagaaagcatatgccatgttttcatatcattttcaccttctgcatcattacttcctttcataatcatttggactcataagaaatgcttttttgcaatttaaatactaccttgacacttaatatccaggttggatgacaaaaaagtcggcttactaactgtttaatgaatacttctgagaccatagttagtttatttttggacagatatatttctattataaatagtctacttttaatttacttttttggaaattatggcccatttttctttataaaacatgtctcaaaatgttattcaattcccagacaggacaggtcagaaagtagtctaacccataatataactttaatggccttcagaattaaattttacccatttgtaacacactgaatatgtaagagttgtctcaacttccagttaacgtccaaataatattctgtgcctctgagcaaggatatttttaaaaagagccaattatttggtcataattacttccctgacaatatcagcacataaaagagagtgggcgaagggaaaactttttatatgaaaacaactttcaaaattaatatgattttataaataaagggatctttcaaaattttgttaagggaaaaatattaccaagagtcaatcatccctcagttgatctaaatgagagaaaaattgtatgtgaatgcatttttgaaagtgtgagttgacgtgtgtgagcatgtgtgcataatctatgagcatgtgtatcagcatgcgtgtgtgcttgaatttgtgtggatgtgagcatgtgtttgagtgtacaaacatgcataaatcaatatgtgtgtgtgatgtgtggaagagaaatgtggtattcataggctgagactggcaagcaatgcacgtggatacaagtggaatagttatcacctaagagaaactcacagcaattcaacaccatatggaggaattgctggaaaaagctggtggaggaatatgttaaacttgattgttgaaataatattcatctaaggcatgtaatttccatatgatctttttgcattgaaggtaaatcaaaagcaagctctcaataaccatatgaaaagaaatacaatttcataagtaaaaggatctttcaaaattttgttgagaaaaacactagtgagagctgataatccctcagttgctccaaattgcgttaaattggattgccttaaaatggcaccattaagaggataaaaagaagtcacagagtggaaaaaggtatttttaataaccaacaaagggcttatatccagaatatattaaaaacttgcataatttcattaaaaatcaggccttcccttaggaaaaaaagtgcaaaaacttgaatagctgcttctcaaaggagaatatcaaaaagaccaatgaatctggaaaaggtctcaacctcttctgtggaatgtcatacaaacccatggtgtggtatcactttcctctcaaagaatggctaaaatagcccagatgaaagtagaaccccacttgcaccatgttttaatggacgtcatattggggtgctttgtgtggctctgcacctgtcacagggcaaagcatccgtaggctaaaggcaaatgccccctaaggatctgccataaacccactaccagaccatgcttgagctaccagcaccccacattccctgtccagacagcctagaacctgttcccacaaagtgctctgggctttctcctgggtttttcatctgaagggagatgataccacctatgtgtgtagctctacatccaaggaatggttcacacccaggaagtagtagacagagccttagtgtatagatcggcttttctcaagtgtgtttctctttgtaagttcaccatttttttcactcatttaaacctatcaactttatttttaaatatttctggtatctttcaacttctgactctatctgaaatatcctttcagttatcattgattcctcattttcctgcctaaaataatccaatgctcagcactgctatggagataaagaaaaaagaaatctgtaacattacaagagcctacatttcctctgcctgaaaagtcaacaatcccttcttgtaaactctagacttcactctgattctcaactacaataccttgaaactcttcaatcttttcatttttctacctcaagtccatcttttccctctgcctagaacttcccctttcaagacactcacatttcacctcgtcgattcctatgaattattcatagctcaattcataaacattgttctcaaaaagcctatctatactccccaaattgtcagatcttctattataaaattctaatagcattctgcattactttcttagcatttacctagctctaataaaataattttattggctgttcaatatctgcctcccaatttatataaaaatttttagaacgaaactcttcatgtatgaatgctctatatgtagttgtttaataacaaaatataaacatttagctatgtaaattgggaaaatctgccatatttagattatacgaatgaaggttgaataatgtttaaagaatactttaaaatctcaatgatctgtccaagaattatttttaaaatggtgatattctacataatacattattttaaataaccctaagattatgcttctaggaaggataacagaataagcaaaataaataaagatacaaatctataaacttaattataataaggattattagttaaacaaaatatacatagatataaattcacaaaccataagttttcatattcaaacaattttagaacttatgtgtacattctcatataacatattatttatgatgcatattaacagctattaatgctgcatattaacatcatattaatagctatcacttttgagaattgagcaagtataagataattcaattatccctaatctcacaaaaagtccacaaagcagacattattcctgattcactggtgaggaaatgaggaataagtagctataaaacttgccaagattcctgagccagagcttgagtgtgtctgtctgacctcaaggcctggcccttcccctttcccctcaacaacaaaaaaatcatttttcttttgacagaattaagtttttcaatctctaagttcagtttttggatcagagcttaacttttccaaagaaaaattgcttaatcaaatctcttaaataggttagcatttagcatacatcgtgaatagtgcactaagcagaagaaaaataaggcaacagcaaactaagcaacctatcgaccaacccccagattagtttgttaagccatttgagggcaatttcaaacaaatcttttctttgtaaagtgggaacttctaataggctactttgcatttactaaaggagagtacaaacaaaatcaaaatataaaccaggaaggtactcatgatgcaatactaatgtacaagaaaataagcaaataatgctatgaaatgactgtaatctgctaagtatagaagtatattattttaatttgaatacacatattttctttccctgataagctaattgtcaatgattgaggctcaaatccaaagtaaaaatcaattattgaacactatggctcattttaagctagaatctcagtgtgcaatttattttaatccttgtcctttatctatggagaaaggatacacatgtgcatcataaaatgccagattgtttcttacattttcttaggaacatagccatattgaagacacaattaaccacatgatgttaattactgaagaaattatcattgctaaaataaagtgagaattgtcatatatatatatatctacagaattttgaaatggcatgtaatgtgttcatatatattcttacagtgtatgtatatattttagctatatataaattaactaaatatatgtataatatatacatacataccacgtgcacatgtacacacacatacatataaagtatgtcagtgatctaacttggatatatctaaactgtaaatttgaaaatcaaagaaactaccatattgcaatctatatgcaactgtatattttacatgaatttgtggttatcatatagcttaaattggaaagtgagtccctaaaagcatcattaattcagacaaagtaaatgccagaaaataaattaggtgcatataaaatgaggaactgcaaatatattacttacttttatattagtggaggcaagaagacaaaatgtaactgaagaaatgtttttcacagataacttacttcctgaaaaaaaagtattttccgttaacgctatagattttctttataattctcaacaacactacctaagcagtgttttgcaaaggtgtggaggcatctctgcttttctccataattggagatatagtcatggaaaacagaaatgctggacatgttggaaaatgtgtcctctgccattttctcatattcttgccagcattatgttgacatatctgtgtataatcacatgataataaaacatatttttacagcttgagccaccgcgcccggccctgagtcgacttttaagcataatatttcatcctgtgtgaaggtgaagtatttaactttgctgagtagatgacaatacttcaagggaacatgtgtttactaacctgtttggaggagagttaaataatatctagaatggtgtaaactgtgatactcactgtggaaaaatatgtaaaaaaattttcttaaaaatttccgttttatttacaccatcactataatgcatctcttttataaagaaatgatttacacagacttgcaatatttctacataatttaaagcaaatacttttacagcagtcctttgaaaactttaataggcctaaaattctgctgaatgtggacacatgtttcaaatgcttttggccatctgggaatgtggcgttcttcataggagctctactcccgaaactgccagtgcctttgctgcaccaggctccaaaaacctattgataactatatcatgttgtgcaggtggaaattgaccttgatcatattagacaaatacataaaaggaagactgaagaatacaggctacttaagacaaaaatatccattcctgaagatgggtgggaaaagtagatattttaatagaatgctctagatattttcttccgctttctggcaccaaagtaaaacttaggtgccaaagtggcacttatcttcaaagaaccacctttttttctcttattaccattgtatgagagaaagtcattggcattttcatcatgtctcaagatttgtaacatctacctagaggtatgaatttgcttttcatgcatttaaatgactataaacagcattcttttgaaatcacctaatgagttctatgatatgaaaacagatatgtatccccagaaataatatatataattctgattctataagagaactattggggcttttttgtgaacattattatagctcaatattatctttttgtttttcatggtattccaaagatcatttaaaggatgaggatatgtaaggttttcttcagtgcacttgtctttggtgataatgccctagttcactagttcagttgcctattatgcgacatccttttagggattattctgatgtacataaacatacccttgctaagtacatacacatatataccatatgcacacatgcacacccacctgcatacaaacacacacagacacacacacacacagacacacacacacacatacatttcttatcctggattggagttacatggtactggagggggggttatgtttctaaaaatccaatagtaattaatggaataaaaagtattcctttctttatattgtttggctattttaaaatgaattttaatactttggattatagtttaataaagatgatatggaaaagaaattatttacttaaaaaaatcaaaataatgcagaaaaaagttatttgtgagtatttatgtgaatgtgtgctgcactaaataatgaagggttttctatgtcctttcttccacctatcttgaaaatccacactcaaaacttcctttcttattaaaatgcccttggtaaaaatccatataactccactcacttattattttctatatatgtaaagaaatttttacatggtatatagatagcaaatacatattaatgttttatgtttttaatctcttacaatggactttgtgcaatgtccataatgatgaccacttttggtatgcaacaggatgataaaatgtttaactgatgcaccaaaatataaaaaaaaggtagatactaaagtaaattctgagaagaactatctagaacttgaaaattatcatagtgtgatcataaacaagtcagttaagactacaagagataataatgctgtacaaaagccaggagaaattattttcaaggacaatttattttagaggatctactagtgttttcagagttacatatcttcttcctgacccatttcttttaagttttagatctggaagaattttgttgttgtttgggtgtgcttttttggagatggggtaaaagtgcagactttaaaaatagaacttattaaatcctttaaattttaaaatttatctttaattgacacattgtaattgtgcctgtttgtggaatacatcgtgatgtttctaattttcattcaggaataatgaaaaaaaccttgagactgacttataattttattctatttgctacttgatcagaataaattatatgtgcatataggtaaagttacaagggttaaagaataggtacaaaacatcacgaaaccagcatgcctcgtttgatgcaaaattcctataatgactacaatagtaatgatagtgactatcatttaaaaatctctatgcccccaagaagtattcatatttcatgtcagtcttaatagtagacatttataaataataatattcatcatgaaatgaagaatagattgaaagaaagtaaggataaacataaaagcttcaaatcattgtattcttattcctctagattttcaacttatgtcagttatgttcacagaatatgaaaattctatgaccacacatgttcggtcagccctgccctttgacaggtaactgataatttctcctctgtgagaacactttcaggaattatttattcacagatttatttgtgtcagattcaaatgaatgttttttctatggtatattattttagcttctaaatttgtttttagaagtgatgacataatcttgacatacttttgttcatttataattatagaattcagtttttctttctttagcgtagctctggtttatgaattaagagaaaaaattagcaaaaatgatattcatgacttctcagagttaaaagaaataacttataatctaaaatatttaatatttgcaatatttcacttacaaaacaatcacactgctaataaaataagctacaatgccacttaccatgtattggtataaatttaatggctgtcacaataaagattgaagcctcctggtaggatatggaaagcagagtctattcatagagaaattagaaaatgtcagctgtgtggtttccatggaataacttggctttaattaaacatctattcattagtaacaaatgccaaataacattaagctgttagtagaatattaattacatgcttaaggactaatggtagcatattaacaattaatggtactttaagaaactagatatactatagtacataatttgtttaaattgaaagctattctacgagtgtgattttttatttcctaattgaaaaactccataattatatgcacaatatacatataattctatgtacaatatacatataattttgaagtttttttcccctgaatatcatggtatatatttgggtactatgtatatgtccaaatatacctctcttaactttaaaaagcattcattacaaattgttctctttctattcttgcctccctctggaaaaaggaaacctcactttatgcataaaatttctatttaagatgacatgatggttgagttaatatgaaaccttaaaaaagtaaagtcgaactatgaaaacacccattttaaagaactgtttctccgtcccagggtctctccttctgtctcaattttctcttctaacagaataggtatatttggtaaaaaatatagcaggacaggacccagattcaacgaaaagccagagacatcccactctggaatctgacacaaagactttctcattcaacacagacaggcactgaaatgcctgctagatctgctgccttgatactgtgaaaggacattttgaatattctttaatgtgaaggcagaggaaaagaaagtaattatattttaggattgggagctcttttatcgaaaactctgtggacctgtttgaactttgccaaaacatttctcttcaaatcaagtagaaccttgtccatatacttggaaacaaattaactctcaaatacagccagatgatgatagacagtgttgttgaccacacatatgaatccgtcttgatctttaccttataacatttcagttattcctacagatggaagggtgcactttcctgccccttgactttggaatcagcgaaagagatattagcaaaagtggtatgatgaaactgacactccatatgtgctttatggagttgtgttttcctgattcttcatggtccatgtagatgtgttgatgtctgtgcaactgaaggaacaatcacctcttccagtatttatagactgctttttgcaggtctgcaggcctgcctctgtgagtacagatgggtttgtctccagtgtgtgggtacacctgcctgtggactgagctgatcagggttgaagctaggtcacagagatgcttcaggagttgaagttggaactgcagtcagccagcctgttacccaagagacaagcagaatacattatcttttgttttatgctgaagtagagtgcagcaagcaaaaagcagcaaaagacacataatcaaagtacttggaatgctgactgtaaaattatgctgagaactggctgcatgataagatgcttttccttcctctttgttatttgtattattttgtaaagataggccagtgtgagtatgtccaaataagctaataatctatttcccttaaaatttcagcaaatattcaagagaataaaaatgtaagttattgtccacacagctaatgttaatttttcattaacataatttaagtctcggtgatagtttgaaaatgttcataatgttcattatctaataaaatagataattgtggaattatctaactcgtagaagattaattgtggaagagttgtttgtatatttgtaactgtctcgtttttagtaaaaccaatttttttttctgagttaaaatattaaacaatgaaaaagtaaactcaataaatgtaattcagtgccttgcataatagaaaaatgttaacaaggtaaaagctgttaaaattgggatggtttcaaattttaatgtgaaaatttctgtgataatttaatctgctaatataatgtttaactctagatctctttcttgtgacatggctcgatgcaatttaggttgctgtcattaaaattctacaagcacatcatacaggcctatctgcagtgtacccatttctgctctacctatgtacatacctaaacctgaaaacagggttggagctcacttcttatgttcatctccttgccctcccatgctcatttgcagcatagtcagatgaagtatagttaacaaacttatagcaaagacaaagcctcgggcttcagtttgagctttgactttaccattcagtagctttgatacctgagctaaattgctgattttgtttaagtcttgctttcccttcgcgtaagatgagctgaaagttattagcttcttcacaatgttaagaattaaagggaaaatataaaaagtacttagtacaatgcctggtgcctactaagtgttcaaattcattatcaccatcaagattatcctcctctttctccccctcttccttattatctcatgttttaaagaagtcttggatggggaagaaataatgaaggatgtgtgggaagtattatatgatagtacatccagagagctctgcttcagaaataaacatgtagatttttctctttgttttggccaaatatggctaacacaaatatatttacaaaaactaaaaagcaaagaaaattggtgtaatttcagggaatttagtacatggtaagaattattatgtctgaaagacaaaagaaaaacaatataactatataaattataaattgaaaatttatatgaaaagtagatatacttttataaaattaatatatatatttaaatctgagaatttaaatgttctctttaattattaacatcttttttaatttgtttgttttgtagacaccatgtcattaataagtaagaacctgggtattagacagagattttagggatttccattttctcatgtgctacggtttgatagtaactgagcattactttccctctctgacacccaaattcatcatctattgttttaaactaactcacagaattataaaaatagaataagtaattattaggtgtaatttttgaaacttttgatgcctaaaatccacattcgttttctaggattattgtaaaaacagtatcactaattgggtagattaaaaacagcagtaatttatcctctcacagtattggaggctgtgactctgaaatcaaggtgtgggcagtgcctgctccttctgaagctctgggtagaatccttccttgtctcttcctagctcatggttttggccatcaatccttggtattccgtggtttgcagctgcatcactacaatccttgcctctgtcgtcacgtgctgtctctctgggggtctccgtcttcacgtggtcttcttaaacagacaacagtcacgctagacgaggacccacctcagtgacctcaccttaattttattacatctgtagaccctgtttccaaatagggtcacactcacaggaaccaaagatgataatatttttttttggagggagggagttcaacctataaaagtcttgagcttgaatataaacttaattcaatatttcaaggctttgtactaaagccctggatttatacttaaactgtttctgagatgactgacagctttagtgacagggatctccaatcttctggagcaatctcatgaccaaggatctttaatttttgtgtcttgaatcttgcagttctacacacattagtgtacatgcttcatcagagaagaatgggaaaatgagcaggaaatcctgtttttgtgatttctagattcaacctatggtttgatgcagtagaaacatataagtggagatcctactctgaaaatgcctaaaaaatgcaggtttcatcgaacatattttccacttatggtgtagatttaaaaacctccatttttggcagtctctataattctttatgttaatacctcaagtgaaaatacattatggtctattagtcacacaatattcaccatcagagataatcatgatagccatgactctgtttcctttttctgaataagtaacccccaaaatgtgacccatcaaattttcaagttatgtaacaccttacaattcctatgtcgagacaatgttacccaacaagaaaatacaccaatattcagactacgtcatatgcagcacttaatatcaggccagagttaatacggaatcagagcaaagctggaggcatcacattatctgacctgaaactatacttcaaggctatagtagccaaaacatcatggtattgatacaaaaacgaacacatagatcaatggagcagaatacagaagacagaaacaaattcatatattgaaagccaactgatttttgacaaaagcatcaaaaacatacattagaaaatggagagattcgtcaataaattgtgctggaaaaactggatataatataccaaagaatgaaactagacttcaacctctcaccatatacaaaaatcagatcaaaatagattaaagacttggatatatgaccacaaactataaaactgctagagaaaaacctagggtaaatgcctcaggacattgatctaggtgaagtttttatggctaaaacttcaaaagcagagacaaaaagaaatagagaaatggtactataggaaaataaaatacttctgcacagcaaaataaattattaatagaataaagacatgacctgtagaatgggacagaatagttgcaaaatattcaattgacaagggacaaatatccagaatatgcaaagaactcaatcaactcaacaaaaacagaaggaaaaaaaacactgagaaatgggcaaagaattttaatagacatttctcaaaagaagatatccaaatggccaacaggtatgtgaacaaatcttcaatgccaagaatcatcagggaaatggaagttaaaactacaatgagattgcatctcatctcagatagaatggccaattattcaaagacaaaaagtatcaaatgctggtgaggatgtggagaaaagagaactctcatatacagctggtgggaatgtaaattagtacacccgttatgaaaaagaatatgagggtttcttaaataactaaaaataaaactaccatatgatccagctattctgccacttggtatccgaaagaaaggaaatcagtttataaccaggaaaaactgcatctctgtgtttattgtagcactattcacagtagccaagacatggaatccatctaaatgcccactaacagatgagtggataaggaaaatgtgatacatgcctatctctaatgttgtcattgtacatacacatatatacaataggatattaatcagtcataaaaatagaataaaatcatatcactttcaacagcatggatggaactggagatcattgttttaagtgaaataagccaagcacagaaagacaaatatttcttgctctcactcataggcgggagctaaaaagggttgacctcatggaagtagagggtggaatgatggttacttgagtccggcaagggtgaccagcattaattaataatacgtgagcctggtaagggtgggcggtaaagagagattggttaatggatacaaacatacagttagaagaaataagctctaggatttaatagcacagtaaggtaactatcgttaacaataatttactgtatatttcaaagtagctaaaagagaagatatgaagtgctcctaacataaagaaatcataaatgctcaaggtaatgaatatcccaattaccctgatttgatcatcacacattttatgcatgtataaaaacatcacacattcctcataagtatgtacaattattattcaactttttaaaatatcgatttaattgttaatcatttcagaggctactgaagccaaaatacaaaatgccaaatatattaattaaaatcactctattggacacactctttttccccctgctaactcccttaaagaatctatttctgttctcatccttgaaggtcctgttgttatatgaatcccttccttctttcacacgtaactggtcaaaagtagacaactgaactaaagtaaattcattaatttcttagaagttaagatttttttcttaaacatacgagctaagaaaaactagttacatttgtagttgaatttcattatttgatattgtagacaagatctctgcaccactctctgttgataagaaatcaacatatatgtaccaacaacatatgataaaaacctatttagataaggttttttgttcgtttttttttttttttttttaatgactgaatctcactccattgcccaagctggagtgcagtgacgcgatcttggctcactgcaagctccgcctcctgggttcgcacaattctcctccctcagcctcccaagtagctgggactacaggcacccgccaccatgcccggctaattttttgtatttttagtagagatggggtttcaccatgcgcagtggctcacgcctataatcccagaactttgggaagccgaggcgggcgaatcatgaggtcaggagatcgagaccatcctggatacagttgttttattactatgtctatatctacagaatggtacgcttaaagaagacataattacttcagtacaaattttgtagtctgttttgacatttggatcagaagattgaggctcatggactacacatttgtaagtgtgtgatgtttatcagttgcataaccaaactcaaatattgctgatcaatatgcatgtggcaacccagagcatggtctctagaaaggtgtgctctgctacctgacttcaaactatactacaaggctacagtaaccaaaacagtatggtactggtaccaaaacagagatatagaccaatggaacagaacagagccctcagaaataatgctgcatatctacaaccatctgatctttgacaaacctgacaaaaaccagaaatggggaaaggattccctatttaataaatggttctgggaaaactggttagccatatgcagaaagctgaaactggatcccttccttacaccttatacaaaaattaattcaagatggattcaagacttaaatgttagacctaaaaccataaaaaccctagaagaaaacctaggcaataccattcagg

SEQ ID NO: 2479 - DNA, 2993 bp, Homo sapiens
gggtgggttagtgggtggagatgatcaaattagagttttatacccatcacaagcatcttttaaaaatacaattgaaataaacatattttttcagttatacacaagatgaatggattaaccactggaagacctgcactactacaaatgttaaagaaagtccttccaagaaagaaaaaaggcaacttaatggaaacttgtgtctaccaaatggaaagaagagcaatgggaatcctaactacgagtgtgagaaaaaaagttgaatgtggtgatggggaaaacactgaagttcaaaagaagcgaagacaagaagctactcatggcagcagcttttcccataaatcaagaaatgctacagattataaatgagatgagactatcaagaagagacctaataggagtgtgaagaccaaaaatttaaaagacgtggttatatactttgagtaaactctatatataggacaatgttattgtttggttctgtgttcctcactcaaatctcacctcaaattataatccccatgtgtcaagggcaggaccaggtggaagtaactggatcatgggggaagttttcctcatgcttttctcatagtaagtgagttctcataagatctgatttttttataagcatatggcatttcccctcctagcattttgcctcctgctgccttgcaaagacggcagttgcttcccctttgccttccgccatgactgtaagttccctgagtcctctccagccatgtggaactgtgggttaattaaatctctttccttataaattacccagtcttgggcagttctttatagcagtgtgaaactggactaaaatagaaaattggtaccaggagagtgaggcactgctgtaaagacatcactataaaggcacctgaaaatggaagcaactttggaactagctaatgggcagaggttggaaccatttgcagggttcagaagaagacatgaagatgtgggaaagtttggaaattcctggagacttgttgaatgctttgacgaaaatgctgatactgatatggacaataaatttcaggctgagatgctctcagatacaaataaagaacttgttgggaactggaataaaggtgactatttgctatatatgctttagcaaagagactggtggcattttgcctctgtcctagagatctgtggagctttgaacatgagaaagatgatttagaatatctggtggaagaaatttatatgcagcaaagtgttcaagaagtgactcgggtgctcttaaaaccattcagttgtatgcattcacaaagatatggtttggaattggaacttatgtttaaaagggaagcagagaataagagttcagaaaatttgcagcctgatgatgcaatagaaaagaaaaatctcattttctggggagaaattcaagcctgctgcagaaatttgcgtaagtaacaaggagacaaatgttagtcaccaagacaatggagaatatggcctcagtcaatgtcggatgtcttcactgcaagccctccaatcacaggcctgaaggattggagagaaaaaataattttgtgggcaaggcccagggacttgctgctttgtgcagtctctgaacttggtgccctgcatcccagctgtgtctaatagtggccaacatacagctcaggccattgctttagagggtgaaagccccaagccatggtgtcttacatgtggttttgggcctgcagatgcacagatgtcaagaattgaggtttgagaacctccacctagatttcagaggatgtatggaaactcttggatgtccaggcagaagagtactacaggggcagagctctccatggagaacatctgctagggcagtgcagagtccccactggggcgctgactagtggagctgtgagaagaaggccaccaacctccagaccccagaatggtagatccaccaacatcttgcatcgtacacctagaaaagtcacagacgctcaacaacacctcatgaaagtagccaggagaggcgctgtatcctgcaaagccacagaggcagagctgcccaaggctgtggtatcccacctcctacatcagtgtgattggatgtgagacatgtagtcaaatgaggtcattttggaacttttaagacttaatgactgctttattgtattttggacttgcatgaggcttgtagcccctttgttttagccagtttatctcatttggaatgggactatttatccaaagcctgtaccccattgtatctaggaagtaactgacttgctttggattttacaagctcataggcagaagggacttcccttgtctcagatgagactttggactgtggccttttgagttaatgttaaaatgagttaagactttgaggaactgttggggaggcatgattagttttgaaatgtaaaaagacatgagatttgggaggggccaaggacagaataatacggtttggctctgtgtccccttccaaatttcacctttaattgtaatcgccataacccccacatgtcaatggtggaaacaggtagaggtaattggatcgtggaggcagtttcttctatgctgttattcatgatagcgaatgagttttcatgagatctgatggttttataagcatctggcatttcttctgcttgcacttctcattcctgccaccttgtgaagaaggtgcttttcttcccatttgcgttcaaccattattataagtttccagaggcaaacccagccacacagaagtgtgagtcaattaaacctcttttttaataaattaccactctcaaacagttctttatggcagtatgaagacagactaacacagaaagatatagctgttttggaaacatcagaagtacagttgtagcaataaataaaatatgaatagattaactttcgtacacctatttgtgttgaaagcaccaggagtcatagccaacaatcactttaatatttctccagctaattcttctgatttatttttatgtttggttagccagtgacttccc

SEQ ID NO: 2480 - DNA, 3638 bp, Homo sapiens
cagaaatatctctgtctttgttcagatagaatagatatctgaacagagatagttcagatagttcacatatctgaacagagatagagatatctctgaatatatccacatatagatatatttatatctatcttccctttctaactaccagagctatgaactcaagatttagtataaatgtgatgaaaacagtcttacagaaactgcctaaccagatcagctccacaattgttctatacagtcaaatccctacaataaatcattttacaaatctttctttttttgtagattttacaaaatcgtacaacaaatctttagatttatagatcctacaacaaatccttttagatctatagatcttgtagtggttttgcttctctaattgaaccctgatataatgtattccaaatgcggagccaatagaatttgctaacatattggatttagggtacaagagaaagaaagaggtcaaaaatgacttcaaggtgtcatttggaaaccagaaactagaagactgagaaaccagagagtgagagggctgaaattgaatgggtctaagggagaaaattaaaaatgtgtagcaatgttatatttaaaatacctactagacatctagatgggggtgtcaggtaagcacctgggtttacaagtctagaggcttcagtgaagagcacttaactaaagaaaaaatgggaagtcaccccaatatcatagataatgctaaggttgtggaaatggatgtgggcacctaggaagtgaatatagaaaaagaaagaaaataatctaagaatgaaaaaatgaaagaagaaaaagaattagaaaaatgaataggattcatcagagattaagaaggagtagccaatacggtagataaaacggtacctagctatgtcaaatgttcctgatagatgaagactaaaaatataacattgaatttagcaatggagaggtcacttctgactttgagtggaacaactttaagtagagtgatggaggcgaaagcttaactagagctgactcattagaaaatgagaggagaggaaagtggagactaaaaatgcagtccacttttctcagaaattctagtgtcaagagtagcagggaaacggtagaagctggtgggagatatgggatataaaacacctatatttttaggtgggaaatgttacagtatgtttatatgctgatgtatcaggccgttcttgcattgctataaggaaataactgagacagggttatttataagaaaaggggtttaatcagcttatggttctgcagactgtacaggaagcatagtactgtcatctcctaagtttctaaggaggcctcaggaagcttacaatcatggcagaagatgaagggagaccaggcacatcacacagcaaaaggaggagcaagtgagagagccagtgggtcaagagaggtgccacacacttttaaatgaccagacctcctgagagttcactatcacaagaacagcacaaaaaggatggtgctaaaccattcatgagaaatctgcccctgtgaccacctccggctggccccacttccaacactggggattacaattcaacatgaaatgtgggcagggatgaatgtacaaagtatatcagctgatataaatgattaagtagatcaataaaagaaattaatgattggggaaaactgctaaagcaatgcccttggaaagatgaatgggatctagagcacaagtagataggtcttggattggaatgtaggctgtttacgtgtaaatgaaagaaaggcagttatatgagtttaggtatagatggattagtagatttggtaatgggaatctgtggaagttctttgctgattacttctattttctcagtgaagaaaggaacaaggtgttcagctaataacgtggtttgggaagggagtttgaaaagagaagataaagaaatactcatctaggagagtaggagtgtggatggactagaaaaaaggtaagatcgctgggaagcacttgagtttggtagacatggatttaaggacaaagcctatctcagtacatttcactgtggagagaagcaggacacaactccttcgtgcaaagtctgatctgaaaaaaaaaaaaaaaaaaagagagagaacagaaggagtagagccaaccatattcaatttcttcttcaaagaaagtggtcagataagtcaacctacttccagtacagagaagaaagccaaaggacagggaaaagctggaagtatctcttttctgggctttttctccttgggaatgaaatagttgaaaatgtccttccttctatgaaaacatgaaaaggaggggtaggtgtccccctaacgtgtggcatcgtttaataaggccccaatgggatatgcattctgcacactgtactacaggatttctttaaaatacttcttaaagaacccatccaattttatgcaagtattcaaaagtctctaatgggattcattttaattattgtaacagaaaaagaaattcttggtccccaacatggaaatccaagatgcaaggaaatcataggctctgaatcacctggggaagaaaccgctgcagaccaaattgcatcttagatccattaaatcagaaacttggattgctggattcaggtacaagtatttttaaagctccctaagtgattataatgtatagccaaagttgagaactactgctttggagccactggtctaatggaacaaattgcattgatttacttcccttaatattactatgtataactaactaaataagatgtattattttatgtttcttcttaatattggcataaaccaataaattagtgtatgtatgtttcattgttagaagaatatatgaatattatttttgtaccagatattccatcaggagcagaaacgttcacagaaaaggggcacaaattttaggggcagagtaagatgtgaaccatacaatcagctctgagcatcctcctctgcccatttgcctcatatggttttaaggatggtaagtgcagataaagctgtgaatgagaagaggaacagagcagtcatcatggaacatgagagagaagctatgtattcaaggccccagaaccacaagtagaaggagcctggatcccagataattttgtgggtcccatagtcctgaattgcctgcccaggctttaacatgaaagagaacaatttctctatttcatttaaaccacagttattacagggtctctttcaacagccaaacctattacctaactaacacaagtcatgaccaggtagtcttgctaacagaatatctcatattcaattaagtgttttaaatatataccattgttactgcacctgaacaaccgaaaacttctgtgagaagaccaaaaatctatacttagtagaaattttccttcttaattttagcatctacagaaatgtgccccatattttgtcctgtgaatgactttcaaaagttcagacttgtgtaatgccctataagttgaaccaaatattaatttctttgcaatatataaagattttatttaacatagtgtaatataaagataatatatgtctaatgtagtagatgtcaagtacagtatgtgtttggtatttagaccttataaaaaaaatttttctagctcttgtctaccatgtaggtaacatattcc

SEQ ID NO: 2481 - DNA, 4521 bp, Homo sapiens
atttattgatgctcaagataatgtgttatggtactagtaaccccaatcccaaagatgctgaaagtgtcttttgttttgagttttaaaattatcctaatgaatgcatagagttttatatatgtgatgtgttttaatcgattgcagttttgtttttatactaaaactctcccatcttaggctggtggaatcctcttcaagttgtctcccatgtccctttgacatgattgaatttctttttaatacatttctagtttcttccagcctcatcttatatatttccttgacctactatcagccatttctctaagaaaccccggttcttattagtgggaaatctgaccaccaaaatttgatttttctaagaaatattgcccttgagtcatgggcataaacatggcacgtagtatcattctctcttttttttttttttttcaaatttcccaaagtgtttgaaaatgctggacattgtagaaccttcaaatagaactttcaaagtttagcaagccaatctgttacctctgtaataacttgaaatttttacataatgtgtggatagcatgcacaagtgttttcatcttatgtttttacaaattttatttaaaaaataatacttcagttttctgaaacaggaaccatgtacaccagtgttcatccatcaatctcaaaatcacctggtcctctacaaattattatctacaaaagtggatgtcactgaagtcaaaatagaaagtcaacagatctgaaaccatggtgatgcaggaaaatgatgagtcgttccccataatcctgtgccttcttgaggtcaaggtaatattgctcccaaatgtcattcagttctgtggcatcaaaaggtacctgctatgcactaggcagagaccaccaacctctggatgggcttggaacccaagtctctaaaggtgaaaggtcacagcctcacctcacaacactgccttgggcctgtttcttattaccaaataatttccagaaggagatcaggcttgagcctgattttccagtagctgtgcaggggagaaaaagagtttggaaaggaggactgctgttctcagtgactgattgtgagaacaagagtagtgtcaggaaaaaaggccactctcccccggccctagtcacaggataaattgcagtgctcctggctgctcctcagaggaaagaggcttattggcaggagataggaggcaatgaggatccaccaactgacggaccagcaaattcccaggaccccgttcaataaagccactgacaggcacagtccccaaagaagagaggtgaaaaccacattcgtgtacctgaggtgaaagaccaccattaaaaataagtaagaaactccaaatgtgtaaatcctatataagccaaaccatatggtataaaatgaatacattttctccctctacctttggcaaaatggtttcttactggattttatatacaggaaagtattaacccaccttttgccatgtagtttctccctgatatatggcattgataatataagtagttcaatgatacttccactgtttgtgtagctctgcgtataaaaagaatgctgtgcacatagtagaagtgctaaaatcctggggtaacacctcatacattagtggccttccatggtgaacaaagtcatttttcaagcaagtcataaagtagcctaaaacacaagtgtttcagtgtttgctccaaatgaggcagtggtccggggactgccgttcatctgacatcatttctgacacagccagcgctggtttggtatctgattaggactccccgccacagtggtgccagacttactactttaagtgaggtggctgagggaaattaatgtgtcagagttaccaggaggcgagagtgtttgcttcaagtttcctttggaaagcttcagctggaattgcctttgattctttccaagagaatcttttgaagctatttatggagcttggtaataggtgaagatgagctaccaacaggaaactcagctagcatcaaaagtcaagcgtgcagatgtgcaacgatatttctagacaaaagtggtcaaattactgacttgtttagaggatgccttggggtctcctggcaagtgaagtagccattttcctcaaggctgaattttcatgatgcaccctgcacccgctgctttgttctggagaatcgtatatgccctcttgatgtcaatgtatttcccttaaaatataagtgaaatgctgcgtacttcactgatgcatgagaatattggatagaaatacccataatgtgctttgaaactttttgatgaaaagatgaggtatacttaaaagtattaactctgtaatgtgttcctttccatcccttctcaccctcttggcctaggtatacacataaaacttatcccaattcccagccctcttcacttccactttctgggaaaactatgggaactgtggatggaagattctgtggtgcatattttctttcttcaactgaagcaatgtacacaaaagaaatctataaatcttaaagtcagccagaaatatcagttgctattatctttttttgttttagaaaatatagcataagaatacatgctttggatcagacagatctggtctcaaatcctggctctgccatttactcacacatatgtacagctcaagcatgcatgtatgcattcacatacacagacattgacacatgcatgcatgagtacagtcacacactcctcatgcatatgttcaaatagatgctcactcatacatgctcacacacatgtatattcatggacactcattatatacctgaagcttaaacacacaattcacttattctttgcagttacgtatgaccagcagttctgcagctatacttgagcatgattctgtgctctccagaaggacactttattttaaatcttttatatagcacaggaagctttttctcttagtttaaaggccaacaacatcaatttgcagctagaagattgagtttaaatcccacctccactacacagtagctgtgtgaccttggataaattactaagcttgtgtatctctctctcctcatttgtaaatcgggaatttatctcacaagattgagatagatactattattattcccgacttacaaatcaggaataagccattcagaaaagtgcttggcacatagtaagtgcatgtatttatttgctattaatattaaggaatgaaactcagcacagctagaaggaagatttctgttccaacacagccttgaatgcaatttctatgtgtaaatgaaatgtatttcatgtgaaataacaaacattcagatcaggtcatcttaatactacacatgacaaagatgtatagtttaataaattttgggctttgctggtttatccacagagagggtcaggtctgtgctcaagtgtctttcagaagacatgagcatcttaggctcaaactcttcaggagatgagagtctgcagccctattaacagcctctaattgcctcaaggttcattttaagctctaattctaaaagtacaatgataggcaagtatctgccctctcagaaatcttagagactgggtggggcactaaacctgaaaggatatagagtccatgtttaatatctattctcttgagtgatatacatactcatcatacttgttagtactctatttccctcctaccaaaaactcttacatagctatatcattttgttttataattagagttgctttgagttaataaaaactatactaaaatgtttattttcttgcacgttctttttatacaattatgatgcactttagagagataaatagtgcctgaatttggaattctgggactgaacaatcagccttatgggatgtgaaaagaagagaaaggcatgagttgagtaacataagtaagcaagatttaaagaaatactaactcccaaattaacatttttggttattaattctgaattactcagcattacagcctactgtaaccttgatttccagcaggcttgaaaagagatctttcatcaactcgagtgaaactttcttttgtaaaaaataccctttgacctaggttacttcaggtctacatgacagttgaataagtacatccttgcagctttacatcttagatagaaaactatatctgtgtcttcgctcttctaaaacctgctattgaagcagtttcataagagttcataccccttcactcttcctagggagccatggagagcctgcagctgaggtactggctttcccgcagctagaagtctctagtcactttagcaactcatcacctgcttcccatttttttaaaagagtgtgaactgcttgaagttttcagataaatataataatgcctatatttacccaattaaccatttctttctttgagataccctgcctccaaaaatatttgatataaattatttttggaaaaggtttagagttttgaataaattacaattaaacagttatatttaaacaaaacttaacaaagtatataaataggaataaatgataagaatggaaataattttttaaat

SEQ ID NO: 2482 - DNA, 699 bp, Homo sapiens
gggaggggtcagctgcggccacgtgagggccaggcccctctctgactgcccaggctgcatccacacagaagattccatggctttccataaaagagagtgggagaatgtcctctctaaaggcctggggagtgcctggggagaggagacagcctcagctggggctcaccagccagcagctgccagccaggccagcaatgccaaggcacccggcgttcctggaagccaagccctgtttgatctaatggggcagctgtgggtgcagacccagataaagagataaacccagacccagaaacctgggggaggaggtgggagcaacaacctctcttccgcctccttcaccgtgagaggaaaggaagcgggatgacatagttgtggctgggactgctggaccccgcatgccagccctgggaggtatgtgggtcatgaaatccacccactggtgacctcccccatggtgagggagggagagagcttctcccctccttggctaagaggacagagggaggatcctacaaattctgtcaggaagcagaaatttggtctgagagcagtgaaggtgggagcagacaccccccaaatcacctgcaggatgagcatttctcaggctctagagagcatgtgtgggacacagccgccagcccacctggtgcgggggtccagcagccacagccatgggaactcctgggcctgttgttc

SEQ ID NO: 2483 - DNA, 304 bp, Homo sapiens
gctctgacagtgcatcaggatcatcttggtccttaaacagaagaatgccagggcccaccgcaggccagcgactgagaattccctgcagtgcaccctggcacgtgtctttcctgaaatctccacgtgtcctcacatcctacttggatagccaatggacatctcaagccctggaagctgtgcgtttgtacccgccctcttgtctgttggttccagtcttctgtgtttctatgtcatcagcctgaagaatggcaaaggagtcatgttgttcccactggtctttttattccacttgcagctgaagtca

SEQ ID NO: 2484 - DNA, 1245 bp, Homo sapiens
ggccccggtggaagttatcgggtggcagcagagttggaatgggataggtagttccccgtttccaggaccccagacggcctgctgggacagtgtatatgagtccggaatgggctggaccagggtcaggctagcccagacttcaggtacgggctgtgatgacgaggagtgggctagtctcccgggtcggtcaccgctgaactctcagagacaatcaagctttcgatgatcatgtgatgaggtttccagtcagttccaggtgaagacaccactggccatcaagaagctaccctctccccaccagacagagcaggatgagagttctataatcctcaataggaggaagcactcaattgaacaagtgcaggaaccagctggctgcctcagcactgacagaagcaaattccatttgcttggacccactgcattccatcccttgtggaagagagcatgtaagcaagacaggaccttcaggcctctgaaaaaaaaaggatcaaagaactgaaactcaccagatcacctcaccagatgctggacccctcattcaccatgtttgcttccttgcctctccctagttcttattttcttacacattgttacatttcttccctgctatatcaacccctagttctagtcagtcatggagatggatttgagactgatctcccatcccctcagctacaccacctgattaaagccttcttccttggcaataatcattgtctcagtcattggctttctgtgcagggagcagcaggacctagactaaacccctggtgttttggtaacaaaataaggccaggcacagaaagacaaacatcacatgttcacacttatttgtgggatctaaataccagaacaattgaactcatagagatagagagtagaaggattattaccagaggctgggaagtgtggttgaaggagttggtgggcagtggggatgtagaatgtgtccaaaaaaaggaatagaatgaagaagtcctagtatttgatagcacaacagggtgactatagtcaataatcatttaactgtacattttaaaataacttaaaaggtgtaattgggttgtttgtaacacaaatgataaatgcttgaaggaattgctactccattttccatgatgtgattattgtgcattgcatgcctgtatcaaaatgcctcatgtacctcataaatatatatacctactatgtacccacaaaaattttttaagaaaatataccactgcttttccatttgtcaag

SEQ ID NO: 2485 - DNA, 1866 bp, Homo sapiens
caaagctttattcagagccatgttgttatgggttgaattgcatctccctaaaattcatatgtttaagtcctagcccccagtacctcagaatgtgaccctatttgggaatgagtttgttgcagacataattagttaagatgaggtcatagtggaatagggtgtgtcctacttcggtatgactggtgttcttataaaaaggggaagtttggacatagagacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgacaaagtcttgcttgctctgtcgctcaggatggagtgtagtggtatgatcttagctcactacaacctctgcctcccaggttcaagtgattctcctgccttacgctcccaagtaactgggactacaggcacacaccaccacacccagctaatttttgtattttttgtagagacggggttttaccacgttagccgggctggtcttgaactcctgacctcaggtgatccacccgcctcgatcgcccattattaacaatcaaatggctgttcttcatggtactggtacaaaaacagatatatacaccaatggaacagaacagaggcctcagaaacaacaccacacatctacaaccatctgatctttgacaaacctgacaaaaacaagcaatgaagaaaggattccctatttaataaatggtgttgggaaaactggctagccatatgcagaaaactgaaactggaccccttccttacaccttatacaaaaattaactcaagatggactaaagatttaaacataagacctaaaacaataaaaaccctagaagaaaacctaggcattaccattcaggacatagacatgggcaaagacttaatgactaaaacaccaaaagcaatggcaacaaaagccaaaactgacaaatgagatctaattaaactaaagagctcctgcatagcaaaagaaactatcatcagagtgaacaggcaacctacagaatggaagaaaatttttgcaatctatccatctaacaaagggctaatatccagaatctacaaggaacttaaacaaatttacaagaaaaaacaaccccatcaaaaagtgggcaaaggatatgaacagacacttttcaaaagaagacatttatgcagccaacaaacatgaaaaaaagctcatcatcacgtcattagagaaatgcaaatcaaaaccacaatgagataccatctcacgccagttagaatggcgatcattaaaatgtcaggaaacaacagatgctggagaggatgtggagaaataggaatgcttttacactgctggtgggactgtaaactagttcaaccattgtggaagagagtgtggcagttcctcaaggatctagaactagaaataccatttgacccagaaatcccattactgggtatataccataaggattataaacgattctactataaagacacacgcacaagtatgtttattgcagcactattcacaatagcaaataattggaaccaaccgaaatgcccatcaatgatagactagataaagaaaatgtggtacatatacaccatggaatactatgtagccacaaaaaagagtgagtttatgtcctttgcagggacattgatgaagctggaagccatcattctcagcaaactaacacaagaacagaaaaccaaacactgcatgttctcactcgtaagtgggaattgaataatgagaacatatgggcacagggaagggaacatca

SEQ ID NO: 2486 - DNA, 10743 bp, Homo sapiens
agaaaacagtttagatagtagacaataacttttagttggtttttgtattccttgatattttttaaatttgtttggcattactccaagttgtagttgcttggaggtatataaatttattgctatttagtaaaagctacagagttaaattagcaaaatcctctgagttcgttaggatactcaatgttgtactgctaaggtaaaacatacatcacatttcactgaaataagacagaatacaatatgggaattgaattctgcatggctaaaaggcctccgtagaattctgctaggggaagaatttttttctaaccaatatctgtttaaaatgcatttaaattttaatttttttatggtttcattaggacatttgagctatattttacctaaaatatgtagatattaaattggcctttttgcttttgacctttgaagctgagtgagtgctaattcttgttactaaagttttagtttataatattattagtcaattaactaacatagtctcaggtcatcccattcctatggtcatgtgttataggtgatctcttagtcttattgctatctctttatatgttgtataatatgctgccttttaggtcagttcaaagctctcttcccttccagcatttgtttgccttgtttccagagtctcctaagaaaagctgctttgatttgattgggtctagtcttcagaggaaactgaaacatattttcaattacatgaacattataaatgtatttggcttattaaatgtaattggcttaatagctccttcttctcctttctattctaccttttttttcctttttctctcctttagaatagacaatctagagccacactgtccagtaagggaggcaatagcaccctttggtgtgagcgcttgaaacctgaggagcctgagttaggatgggctgtagctgtaaaatacacaccggattccagaggcagcaaagaatattgaactgctcactgcagattgttgtatgcattggcagttgaaaggtcattgtgagtaaatgttgggttaaataaaacatattatttcattaatttcacatattcttattttttaatggagctactaaaaatttaaattgcatttgagatctcacgatatattttttggacagtgccgatcttgagggaaaagatatagctgctaagacttgaacctaacaaatatgccctcattgttctagttccctcagcatcatggttcattgtgagataataaagaattatacaccaagtgagttattccaaggtacctcctttccacgtggatattgaaaacctgtgtcatgatttgacaatttgtagaagattgtgagatctagaatcctagccaaatatgatctcatcatgttatcataaatccacaaaaagtttgtgacaattcttacaagttttctacttaatgcacggaagttgaaataaatagaactaataatttctgggaaaccaaacacattcagtgcattatttaaacttttattcagtgtcaatagctctgacactattaaagactctattaaaagtacaatatgtcttctgtaatcatgtaagtctcaatggtctctcacaatttcaatcatagagcttttccaatctaataatggtggcacataaaaataattctctgtaattatggatttatgccttatcagtaaaaataagcagctaattacccaatactgatatcagccctagcttcctacaagactgcgaattagattacttgctaggaaataaaccagaaactagaaggacacggttatctttccctgtatttatagaaatatcagtcatagagaccaaacgaaggttgtcttccttttcgtcctttcttagaagtgcatggaggcagaaggtgtctccttttcttacattcccatctagaatcttggcataaattctgtttctagtgttgtttgctaacgttcccagcttcacaattttcctagaactctactgagaagatgtattataagttcaattagtgctttgacatctttgagcctcacaggttcccaaaagcctaacagtttccctgctgttgcctgctatagcccccagcacccagcaggaaagctgcctcaacaggctgccaccttcagcttggccagctgcaccctacccagccctcaacctaatgggctgcagctccctgtgaatctgaggcatttttcaaacaaatgtcctcttgggggaacacaagcatctcatccttctattactgtaaatcctgcctccccagtcagtccctgctagttcactctcttcctgagtgaaacctccacgtggccctgtgtggcgtgtggcgccccctcacggggttgtgagtctttgtgcctcatcactgcagtccatctcctctgtccaacatgggcatcatgtgtttggccgtcttcagaacctagaatgggactctctccctcaccaaggggtaaagaggagacgagcaaaacaaccgccggcactaacagaggggcctggccatggtggaggacacttaacagctttaattgactgttcctttgctcactaactggttcccgctttggggagacccctgagactgagctgcccattgctggctggctcccacggcagttcttgtctctcttggaggctgccatctctttcctttctgaaatgctcctcttgcctccttcgaaatgagaactattattaactggctatctcctggcatgaggttctgttagctgggacctatgtctgccaggttgtcgctgagacccttgccaccaagtctgagatggggggatttaaaaagccccctgaagggatgatgggaggctgctccagtagaggacgggggtggtgacgacatagtgtctgaactggtgggcacttgcgagtggtcaggctggagccctggcggatactgacttccgtgtattacactcagcctggtgactggagacggatttcttgggcgatcaccgggtcatctttccagtaagaacttaggaaaggaggagtcccaggctgtcaacatgggaagtattaagactgacaccccagctgcctggcaggagtcagtgcttctcaggtgagggtagtggcctttcccttcccctgggccgctgcttcccttgctgctgtcatgtgctctcctcaaccccagggatgtcaaattccacatgcatggtggccgacggctccagcactgatgaggaaaagtagggagcctttggaactctcctggcctcctcatgcagaagtcccagcccatgtgcctgtgctttgcttgtgctgctgcttaccagctgcctaaggactcaactgctgatcatggggcttgaatgcctccgcctgggacacagacaaaatgactgtgggatagggactccatcccagaaaagctgactggcattccccagaggctgcggaagatcaccacccccccctcctttccccataaccattcagaaggtccacactatgaataatctcatggaaatgaaaccccaaaaccacaactatatggctagaaaccctaaaaggaaaaaaaaggtaggggaggccctcctggaagaacaagatggggccgtagcagaggacagtttcagtccactgacctctgaactgtgggctgattgcgccgcatcactctgcaacttatggttccacttcaacaaaaacctgatcccagggttatagggaaagatacctgcggtacccctgaggcacagagaagggagaaatccaaacctgacttgagtccagggttcttaaaccacacaactactctgaaggaagaccttaactctgatgataccaattttgggttgtttgaaagaaaaaaatgtacaaacatgagtgggtaaaaagaacaaccttccctaagtatatccagttacaaaaataatggaggaaagggaagaaagaaagaaggaaggaaggaaggaaggaaggaaggaaggaaagagagaactacaaaacaggaaaaagggatgaaagaaagaataaacccagacatggacaaaatcaaaattcatactaaaacagaggtcttataatctgacctaattggaaattcactacttactaaaataatgtataccaccacaagataaaaaggtactgattggtgtttgcacctctacagcatatattctgaactaaccttaacatctgctgaaatgtgccaattagcatcccttcacagactatcagtagcagggatcagactttgttatacccgggatccactaaatttaaacattgcactctctataatccttgcagagtaactgcatttagaatagaggactcatagttatgcctcacctttattaccttgcctaaatttcccttagtcatagaaacctctgtccatagtggacctggatgctctggcctaatgagcaataaattgaaattaaaccatttgcacttacatattgacctcataaaatgtgatcttgtggaactcctcttctgtttattgttttaaaactttatttatttttaaattttttctttttaggaatggtgtcttgctccaccgcccaggtctaagttaagtggcataatcatagctcactgatgcctcaaactcctgagctcaagcagtccttccatcttaacctcccaagtagctaagattgcagccatgtgccaccacacttagctaatttattaaaaaaattacagagatggggtcttgttatgttttccaggctggtctctaattcctagcctcaagcaatcctcccacctcagcctcccaaagtgctgggattacaggcatgagccactgtgctcgccctccccttcctgttaaattagcaaatattgcccaacataaattacaacatgacttcgaaggatccaaacttatcctaaaagacctaattacttagtgaaggggtgattatcctcactgcttcaacatttagcagtgcagtttggcctgttcttaaacctggaaataataaatagtgtttcacagtgaattgcagcaaccttattgctgtcctcctgcccattaaggccccatacccaatccctgacagtattgaaattactgacaccatctatgatggttaattttatttgtcaacttgagttgcccaggtatttggttaaacatgattccggatgtgtctgtgagggtgtttcttgatgagattaacatttgaaaaggtagattaaataaagcagtcaccctccctaatgtgagtgggatgcatccgatacactgaaaacccaaatagaacacaaaggtggaggaagagagaattcactccgtctgatgatctttgagctgagacatagatcttgtcatgcctctgaagtctgacttggactgtaatggaagccatcatctctcctggttctcaggactttagactttgactggaactccactgttggaagtcctgggtctctagcttgctgactgcagatcctggaacttctcagccttcatagcctctgtattagtcatggttctccagagggacagaactaataggatagatgtatatatgaaggggagtttattaggagtattgactcacgatcacaagttgaagtcccacaataggccatctgcaacctgaggagcccagaagccagtccaaatcctcagaacctcaaaagtagggaagctgataattcagtcttcagtctgtggccaaaggcttgagagcccctggcaaatcactggtgcaggtccaagagtccaaaagctgaagaacttggagtcttatgttcgggggcaggaggcatccagcatgggagaaagatggaggccagaagactcagcaagtctgctgtttccatgcctgctttttatgctggcagctgattagatggtgcccacccagattgagggtgagtctgcctctcccagtccactaactcaaatattaatctcctttagcaacaccctcacagacacacgcaagaacaatactttgcatccttcaacccaatcaagttgacactcaatattcaccatcacaaccacatgagccaattccttacaataaacatatatattcatgcaactggtaaatattttcttgttacagatttggctaccatgttctttttgggcctattttaacagagtctcagtcacagcctgccttcgtctctgaagggaccgggcgacccacggagtgtctcggcagcctcgtcactgcacacaatcttcacagacaagatctcactgcagccacctttctacaggagcacaggtgtgacattatactgatgacatcattctcagagaaaattcattttacacactaaggacacacagatacaaggaggcttacacaaagggaatggacctttccccaacacagtagtgcaaggccctgccactttggctaaattcctgaaaattctttggtaaactgagggctgatgtatccctgacactttcaagaagtggttattgaccctttcagtatccacaatgttaatacaagtccaatattctttatttatgtatgtattttttgagacacagtcttgctctgtcacccaggcaggaatacagtgtctcaatctcagcttactgcatccttgacttcctgagctcaagcaatcctcccacctcagcttcccacatagctgggactacaggtgtgtgctaccatacccagctaattttatttattgtagagacgaggtctggctacattgcccaagctggtatcaaactccttggctcaaccaatcctcctgcctcagcttcccaaagtgctaggattacagatgtgagccactgtgcccagccctttaattatttatttggggtacaggtgacaacatattcctcatttacaaattttacttaatctcactgatgctgtcgcttgaaagctgacccaccttgaatgaagcctcctccaacaagtctggaatctgtccaaatttaaattaacaggtgctcctatgaattccatcagagatcacactgtagttgcttgagcaacctcttcctgtgcctcctgaagtatctgggttgcatatggtggccataagctgtccatgggcttctgatgtgaaaaacaaacctgccccccttttgaccctgtgctgtacagcatcagggcagtgattgctgaccacatagtggaccctctggaaacagagggctccgcgtccatgtccatgagccttcatgcccatctggccatcaggccttgggaagcagcaccccatagccttgacacagttacagagatgtccttgccttagaatggagtcaaatatgtaccccctgcaagtctcatctgctggaagcactggccttgttcatcctcaggctgtggtgctggcactgccctccttcatcctcaggctgtggtgctggtactggcctccttcatcctcaggctgtggtgctggtactggcctccttcatcctcaggctgtggtgctggtactggtctccttcatcctcaggctgtggtgctggtactggcctccttcatcctcaggctgtggtgctagaagtcatccctctcccaggccccttgggatcgactgagtgacgagcagtgaagtttgtcctccgtctgaatggatgccatcattggacgtgatggagctcagtggaatgctgctgccttccctcccttagctaggctgtccctgataaaggatgacatccaagcctcagcacgaccggccaaacttgagatggtcgtctcagcactgatgctgggccaacaattagccccatttgtacatttttacaaaccttttggcaatttccaagaattgtccacctcccctccccattgaactaaagaaacttcttgtctcatggatactcagaataccaatcaaggcaacagatgcttttattttaactaagtacacagtacggatctcacagggacactccttatcccctgcagagttccagacactactgatggtgaccaaggcaacatttcatcagaaaacacagtgctgggcttgtgaagaaggtgtccagtagagcttccactgcccctataggctgcaggcagctgctttagttgagagactgagctcctcaaagaattcctatttaagttacaaagcagcgagtggatgccctgctgggttccactgttgccacagcctttgattactctaagttcatgctccttaggaaagtgcactttttacaccaatgctacacagttctctcagttgcctttactggtcatcaaggagttcacatttttgacaaccattcagtcctggactgtccaaggggtggaggtagctctgtacaggaagctgcctgctgcctgtggatcactaatatcagacttgcccaaaaactcactgaaaccactcatgaaaaccaatgcatggggaatgtgtgacgttacccagatatttacgaacacgcttgtgctgccagagaccccagatctctaaaccaatgcatggggaatgcatgacgtcacccagatatttacgaacacgcttgtgctgccagaaccaatacatggagaatgcatgacatcacccaaatatttacgaacacgcttgtactgtcagaggcctcctatcttgccttctgctaaacaaatgggggcagtagctttgcatcggcttccgcatttcattactcgtaactgtggtcttcctaatttctcatgcccaagcacttattacagtgtctctacagccttctctcagcctcttaaaatattagtcatcattaaaataaatacccaatgttaaagcatcagatgtcaatttgtattgtgacacctaaaatttcatgctgcaccccaccagttcctcagcctaatggctttcaccccctgcccgactgcaaaactcttcaaataagtcaagcactttcccccaagggactaggggccacccaccctctgatgactcccaagcctgcctcccacaccctctgcttgttctttctgttcctgagtgcaacccccacatagatctggagagatgcagcagcatcctcccctgggctgagtatgagtaactaatcaattactgtcagtttcatcgtctcagtgtttgttgtgtctgtagccacccccagaactctagggcaagaccagcttcttcaccaactaggaattcacaggaaggaacccaactaggaattgccttttttaaaaaaatcccttcccaccctcttaattacgtaatgcatgcatttttatagctcttttgctcattccattatctgaggtcagccactgatatttaacccatccttagccttggaggagggcagaggaacactggtcatattgatttccctagcagcaacgacatggtttcctcctgtgccactcaagttctcttcttcttcaacttgatggtcagtaggttgtgtttcacttatctttgcagattgttaggaagatgagaatcagtcttcatttttgatggtgccatagagaagactctatggtaatgtttatttgcacaaacaactttctcttcttttcccccagaaattacaaactcttatgtgagaaacagctttctggattctgcaaacatagtttatcctccctcttttgaaggcaaatttcatatattcccacaacaataatacactcacatataattgtggcatgtcatatttactggccactataatgagaaaattctccaattttaaatccaggttaattgtgaaactttgggtagtcacagaaaaaaatctctgtgtacaaatttatagacctcttattaggattaagtgaggtatgaataactaatatttatattagttagcgtatggcagaagcttcttgtgtattattttatttcatacttaaaacaatattctatgcaaaatgctataatttccccttgcctccaatttacacatgataaaactgagcctagtaaaattaagtatcatgccccaaagttctctgcttagtaagaagtagaggcaagcccaaacctaagtcatctgatttcagagcccatacagttaaatgctctaaatgcagcttcccgtgatgatggtgactatgagagcctgtcacatatgatgtaggacagtgcttccctgtaacatgcacaagattcccacgatgatggtgactctgagaccctgtcgcatacgatgtaggacagtgcttccctgcaacatgcacaagattcccgtgatgatggtgattatgagagcctgtcacctacgatgtaggacagtccttccctgtaacatgcacaagattcctgtgatgatggtgactatgagagcctgtcacatatgatgtaggacagtgcttccctgtaacatgtgcaagattcccgtgatgacggtgactatgagagcctgtcagatacgatgtaggactgtgcttccctgtaacatgcacaagattcccgtgatgatggtgactctgagaccctgtcacctacgatgtaggacagtgcttccctgtaacatgtgcaagatcccatgatgatggtgattatgagagcctgtcacctacgatgtaggacagtccttccctgtaacatgcacaagattcctgtgatgatggtgactatgagagcctgtcacatatgatgtaggacagtgcttccctgtaacgtgcaagattcccttgatgatggtgactatgagagtctgtcacatacgatgtaggacagtggttccctgtaacatgcacaagattcccgtgatgacggtgactatgagagcctgtcagatacgatgtaggacagtgcttccctgtaacatg

SEQ ID NO: 2487 - DNA, 786 bp, Homo sapiens
attttcctgcccggaaggatgcatggcccggggtctcctgcacctgagggtgggcgggaggcggccccgcgggttgtgttgctggaaaaaggggtctcgatccagaccccaagagagggttcttgggtctacttcagggaagaattggaggcgagtcacagagcgcagtgaaggaagcaagtttattggaatctactccgttagagagtgcaagtcctcagactgcaggaggaggaactcccgtccttcggtagtgtcactacttagaggcagctgtgaggagctgtgattaatcgtggaatgtgctgatgtgcccactaaagcatcgctgtccttgtcggtgagaccctggctttagggcagacaggaccacgtttcataagttcatgctgtcccagcagaggaataacgccagaaagtgttccagtacaaccagagaaagagagtccatgagaaatctgcccttgtgaagttggaatcccctcaacctcaccccgctgacttgaatgaagcgactgagacgggctatgatggagcagatccggttgctcgaccttctcccttgcaccaacacatgtagttaatagttactggacatgcatattcagtgggttccaggtaccaaacttgtattgaatggtatgtgccagacaccgtcttgagatctggagaataaaaaaataaaaaaataaaaacgagacatccagagcacagtagccttgcggtcttcctggaactagagaaaattcagcccttctgctccttgggaagctatgtttgggaaaa

SEQ ID NO: 2488 - DNA, 1171 bp, Homo sapiens
gggcaacgtgggggcctatccgtagctttcagcgtttcctggaccctaccaggacaagaatcgcggggagaggtgcgaagaaggtctggagaggaggaggcttgggacaatgcagagtcctggaagtgaggctgaccgctgaccgctgtcaggagggacatggaccgctgccggggaatcatgggatttcccaccggcccagtcatctcccacgtcgggaaaagggaagagctgcttccccatggcgtgtgcgcgtgggaagggtctcgggcagagaagaggcactttttctgtcctccaggctgtttccgccaaatgaagacctgggctggaagagccaggaacaaagaggagagtcgagtgctgagcacccagcgggagaggatgcagcccggtcatctcacacctgctgaccacacaacatcgtctgcgagttccccccacctacttcgcctgcagctgccatttgggaagatgactcttgcctctttcaccgtctgttttttagattaggactcacgggcctagggcaggagtcagctcttccagatctttatcgaaaagtaacatcacacttgtgcccaggggttcgagaccagcctgggcaacaggacaaacccccttctctacaaaaaaacccacaaaatctgtgtggaaggtgtgtgaacccttgggaaacagagttgctgtacacgtgtatcaggccctgagccagctgcagggtgggcattactgcttggtgccctccgccctcactcttcctccctggatgttgaggatggccccgtaaaccttgttcataggggtccctcgttttctgagacacctcatctgagcactgacgaggggacacaactcttggctgggaagcaggagactgagcattgccttcaagccatccccacacatgtgacctcagtcagcattctgccctttcatgggtgtcagttgtctcgtccataaaatgggatgatgttcttgttccagccggcatactggatgactaaatgagggaacagttcaaccccaccgccacatcccaccacgaccacaggcatggatccagacaccaccaccaacatcctctgctgattccacgtacctaccattgcccaggccgtgaagaagcgtttgggaggaagggaaacctgaaagagtcacaggaccacag

SEQ ID NO: 2489 - DNA, 38129 bp, Homo sapiens
gcatgttttactaaagtcatgtacacagctgtgatttgaatggcaatatttatcttacatctgtgaaggctgattttcctgacctttgcttcagcataattgagttaaacactcaggggactgtgttactatatttaagacaatatgcataacgggtgttatttagctaagtggtgcctgcccagtaggtgctcaggatccagggagagaggcagactcaacatgcaaacaactcttctatgagggtaagtgtaattgagggccctaggagaactttagtagtggagggtttcttgtgtttctccctttggactgcctaactcaagcagtgttcttgacccatataagctatgtagtgtttcccctctcttatctactgtactaatttctgtgtctctcttggaaattactgccctgatctcgaaacttaacttcacccattgcttggtgagtggtgtggaaaacttctctcgggtctatgtcttatccctgaaaaatcttgccacagctgctcaggaagagtgtacaaactcatttccccaacatgaaagtcacaaaaattttgaaaaagttttccctaaaattgctgtgagaaggtcttgctgattatttttgttctcaattatatattctttggggggaaagcctgtagcttgctcactcatgggacagatctttcgtgggttacatgaagagcagatctgtgaatgttgtcatcccctgcttgttcctgctttcttgtggttaccatctttgtctttaacctttagtttttggctgagtgaaaaatttccagactcctgaaatcaccacaatcagatacaggagacatagtagagctcacttgtagaaagtgtcttttttctggtacagagaagaatggtttagagacacccttctctagtatatgccataaaatagcctatctaaaccttggaatattattgtgttaaagtacatgtagcatgtgtagcatgtttaaatgtccttttatgaagaatttaaagcaaaaaggaaagaaagaaagaaatttacatgcaatgactaggattaaaattattgctgtaattgattaacaaaatttactgtatattctggaagtcagtactcaaaacaaaattatagaaagtaataaatatgttaagtaccaaagagatatattgtagtcctggccatatgttaaattctttcccatgtgaaacattacataggggacaagggtcattcacaattttattacaaatataaaaacagtttacacgtggcaatttctggataaaagtttatggcagcaagaataacacattcaaagtgctcttagaacaaaagtaaaattatcagaaccatgaaatcccacagtttttgctaaattcgtttctcaagaaagactatttgaaaacaaaataaagaatgcatttgtataatcttctttcaccatcaaacacacatacttctaaaatacaaaaactttcaaattatcatctgtgatcattggataattcacctgtcttaaagtttctaaatcaataaatttagtgaatcattgttattctgaagagtaaggaaactgagtaattatcctcaatcattgtgcatttgctactgttacaatgattcctttagtgcttttaaactttacatcaaaacccaattgctcacagtggatacctgcccatttgcacaccatatactgacttattttcttttcctgtcttaagttcccattctcccaccagtgattcttgggttcgtctcccaaataaactactcactcaaatcctactcatagggtctgcttttgggacaaacaaccctaacaatatttaaagaaagtttaaatattatttgtcaaaatatgttctgtgcaaggaaggatatgtggaataatcttattgagaacaattatttttcacaataaaattcaaaaggaatttgaggtatcaactaattgagatttattttctatgtatatcaagctgtcatatattatgtcttggttttgatattttacttttgaagctggcttctgtgtattttctctctctagttatctcagctgtggtaaaagtagtctgcattgctatcaccattgcttagagcaaggtggctggataaagtgatgtgactatcaaagggtaggataaaaatttcatcttaaatattccttctcataatcacataatcctttaaaccaaggatagcctgaaagaaaaaataatgatcctaatttgaagaagtctcaagaatccaaactttaacattagaatgtatgagatttagaaaagaaggcatcatcaactatgagaataccaaaaggaaaacatggtcccataactaccacatatcagtcagcaaacagaatttctcccaagcaaacacagttggaattgcccatggggcaggtcagcaaagagtggggctctttgtttttttttttttttcctgtgggttccgctatgtcagtaatggaaattgtgagtcatctctgtgtccattgggaaagcatgtcatctcttgtgcctggcaagcagctcatcgcatgagagagcctaccaggctcaaccatgaattacataatctgccttcaaaggaatcagaggattaaccaggtgttcctaagatattacataacttgtgtatcttggagagatacacagatagtttcaacagctgccttgataaggagcataatttctcaggagagtaaaaatatatgttcttttttctctaaaattgaaatatatatattttttcactaaatgctaaatgtggttttgatttggttggttagaaattaacttgttttggtatttttcctatttaaaccatcaaaattgtttttaaataattttaattcttttgctggcaggtgaaatggaataacagggattgggcttacccctttactgaacaacaaagaaaagtgaaattataagagaaatattatttatgatattgagtattgggcaataaacaggggtaattttgatgagacagaaaacaaatgaggtgagaccctgtgattgcctgttgggaagattttcagagaaaataaaattgagggtctggggagaccaaagcagttagagttagaccaaagtcagttaatattagcagatagaaaaaaagcagcatgaagagagatttctagagaaatgaggagactcgtcgtcaagtatgcagctaaatactgatcagtgcatgcctgtgagaaaactacctagaaaaactatctgaaaagattggcataacaatgcccagaagtcatacctattccaggaccaggaatactgcctattagcaccagccagactggaagacttcaagacttataaggcattggatagaatagaatagatagaacagttttccttcagtagataaagcaagttttaagttgttttaacttaagcaaaagcacaaaggaagaaactgtttctaagtaacttgcctgcatataagaataatgctcaagaatatttatagtaatataacaatatccattattcagcaaggtggaattcacaatgtctggtattcaacaaaaattaacaaacatacaaagaagcaagaaagcatgactgataattacaagaaaaattaattaaaaccaacccagacttaacacatatgttagaattagtagacagggacattgaaacaatcatcattttatatttcatatgttaaaaaaagttagtagtattaaaaatgcacccctccaaacttctaaagatgaaaactgcaatgtatgagatggaaaagaaactgcataggattagtggtagagtacatatttcagaatgaagaatagtgaacttgatgctatagcaatagaaactattcagaaagttacatagagagaaaagaaaattaaaacaaatagagcataaatgagctgcagcacaactttgagaggcccacttatatatgtaattgtagtccccaaaggagatagggctaaaaattatttgaagaagcaatggctgaacattttctgaatatgataacaaattcaagaaactcaacaaataccaagcataagaaatatggaaacaatatgccaagaaacatgacaatcaaattgctaacatctagtgataaagagaacattttaaagcagccacatggagaatatttcacagatgagaacaaagataagtttggcagcatatttctcatcagaagagatatgttttaagtattgtattaatatacttaataaaaagtgccataagagcttacatacacttaagtaccttaaggtgcttaattagaaaatcttaactgaaaattttagaccagtaaaaatatcttgcaaaaatataagtgaaataatgacttttttgaaattacaaaagctaaaatcatttattattagcagacctgtactgtaaataagcctttcagacagaagaaaagtgacatcagatggaaataaagttctccacaaagaaatgaagagcacaagaaatgatataacaccagaaaatacaaaacatgtatcttattatttaaatatctttgaaaaaaattgaccataaacaaaaaaaatgtaatgtggagtttataatcaatgtgcaattgaaatgtaagacagtgatagcacaatgattggaaagagaaattggaaatatattactttaaatgtcttatactttatgtaaagtgatataatcattttaaggcacattgtaattattttaaaatatatactacaagccactcaactaatagaacaaaaatttgtaattaatagctcctcaatgcagataaaatgaaatcatagaaactattcaattaatccaaaagaaggaaggaaaaagaagaaaaaaatcaagaaaaacaaatggtaaataaagaaaacagttaaagttgttagactaaaacataataaaatcactaatcacactaaatttaaataattcatgtatctttataaaaaggcaaaaaattggcagattgaatttaaaaaatcaagacaacaaatgtgctacatacaaaaactcatttcatatacaaaaacacaaatatgtaaaagtaatgctgaaggaaagaatactgcattaacataatatatcaaaaaaactatattaatgttagagttgatttcaaagcaaataatattaaaagggataagtacagtaattataaaactataatgaggtcaatttatcaaaaaatagtagcttgtaaacattcatgcacccaataatagtttcaaaatacatgaattaaaaatctcacagaattattaaaagaaaagtaaaagttcaccattgtagtaggatttttaactttcttctataaataagttatagaaaattagaaaatcagtaagaatataaaacatttgaacaacactaccaagtagcttgatgtagtagacatttatagaatactccatccagcattattataatgaccattattttcgaaggcacaccaaatatttaccaaaaattattgtgggctacaagtcagaccttaagaattttaaaataattccagttaaagtgttttctctgaccataatacaattaaattagaaagaataacaaaaattcttgggtaattcccaagtacttggaaactaaataatataattctaaataacatataggccaaagcaaaatgaaaggaaacactgaataaaaatgaaaatatatcaaaatttatgagatgccaattaaatattatttagaggaaaatttatacactaaacctttatattagaaaaaaattgactcaataacttcaacttccactctaaaactggaagaaagaaaaaattaaacccaaagtaattacacaaaaggaaacaacaagaatcagagtggatagcaatgaaatagaaaagagtgagatgatagctacatcagtgaagcaaaaatctgattatttgagaagatccataaaattgatatacttccagcatgactgatcagaaaaagaaagttaaaaattaacaataccagaactaagaaaactgacaacattacaaaagttacagacattagaatactgttaaataaatattatagagaactttttccaataatttgacaccttattaggctggtgcaaaataattgcatttttgacattacttttaatgaattaaatagatgaacagatttcttaaaacttacaagttatcaaagcacacacccaagaagaaacagaaattctgaatatctttgtaaatgtttaagacctggaatgtgtagttaagaattaaaaacaaaaacaaacaaacaaacaaaaactcaagtcctaaatggcctcactgatgaattctaccaaacatttaagagagaagtgttaataattttattcagatattcttggaaaattgaagaagtggaaatgttttccaaaagcatttccctgataacaaaccagaaaaaaacataagaaaagaaaacttaagaccaacattccttgtgaacataaatgcaaaaattataaatgaaattttggcaagtcaaatctaattagatataaaacattatgatatcatagccaagtatagtttttcccaaggatgctaggttaaatgtttaaaaaattttcaacataaattactaaattaacaaaacaaaaaagaaaaccatatgattatctcaataaattaagaaaaagattttgataaagaccaatatttattactaataaaagtgttcagccaagtagaaatagaaaggatcttcctcagcctggtaaagcacatctattaaaaagtggcagttaaaacagtacttaatctggaattatcagacttaagacaaaaatattcactctcactacttctattaaatatggtattacatattccagacaacttaatagttaaaataattttaaagtattcagaatggaaataaataaaacactatttacagatgccatcattgctatgtagaaaatccaatgacatttacacaaaagatactagaattcatacagtacatgcattcattaaggctacagaatacaaggtaaatgtacagaagcaaatcgggctttatgtactagtaatgacaatttggaaattaaatttaaaatacctccaataatagcatcgttataaaatatatacagataaatttgataaaataaataaaagtcatatactgaaaattacagcattacctagagaatgagagaggacctaaataatagagagataagccatcttcatgggtcacaagatgatattattaaattatcaattctataagtcaaaccctggaataaatttttggtgaaaattataaattgattataaaattcgtatggaaactcaatgaacctagaaaacttagaacctgtgaaaacaattttgagaaaaaaaaagaacgaagttgaggattaacaatttggggctcttatactgatttaggggcattataaaactacagtaatcaaaacaatgtatatttgaatcatgatagaaaaatagatcaataaatcagaatggagagttcaaaaatagaatattatatatgtggacgatttatttttcatcaatgtgaaataagcaattcagtggagaaagaaagtcttccatcaaacagtactggaacattcagatagccataggaaatgatgtgaactttgtttcatatctcacaacatatataaaaaagactcaaaattcatcatagatctaaatgtaaaatctaaaattataaaatttctagaagaaaacataggatgagctttgcaaccttgggttaggcaacgattttttaaatatgaaatcaaaagcacgatcatttaaacaacttgataaaatgaacttcatcaaaattaaaaacatctcctctgtgggagatatcattaaggaaatggaaagagaagttaccaactgggagaaatcatttgcaaatgatgtacctaatagtggactggtattcagaatatacaaagaactcttaaaacacaacaataagaaattaaacaaaccaataaaaaacaggcaacagactttagcaaataattcataaaaatacaaaaagtgatctataggtacaagaaaagatgcactcagcatcattaatcattagaaagatgaaaattaaaatcacaattagcactacatgccaactagaatagctaaaatttgttaaaagatataccatactaggtctttgtgaggatatggaagactggaatggtcatacactgttagtggaatgttaaatgaaacaaccactttaaaaagcagatgacttttttaaaaagttgatacactgactatattatctaactatttcattcctattttaaaaaaaaacgaatgtttatgtcctcagatgttacacaaatgtttttatatatatataatattattattcataatagccaaaaactggaaacaatggccatcaacatgtggatggataaactaactatggtgtattcatataatgggatgggatgcttctcagcaacaaaaaaatgaattgctgacccatgctttactcagataagcctcaatataattatgttgaataaaagaatttcgacaaaaaaaaccccacatactgagtggtctccatttatataaaattttaggaaatgcaaatttacatgtggtgacagcagatcagtggctgaatggggatagaggaacacgggaaacatcacaaactttttagagcaatggatatattcattgtcttgataaaaagtggcagcacatcagaaacttcctttttgtctctctgggtaatgagtactatttgcataatttgcttcactctgtttcattggttccccaaaatggatgttgctaaagaaagaaatattgttacatttgctaatggctggaccctacccacttatattttgagtttcttcatgacacaattgtcaactaaactttgtagtagatattggtcacaggatttgaggtttgtctcttttcatgaaggaaaaaaggaagattcaaaaagctatgctgtcactgcttctatttttttcaaattatcttagcaatattttgtagttttcagtgtaaaggacttgtacatctctaatagatgtgcatattctaatgaaaagtattctaaatacttttccattagttatttgatttataaatgctcttttgatatcactttaggatgtcattttctaatattcctttataaacatagaaaataaacacatttgattttcatatgttaattatgcatccagagttgtatttatcaactagtaatttatctagttttctatgtgcacaagtctagcatcatcgtgggactgcagtatttcttcttttaaatccttaaagcttttacttattttgtgtgactcattacaatgactatgccctctagcacaatggtgaataaattaatgtagtaggcactctttttgtgttcctaatggtaccacaacaatgatgtttgctgtaggtagaatgtaccctttcaatactaattttctgaggatttatcatcttgaaaaaattttgtattgtatgttggtttttattgtttatcactaaatggacacacttgtttattgtgtttatgtgctgaattaagactgatattaaacagcttttatgtcctgaaataaatgcaaaatatatattgctggatttgatttccagttcatgatgtgtttagagtttttgtgactaggttcatgtgaaagattattctgtaatattattttattaataatcttgtaccattttgatttcaagataatgattgtctcatcaaataaatatggtgggtagtgttttttatatcctataattattttttggttggggggatagagtctgaccttgtctcccaggctggagtgcagggttatgatctcggctcactgcaatctccacctcccaggttcaagcaattctgcctctgcctgtaatgtagctaggattacaggtgtgcaccaggatgcttgactgatttttttgtattttcagtagagacagggtttgctttcaccatgttggccaggctgatcttgaactccaaacctcaagtgatcttcctgccttggcctcccaaagtgctgggattacaggcgtgagcaactgtacccttttgtatgatttttttttaacacgcacatttatcaattaagtgggcacagtttgtggtccaccaaaacaattacaacagtaacataaaaaatcacactgaacacagatcactataacagataaaatagtaataaaaaattttttaatattgcaagaattatcaaaatgtgacaaaaagactattgacatcatttttccacatcatgttttgtctgaaaattttaatataagtttggttttattccttatgtatttggtaaagtagtataggcttacttgttgggtattttgaatgataaatttaatttctttaatagatttaagatgattcatatttctttttgtgtccattttacaaatctgttttttcttgaaatgcatacatttcgtctgaaatttttgattgatgtgcacaaatacattggtatttgatggataacttgattgatgtattagtccgttttcatgctgctgataaagacatacccgagactgggaagaaatagatgtttaatggacatacagttccacatggctacggaggcctcacaatcatggtggaaggcaaggaggagcaagtcacatcttatatggatggcagcagacaaagagagaacttgtgcagggaaatttctctttttaaaaccatcagatcttatgtgatttattcactatcatgagaaagtcccatcccatgattcaattacctcccactgggtccctcccacgacacatgggaattgtgggagttacaattcaagatgagatttgggtggggacatagtcaatccgtatcaattggcattgtttaatttcctcttaacttttaaatatctataacaatgacccttttaaaaatttatgtcgttggtttttgtacctccttcctatcctctctcttctttctctcttcctccttttctttctttctctgctctctgtctctttgtctctctctgtcttgcaaggggtttatcaatagtatcaatctggggttttcaggtttttctcctttgtatttcttctttctatttcactattttataccttctataattttagggcttaatgtgctgctatttttgtttcttcttaagattgatactattaatactctttcattattatgaaattaccctttttatcttttggagtatattttttctttcagtgtgccctcaccatagctgtaccagagtatcttttaaccttattttgctttttaaacttccactatctatttttatatttaaaatatgtctcctttaagtagaaatgggtttctgtatgtagcccaacaatctttttctgacaactaaagtatttaaatatatatagcaattacttatattttggggtttatgtaatcttgccatttattttctgtttcgtctgttctttgctccatattacattatttagtttttaaataacattattattatttgttttttagacaggttctcactctgtcactcaagctggagttcagtggtgtgatcactgctcactgcagcctcaacctcctggactcaagcaatcctcctgcttcagcctcccaagtaactaaaactacagaagtgtttcaccacactcagctaattttttaattcttttgcagcaatggggtcccactatgttgcccagtatggtcttcaacctctgggctcaggcaattctccacctaggcctgtcaaagtgttgggattacaggtgtgagcccctctgcctggccttttagtcttttattgtttttaatgtttaccatatatattataatatgcatccttcactgattagaatatacttttattactttcacacttcctgatcaatgaaagtgcctgaaaagttccactctgatttcttgcactatcaataatatggatattaattttacatataatttgaacatgtattattattgttgttattattatgttctaacatttaatatttggttttgatatgctctgatgtttctccttccttgtgctttgtatccttcctttattattatgctttgttcagggattattttctttctgcctagataattatctttggcattttatttagaaaaagtattatgacctcagcttctctgaacttcttgtttcaccccccaaaaagaaaaacaaataaaaaaaggcctttatttagccttcatttttgaaggagatcattttctaaatatagattcaggcattttctttcagcgctgtaagtgttctctgtctcccattgttttatttcaaaagtcagctcttaatcatattattactcatttgaaactaatgtgtcttttatttgcatgcttttaagattgtcatttggctttagtttttagcagttttatataataggtgttattattttgtttttagctgggctgtgattcatagagcttcttgaatggctccaaagacttgatgcttttcattagttttgggaaattcttagccaacatttcttctcatacttctatttttttcctctgtcatttctcctttttggaatccagttacaaatacatgaacctttttttcaattatgttccacatagctcttattttatatttcatttaatttacttgcttgcttcaaactgtatattttgtatgtgtataagtatgtgaatctattggtaaatactttatttcttctactgtggttaatcattaatctactattaaagtcatctatatcttaatttcagtattttgtaagatccctgatttctatttgatttttaaattaaattccaattctctgatgaaaatattccatctttgtatttatttttggaacatattaagtttagtcctgatacctcagatattttgattttctgctgctctacttttaagtttttctcttacatttctcagtcatttggttctattctctggcatatctgataaattttgactgaatcccaaatgtatatgaaaaattgctggcattctcaatgatatctttcttcttgggggctactaaaatacatgcagattaccttgtttcagcagaggatattctgtttctagtttgcttctcactctatagttgttgccttttcagggatccaactaaaggcctgagatttttgtaagtccatctttttcctcttttttttttttttttttgtagaaatggggtttcactatgttgctatgttgcccaggctggttttaaactcctgggctccagcaatcctcccgctttggcctcccaaagtgctaggatctcaggcatgagccactgcaccctaagtcccttgttttgtaatgatcctacattctaattttcatcttccccgcaccaaaatactgccaaactatctgcctaaacttttagtatctcagcagttgatttctgcttgaattcttagacatatgttcttcaaatgcaaattttagcattcagctagtgcctcaaggggaaattttccacagaatgttatgcccatttctctaaagttcccttttactttggagatcttgatccttcaaactcttactgatttgcttgccatgcctgccaataattgttttcttagcctactcagatagtcctaaactccagagactctctttttgatatctatgcactgtttttatttttttacttattagacatttttccctatttcacagctgtaccctcttccacaatttgtttagacaaaaataatatttttttcaagataagactatcaaatggagtttatgtaaggtaacattaaaagtggaccaacgatcttattttctttttactcattaatttatcttatccatgaacaaatacatttaggctatagattggctctatcaattattttctttaacttttgtagtagattttctttctcttttctagtttcatgcttagagagccttagtgcataaaggtctctaaaaggaattaagaccttctggaaatatgattaaaaggtcttccttttgttttacaccatgtatcattcccaatataacataatgttcgctctgcttagaccttgtgctttacatttctcagaatgagataatccacagcctaaatgcatatagctataaagtattatgtgaattgtcaaaggaggtatgcattttttcatgatattctgaattaatcaccaaatacgtttataaaaggctatgggaattacagttaccctaatgcttctgaattgcaaatattccttatttctgttttgattactgttgtctttaattgagtatgactattttatgtgtacggtttagtaacatagctgtttgggctctctttgtctcttttgcaatgaacattgcaaagcagctgttacaagcatatatttagagccaaagggtactctggcttacatatgggaggggtgagggaaggataattgaatcacaaaatgcttgtgttaaaatatgctctgagaaacaatggaaacaggaaaacaatgccagaatggtgtccacagtgaagagaacaaagcctgactctaaacagaggttgctaaacaaatcagtccctatgcaattagatggaaaagcacttagcaacaatataaaaatgacagactagctgaaaatcagcacaatagaagatgactcagactctctaaagtttacatactttagaacattactttcaattccacatagagttagttcacttgcgacttcatgatatggaaatgaaagtgatgataaaaaagaaataatttctgcattacaaacataaagtcaatactaatttgacttttattaaagaaactcaaatccttcataattaattcctactgaaattttgcccaaaatcatacagactttatagtttagctttttttgtaggtataaaattgacatattaagatttctgaacttttgcccagcatttctagttctcttattctttttaaaacttcatattttagatagcaggcctccctggcatctgaaacagcatgattaagtatgaatatacatgtctttacctccctataaaagactattctgtatgacctgtacatttctcttggtgtaacactattgcttcaattttataggctcacacctatgagttttcagtctgccaaaccctcctggtgtgtgtgtgtgtgtgtgtgcgcgcgtgtgtgtgtgtactgtcatactctaaggagaatgtgtcttaacaactggagggtttgtttaatctgacctctttgaagatttgaatatgaaagtttgggatcaaagtttaaagtggagcaaattactctgcataaaattggaagttaatgaattgggggtaagagtcagtgagagagattgagagaagccattaaggctggatgctacataagagaacttgtatgtgagctctgggttacactaaagaaaaatacagaagtatatcaaggaaatagaagtaacataaaatcacagattgcaatcttcatatcagccaagtaaaattcaattaaaaaatgatgaaacctaaaatttaggccatgtttaaacactaaaagtcataatttacaataaagacataaagatttaataattatgtatatgtaagttatttgtctctttatctctatttattatctatctatctatctatctatctatcatctatcatcgatctatgccaagtagcaaaatacccacttttataaagtggaaactacagaggataaagaagacatagacagggacaaagaaatgcaagggagtgcaataatcactgaaagtcaattttttcagatacgtggtaggacttttcaatatagaaattaaagttctctgttattttttacattttctttgtttgggttaaaggagactttcattcattgctctatgtacaagtcacatcaagaggaaaagaaaataaagttatagggggaaaaatcaccttttcagtactctctaaactcttaaaatgtactgtctgctatggtttgaatgttttccccaatgcaacagtgttgggaggtggagcctcatgggaggtgtttaggtcatgaggtctctgatcttatagatgaatttatgcccctataaaaagggcttgctggagtggatttgctctctcttgctcttctgccacgtgaggacacaaagttcctctcttccagagaattcagggttaaaggcaccactttggaagtggagaccaggccctcaccagacaccaaaatctgctggtgctttgttcttagacttcccagctccagaactgttagaaataaatttctggcccggtgtggtggctcatgcctgtaatcccagcactttgggaggctgaggcgggtggatcacgaggtcaggagttcgagatcaggctggccaacatggtgaaaccccgtctctactaaatacaaaaaaaattagctgggcgtggtggtgcacccctgtaatcctagctactcaggaggctgaggcaggataattgcttgaacccagaaggcggaggttgcagtgagctgagatcgcgccactacactccagcctgggggagggagtaagactctgtctcaggaaaaaaaaaaaaagaaagaaattcctattcggtataatttaccagtctgtgatagtctgttatagctgcgagaatagactaaaacagtgtctttccataatctagtacttattgtttcttgcctgtctttccctcctaacaacatgtacttcctgccatatccctagcacttacaacagcatctggcatacaatatttgctgaataaacatctgttgagagactgaacaactgaaggaatgaatcctgtctggcactcaagttttagtctccatccaaaataaatatgttttttgatttattatttcttcaattcttgtttattttccataagtttttttctttctcaaaacttcttttaaaaaaacttcttttttaaaaaaaaaattggaaaaaagaaccattcgtgctgcatcttctctctcttacttcccaggaggaagagaagaatgatcatcaatggcaaaaagcagttgcagcaaagcaaaaccaagagccagctttaagctcaggagagagcgctacatctcctcctcttggtttctggtgctctccaggttcagagacacttttctagtaataaactgaaaaaagatcactgaaagtatcatctttctgagacttctttaatcagatattttgtctggtcattctattcccaaattatcttccatttctcataatttaaaactttgttttattttttactctatattataatacccagattatatttcatcttctaaagctctaattaccttttttattcttgtacaatttaaattcataaagtataatttgtttggtttatttatgtgcttgactctacctagttgctgtgtatgtgtagtttatctcctacatattctatgacagttttattaaaagtttcttcatattatttcattagctgtgcatctgtgggataacatatcctggtaattttattttgttaattttctttaaaacataaaatattatgcattacacactgatttatttaaaagaaaaagattaagatcagtttgacaattttaggaagatcattttggcaatctagaatttttgtttattattagtttttttaaaatttagtaataatttattacaaagcactttgctactaccggggtgacactacaacagtaaataaaaagtttgacttctactagaggatgtacatcatacattacatggaaatcagttcccactatgtctggtccatgcagggtgagcctcaacaagaattagcaattgcagaatttataattgcagaatttataatgttcagcaataacaaattaaaaggtgttgtgtttgagggcaaagacttaagcatttagatttagtaaagctgaattcccaaattaggaaaaaaaatctgattttaagagtttggactcctgaagagatttgtcccacttccggtcacactgatttgctcactttattttgtgacttactggcttagcttgttttcttctatattgctttccttataacaacaatagagagaaaatgggatacattccatatttgttattgtcagaaccccagtggtttagatgtgattgatgaataagatacacgaagttacaacaaagcattgaataatgtgtagttaaaatccagcaggctttataaacaggcacatgtaaatcatttcagcaattttccctcttgtttatgccaattagttcccacataaatgtctacatgtttgaagctattttaaattgattcagcatttttctctcaaaattgcagatatcaaatatctagcatttaaatgctgctttagcctgagactagaagtgagctgcaatgcaactgtaaacacattttgaatgagtggttttgattttatctaccttcatagtttattagttttataatgacatgaagacacagaatacttatcaaaataaggattattttttctgttaaccaaaatgtaaacaattaggtgagttaagttctgggtgcactagctgtgcttctgctttactagtgtctttaaaaagacagaatactgataattttgtacctgtgctactattacagcctgctaaagaagaatagtggacatgatgttctgaaatcactttctggtcattaggttactgagattatatcactcagtgagagccttttcttaacaaggagaaagaactatgtccagagtttatagtgtcttccaaccatgcactgagacaattttcaatgactaattatagcttgagggagcaggaaaaggctaccagaaaaaaaaaaaaaatccatcagaggagttaatttgtagaaagaaggaggagtgcagtttcaaagcaattttgtaaattccaagtgtaactacttgcattcttcaaaacaatttccatcctactgactttaatgataggtcattggtatagaagagataaaacgttcatttcataactgcagtgcctatgtttgtataaggtgtgcccaggaaaaagtcaactagtttttttagaaatttattggaggaatatttgaaatattaaaggctatagtctatatagtcaattcatattataactaaagtctcactccctagttaggcttcagtgttctcacattggcaatcttttattgattattctgaaactttgaaaaaaaaaaaacaactagatagcccccactctaatttttaaatactttcttgaaattataaaattttgctgcatgtttcttgtagtaaaatacattttatagatttgtttaacttacagattttagtggcaccaaaaatttaaaaatataaagtagacttaatcttgccaaatgatgactgaggaatggaatgaaaacaagtgtatacctaaatcctttggctacatttaagttacttttagtaataaagatgtaatgaaaatgaagcaacagccaggcacagtggctcatgcctgcaataccagaactttgggaggctgaggcgggtggatcacctgaggtcaggagttcgagaccatcttgaccaacatggagataccccatctctactaaaaacacaaaattagccatgtatggtgacgcatgcctgtaatcccggctactcaggaggctgaggcagaagaatcgcttgaacctgggaggcggaggttgcggtgagctgagatcatgccattgcactccagcctgggcaacaagagcgaaactccatctcaaaacaaatacataaataagaaaatgaagcaacatatatatcattccaaagctgaagccaaaatcttatcctgaaattagataattattgtcagcaaaattagccataatgatctcatctaataacttacctgatttacatgcaaagccagaataatatcaagaattcagtcacctatcacacagagcacttcatgtgttttacttgaatagcttggtctttctctttcagccatgagtgccagagtgatattttatgcttgtatgaaagaaatacttcaaaaataagaaaaaaactataggataatatgaacacttatggaatagaaagaaggatgacatcacaacaaaataaagcaaaataaatggaggaacacatttggggcagtgaaaaattagaattttctgtggttgaggaagcaggagctgtagagtaaagttgggttgcccagtgagattaaaaaataaaagggctcaaaaaactggtgaagacttgaagaagaaccatccagggattttaagagtgaataaagagataaaatcaatatttaaaaacagttggtgtgataaacagatggaaaggttagaattaaacctggaaaattaaatggctcttaaagaattcaaagtaaatagtggtggggcttctatccagagtgatggcataactaattggaaataagctagagaaaaaaaactttaaaagaaaaaaaaggtaaatatttgatgtctactgcctcagaaacgactgtgatatccatggcactgaagcctggagggagtatgataccatgataaccacaggaaaatgtaggggttaggaggaatggcttaggctgaagtcatgttaaggacaatgagcagttgttaagtcagagatgtgggattcatttatagagaatatacacaagagcagaaaggtaaaaaggtggatattctatactgcattcaattgtttattgattatcaatctattaaccaggcatagtctgaaatactgatacatgtttttttttcaaaacacatattgcaaaagttagttttctattccaagatctctcagttcttttctctaataataacacatttatgtagccaataccgattttttaaaaggacaaacattcaaattttaacctagtccaatttttctaattcatgtgtgaagattttatgaagctctgagttaaaattttcaaaaactagattatttatataaaaattgaaaaactgcctaatggttatcattttacctgtaactcaatcaaagtgttaaccaaatttggactgtggtgaagaattgccagtgaacagtgggtgggatgagaaaggtagctaatttgttttcaaatcacttagattaaaattaatattgctttgccagcataggcctaaacatatgagaattcatttaggaattcagcaattgcaaataagtataatttgctgaacagttctatttacccctgaattctaataagacccattatcataatttatcatttaggaaagcatagtgaagttaaaaaaaaaaaacctttctgactagtcagtgactttacagaaagaagtgttagaatgattatatgtgggagaaggtatccttgcatcagtgcatggttccctttaagggagtaatcattaattatttatataagacaagaagttactctaatagcttgtcaaagtgttgctggtcagaatcatagtgtcttgaaatagcagtttaaaaacaattattattattgttattactatttttacctctgggagcctttattgaatcaaagtgcattttgaaacagacaacattcttgctgctgttaagacaacattctggtgtgcttatagcttggtttctttgatgctcccacccatttttccctccccctcttcttttaggactcagttacttctggactttctaacagaaggaccattctaatatgaaaacatttcattttaggaatacccacattgtaggagtgacacttttttgtgtccattgattgatagaccaattatcaagaggtttcaggctagaaacctcttactactctagggaaaggccctgctggtgaatgttttcatgaacagtaactagctgcatccatctgatttcttatccatgaagatacttggctacacgtgatcgtcctgtaataattgtggtagactgaataatggccccaaagacatctacaggcataccctgtttcattgcacttcacttttttgtgctttgcaggtactgtgatttttacaaactgaaggtttgtggcaaccctacattgtgcaagtctattgatgcactttttccaacagcaagtgctccctttgtgtctttgtgtcacttggtaattattacaatatatcaactttgaaaattattattattatatttgctatggtgatatgtgatcagtgatctttgttgttaccactgaaatcattctggggaaccacaaacaatgctgatataagatggcagactcgatcaacaagtggtgtgtgtgttctgacagctccactgactggtcatttctccatctctctccctctgcttgggtctctctatttcctgaggcacagcaatattgaaattaggccaatttataatactacaatggcttttaagtgtttcagtaaaagaaagggtttcacatctctcactttaaatcgaaagctagaaatgattaaacttagtgaggaaggcatgtcaaaagctgagataggcagaaatctaagcctcttgtgccagttagccaagatgtgaatgcaaaggtaagtccttgaaaaaaatgcaaagtgctactccagtggacacacgaatggtaagaaggtgaaagaccctcattgctgacatggagaaagtttcagtggtctggatagaagattaaaccaactgcaacattgccttaagccaaagcttcatctagagaatggccttaatgctcttctattctatgaagagagggaaggaagctgcgaagaaaagtttaaagctagaagaggttggatcatgaggtttaaggaaagaagtcttttctataaagtcttctttcactttgcacataaaattgcaaggtgaagcaccaagtgctgatgtagatgttgcagcaagatctagctaagatgattaatgaatgtggctacactcaataacaaattttcaacgtagattaaacagccttctactgtgttggaagaaaatgccatctagaactttcatagctaaagaggaggcaccaattcctggtttcagagcttaaaatgtaagctgattctcttgtgaggggctaatacagctggtgactttaggttgaagccaatgctcatttaccgttctaaaaatattaagatgcttaaggtttatcttaaatctactctgcctgtgctatataaatgaaacaacaaagcctgatgacagcacatctgtttacagcagggtttactgaatattttaagctccctgtggagagctactgctcagaaaagaggtttctttcaaaatatactgctcattgacaatgcacctagtcacccaagagctttgatggagatgtgcaagattactcttgttgtcatgcttgctgacacaacatacattaggtagcccgtggatgaaggagtcattctgactttcaagtcttatatttaaaaaatacattttgtaaggctacagctgccatagatagttatttctctcatggatctggcaaagtaaattgaggaaaggagtcgctcttctaggtgccattaagagcattcataattcatgaaaggagatcaaaatattaacattaacaggagtttggaagaaattgattctaaccctcatggatgacttcgaggagttcaagacttcagcagaagaagtaactgctaataaacattagcagaatggaaacagcaagagaactagaattagaagcagaggctgaagatgtgactgaattgctacgattacatgagaaaaaaattaatgtaaaaggagttgctttttatgaatgagagtaaaaaagtgtttttttgagatggagtctactcctggtgaagataatttaagcattgttgaaatgacaaaaaaaattataatattacataaacttagttgataaagtagtggtggggtttgaaaggattgactctaattttgaaagaagttccactgtgggtgaaattctatcaaacagcatggtatgctacagagaaatattttgtgaaaggaagagtcaattgatgtggtaatctccattgaagtcttattttaagaaattgccacagccaccttagccttcatcaaccaccaccctgatcagtcatcagccatcaacatctgaggcaggactctccaccagcaaaaacgctacaacctgctgaagactcagaagatttttggcatttttttgcaataaagtatttttaattaagatatgtacattgttcttttagacataatgctattacacatttaatagactacaatatattgtatatatgttttataattactgggaaacaaaaatatatgtgatttgctttgttgtgacgttattgttattgtctggaagctaacccaaaatatatttggggtatgcctgtacaatcctattctctggaacctgtaaatgttgacttacatgacaaaagggattttttcagatgtgattaagttgaagatcttgagagaaagagattatcatggataatcagggaaggacctaaatataatgactgtcttctatgaaaagggagacagtaaaatacatgattagagagaggagagagaggcaatgtaattatagaagcaaaaggttgcacaggtgcaaaaaaggcgtcatgggcgatggaatgtaggtagcctccagaagctaaaaaaaggcaaggggagaaatcttctcttagttcctccagaaggagctaacctctcaaacaccttcacattagctcaatgaagataatttcagcctcctgaactgaaagagaatacatttatgttgttctaagccatgaaggtgttggtagctggttatagcagccataggaaactaatgcatatgctaatcatgtaatgataaaactagtaagcatgcaatgtttatacaggaaaaagccttcctataaggaatggtagtatatttcactagtagagtactttacagattttagagttcttttaaattattactcccatttgattctcaaaacaattctataagtaagcaggaaagatattattataatacctattttactaatgaagaaattgaagctaagggagcttacatgtcttgtggtaaaaaaaagttatttgactctttgcctagtaatttcttctctatagggtcctgtttctttaaaaaggagctcagaaaagcatctgtaaccagctatatagaccacatttctttaaggaaggcaaatacttttctggtccatagtcagacgcattatccattgcaacactggcctgtgcttgcaaatgttttcttaaactggataaatagaaaattcatcatggaaagacaaccttctaccttaaattcatgttaagcagaagtttattgattggtagatgcaagatcctctctacacaagaaagaattaagcagaatattcatatgaatttatattacttaatatggggtatgccattgaaaggagttagcaagcttgctttaggcaaacagtaaggaaagggtcctggagagcctttgacctgccctgtaggtgcttgcaccagatgttttgtgcagataaaggaacttgcaaagggggcttgcctaaacgtacagactaagggcccacatacaactaggggaatgggatggagccaccagcaattcatgccttatataaatagggaacccaccttcatcagcttgtatgtaaaggcccttgtattcaactctgaagggggcaaccagcaacctgctattagaacccctctttttgctgagagctttccttttcacttaataaattctactccactcattttttcaatgtccgcatgcttattcttcctggtcatgagacaagaacctggacgtagctgagctaaggcacaaaaaacctgcatcattttgggggctcatctgggatacctggtgggtgagtaaatgcagtcccacagcctttcactttcatttctgagccttcttgtcctcagacttttcctgaaggcagatgcagcactgaacctctggtgagccaattaggaatgaatggcacagctacagaggacaggatgcaggagaggaccatgacacgcccacccccgtcatcctctggggttgggaatgtcggtctcgtcccaatccagtcttttctatggcgttttacttctttttttcagtactgtcacggcacctatctcttcttttgtaatgttaagggtgttgctgcaaactgcggagatattactaggtagaatgagcctttgacccagccatcagacatgcaattcagaataatgcgatttccttctgttcttagaggtgtcgcccacccccatcctgatggacatgtggggtgggaatgagctgtggctgccacctgggcccgggccccaggacagcctcggtagccaagggccccatgtggccagctggccagtgtttcctgcttaccatccccccgacgccatgcaccaacagagtctttcctcccgtggccaagccaggaagagggtacaatgattgaaagtttctctccctgttggaggaacccatttgcatagagctagaggattttccctcaggcatcttccctgccctgcccttaagctgttttttttttttttcttttccccacactgtcaggagttaccttttatgcaagaggtttttttttttcctttggaagacatcttattaggccagtaccccaattcacaagacatccttttctctcccttgtttgaggaggactcagctccatagctttaccttagcatgactaagtcctgctgaatttcatggatagaggaggtcatggtagcattcatggatagaggatgctcccacttcatggatagaggtcatgctagcattcatggcatagacaaggtctagggaactcaaaggctactgacagcattgggaaaaggccacatgtggataagtgtggataattcccaccccctcggccccctgttaatgtgggtgaaaacctctgttttccttatgaaaccccaggaattgaaagcagaaagatccctctcaaaacctttagggttcctaacctgtggtaagtaaagaatgttactttctaataggcccaggagacccatgttcttgagacctcaagaaaagaggaatttactcaactcataggtatttgaggctaccaacccatggctggcctcagctgtaaaaggtcttatctgagattccgtggggaacagggtgtcattaaagccgatttaaaggcctgtgtgaaaaacaattactcatgctgcactttacgcaaataatcaggccaagtataagactaaggtttattttacaagcaacttagtcctatcatgatttgtttttgacaaaaatggggactagagagagaaaaattatgtttcaatgcttaccatatacttgttattaaattctcgtctcatctgttgtttttaggtttttgcctacattctagactaaccctgtttatccccgtgaaccaaccagtgatctctggctgtatctcagaagaaacagacagatgggtaatataaagatctagatcaatagtctagttctggacaattatcctgcaaagcctgcaaggtggtaagaataaatggggtgcccataacccagaagtttctttgttatggaaaataagaccaagggagctaaccagagccaagccccatgcccccacatcttggcaggcataactatagccaccagttttctgggcatttcagcagccttggggtttttttgagctgcccttacccccttgtttcattttgatgtgcatcttctaataaccctaattgtttattcttgcttagcggccattaaacttcaaatggtgttgctaatggaaccagatctgccctagtacgtcactgaagagagactaaagaaaaaattgtctaatttcataggacattatagatcctgtgagtcttctaaggtacctccctgcttgctagggcataggaatttgcacatgggaatctacagtcttttatgccaagaaacaattcccagaaatcatttccttctcaagtggctttctggcctccctggagctcaacacagtttttagggctcaaggtccctctttctatttattttctgctcccatcatttctttatttttccttcctgaccaagatgtttttttttttcttttttattacaggaacaaaaagacatattattttctgcctgttccttgtgggaaaaaattcaaattttctaaattttataagggctgcaatttccgaaatattcttccattcattcaggaagtacttgaatatctactaaatgccaaccactcttttctggatgtttagcagtaagcaaaaacaaagttatgcttgtggaaagaaacaaaaaaaataagcaatttaaaaaataaatataaaccatattctgagaatgctaatttttgcattttgtaaggggataaatggagaaatgctcactaaaaaagtgacatttgaggagatacatgagtgaaatacagaatttggaaagaaaaattagtaactgcaacatccttgatacaggctggagttggctagctttattcaggattatcaagaaggccaatataattggagccgagagggcaaagggaggaaggaatagttatataataaaaaccaatgtggacttccagccttttttgtctaccttcacccctttccagagtcagcacagaggtggctatggaaaaagagaaaaaaaatcttcaataaaaacggaaagtaaaaagagtggaaactaatatctcaaatgttttctaaactaacaaagattccacagaatttcagactttggacaaatgttatcattcttattagatggtcattcttggaattgtttctgcttagaattatctgaaaatggcactgcttgcagttccctcccagttgattcatatcatgtacttgttgcaatgttagtcatccaggaattttatcctaattatatctgctgctcctttgattgcaatgaatttaattcaccttacctattaacttacttaaactcttttagtattgttaagccattcacaataagctaaaaggaagctaaaggtttgtttatgttctttagtctatgcttaaaataacacatagacttttgcagggtccacaaaactattgtacaaaagtgcacaatataaaattctttaagaatttgggcagtgtttatccaaatatttgtgaaatgcaaagacattatactttcttgtctttcagtgaattcacataaacattattaggccacccctttaattcatgcattattgacaatgtggttgatactggttgaagaaacagtcattgaggaatactaaaaattgtcctttgatctaaaacctaaaatatcagtcattgtcaaagcttattttaaaatttcttgctattactggtgataaagttctacatttaagaaaaattatttgtacctcacttgaaaagaaataacttttgtaagtgtaaatttaggatggttaccaaaaaataaacttcacatactctaatagtggaataagcttcagaaccatttataaaaatgactaatgcagcattatcaagacttagctacatgttcacttgttattgtataactctcaggagcatgcatggagctttgtctggcatttaattaagcccattttatgtctgtcatgaaagaatactggcttgaaaaaatgattatgaaaagtcatgctcaaccctacgttcaaagaatgatgcacgcaaagctacaaacaaatgtatgcccagaaatggccagaaaatgttattggggttgtacagaaatgagttgaactgacataaaaaattaacaatagtcactgatatgttaacagatgctaaaagccacatttgcttgggtagtttacccatagttttaaaatgtttaaataaaatgttttataaatgcaaattatacatttattgagaacttggagcttaatcagcagtttgaaactttgatcactccaaattatcagaatagaataaggaacagaagctagtctctgcttctttataacctggtcagctgtgtaaacatatagaaaaaagaatagtatgaaccgagtgagagataatatttatcaactctacatttttcagagctccaacaaattccagcaggcccagtgtagagccagagccaaggacaccatagaaaatagttggcagcaaagacaccaaagaaaatagttggcagcaaagacaccaaagaaaatagttggcagcaaagccaggcaaaggaaacaaattagaaaatggtagcctaccttatttgaaaccagggtaagcctgacacagaatattgtatacaaattataatttttccacctcaggaaggatatgtttaaaaattcaaacaggtggagaagcttctatcaagtaataaaagattaacacctttagattttagtgacagattaagatgaactagtgagctttcagtcttctctttactcactttctcatcgctgactagagctctctttccaaaccacaaatctgcttttgcccatctattagccatttaggaacttttgaattcctatgagataaagcctactttcttcaacatgccatgtcaggtccaccacaattaagctgcaaggtaaggttttacctgtaattccactcatattcgatcccctcacgtttagtctattcaggaatatccattattcccccaaaactccttgaaattttactatgctattattccctctcgcagaacaccttctttctccgttcccttcccttcccttcccttcccttcccttcccttcccttcccttcccttcccttcccttcccttcccttcccttcccttcctttcccttccctttctccctttctctctctctttctctctttctctttctttctttgctgtctttctctctttctttcttagacggagtctcggtctatctcccaggctcaagtgcagtcatgccatctcagctcactgcaacctctgccccctgggttcaagcaattctcctgcctcagcctcccgagtagctgggattacaggtgtgcgccactatacccggctaatttttgtacttttagtagagacagggtttccccatgttaaccaggctggtctcgaactcctgacctcaagttatctgcctgcctcggcctcccaagttgctggaattacaggagtgagctactgcgcccagccccttttctaccagttagactttagcacctcattcaacaccaaatgacattgtgtcaggagagtaagtgttctccctagtcttcacctatattaacaaccttactttttctgtagcaatatttattctctgcgttgtccatattaacaggaccacacttttcccatagtagccatgtacccctcttaagaaaaaagagacattgcccagactcttttataattatgtgtggcccagaatagacaatgagatataagtggaagtcatctggggggactttcagggtctttttacctttcctttcctttgtgacttaccttaccttaccttacctttcctttgtgactacaaagcaaggtcacatgctgaggagagtaggataaaaatacatagaatctagttccctggtgtcattttaagatgctgcacttctagatttcttgttacatattaaagttaattctctcatttgtttgagatgtttctcagttatattttgtgttactccagaattataattatttgtttgcattttagtctcctccacaggagcataaattcatagaaatgtgttcatctttgtttccacaaagtataatatctagcacaaagtaggtggtaatttatgagtagtggcaatttgattgctgctattaaaaactttattgcatgaaaaggacatttatgtctctgaccagaaatagactggtaaaagttttaataaatgtatggaacatgggttaataacaggtgattgatggtagaactgttgctgtagggcattataggcaacttttgtaacatcataaggaagtcaactgctaactgtcattggagccattataagtctcagaataaggaatagaaagtacaacttttacatgacctagtatgacatgttctctttttaatgaaaaaaaaatccatggaaagaaaactgtgatgttgaaagactctcaaaagagaatctttcagaagtaaaagacagaaaataattttgcagcaaaaaacatttcatgccaagaatcacaatcacattcataatttggagtctgggtcttccaagaagctggagaacctgtgcttccctctttcttctgctaatttcaactaataaccctggatattatgtgcaaaataagaagacaaaaaccctgctattatatagataagaagactgtgaaatatagcaagaagaaggcagacaggttgatgacacccaaagaatgacacgatgggcttatttttacctcatatatcccacacatggagctaaagaagctggcaacctcaagataccagtcggcacagacaactcctccctcccctccaaaaaaattttgctctcttaagccaaaggataaggaaagtggaagcctaacaagacagaagattttagaaaataacagctatatggctgggcgtggtggctcacgcctgtaatcccagcactttgggaggctgaggtgggtggatcatgaagtcaggagttcgagaccatcctggccaacatggtgaaaccctgtctctactaaaaatataaaaagtagctgggcatggtggtgtgtgcctgtagtcccagctactcaggaggcagaggcaggagaatcacttgaacccaggaggcggaggttgcagtgagctgagatcgtgccattgcactccagcctgggtgacagagtgagactctgtctcgaaaaataaaataacagctacattttagttatttatcacataaattactgtggcctgagtccagcccacaccagccaaccaagccagaatcctgggctttcaccatcaccaggtggtaatgacaaacgccccccatttcccccaccctccacaaaagtcatatcaaagaaagacatctttcctctctgagtaacagcaagtccctgtagtgtcagtggagaccaggtgggaaagctggatgtccactccaactcaacagtaataaggcatcctcccacatgttcgagtgatgtcagaagaccaggggagagtcaggacttttaacacttctcagtggtaatgagatcaaccccctaccccaagtgtcagtggggaccacatgggaaacaggaaataggcactcctacgcctcccagcgagggaggtatcatacgtttctagtgggggctggtcatcccaactccatccgtctccaaacattttatatatatatatatatatatttaaattttcattttagatttgagggtacatgtgaaggttagttacatagataaacatgtgacatgagggttggttgtgcatattagcatatcacccaggtattcaactcagtaaccagtagttatcttttctgcttcccctcttcctcccacccttccccctgaggtaaatcccagtgtctgttgtttccttctttgtgttcataagttcttatcatttagctctcttccaaacactttaaaacctaaccacatgcttctaaataatctatgcataaaacagatagcctcaagaaaaataaaaaaatatacattgccttgctagaaggaatataaaaatgtagtccaaaaaattgtaggacatacctaaagtagtgctgagataaaatttatagcagtagatgcatacgtaaaagaagaaaagtctcagccgggcgcggtggctcaagcctgtaatcccagcagtttgggagcctaacgcgggcagatcacctgaggtcaggagttcgagaccagccaggccagcatggtgaaaccctgtctctactaaaaaaatacaaaaattagccggtctacgtggcataagcctgtaatcgcagctactcgggaagctgaggtaggagaattgcttgaacccaggaggtggaggttacggtgacctgagactgtgacactgcactccagcctgggcaacagcgtgagactccatctcaaaaaaaataataaaagtctgaaattaataatttaaacttccaccacaagaagatataaaaagaaaagcaaaataaacataagacacatataaaaagtaagtaggaatgtgggctggaagaaaatgggtatgcctgtagaagagaaaataataaagataagagcagaaatcaacgaaattgataatggaaaaataatagagaaaatcagtgaaccaaacatctggttcttcaaaatgattgatgaagctgaaaaacctaacacaagactgtaaaagaaaaaaagagaagacacaaattatcaatacaaaaaataaaatagatcctgccaaaatcaaaatgataacaagagaatatggcaaacaactctacaaacataaattttaaaactttgaagaaatgtgtcaattcctcaaaattaaactaccacaattcacccaatatgaaatagataatttgaatagacttatatttctatatctcttaagtaatttaattcataatttaaaacttccccaaaatagtttccaggcccagattatttcactgaagaactcaattcaacatttaaagaataacttacatcaattctacactccatcttccagaaaatagaaaaggaaggaaaacttgtcattcatttttgaagctagtattgccctgatgccaaaaccaaagaaaagcaatataaaataaaaaacgatagaccaaaatctatcattaatatagatacaaaatgttttagcaagatgttagcaaatagaattctacagtatattaagaaaaatacatcattaccaactaaggtttattccgtgaatgcaagactggtgccataattgaatatcagtcaatataacctattatttcagcaagctaaagtagaaaatcacataatatctaccagcagagtaaaaggatttcataaattttaacatcaataataatttaaataatttcagaaaaatagaactatttgggaatagaaaggaacttcctcaacttggtaaaaagcattaatcgtaaaacttacaactgacattatacttaatggtgaaacactgaatgcttttttacaaagggtgagaacaagacaaagatgtttgcttcactgctcattcggcatgctgctgcaagttctagccagtgcagtaaggcaaaaagaaaagatagaagaaaatagaaagcatacagataataaaggaagaaataaaactatccctctttgaagaagacgtgatggattgtctatatagggaatcccaagtaatctaccaaaaaacacctacaactaataaattaattcaataaacatgcaaaaggtaactttatttctaaatattagcaatgtctacatgaatataagaattaaaaatacaataccatttagagttgttgaaaatataagaagcactcaagtgtaaatctatcaatgcatataaggagattgtatgctgaaaattacaaaatgctgatgaaagaaaaggagatcaaaattaatttagatatatgccattttcatggactagaagactaaataaacatagtaaagatattgatcgcattaaattgatgtagaggtttaacataacacctctcaaaacccaagcaagaattttgtagatatagaaaaacatcactctaaaatttgcatggaaaatcaaaggaatcagaacagccaagataattttgtggaagaataatgaagtgggaactactctagttcataatttatatagctacagtaataaagattgtgttgtcttgtcatagagatacatacgtagatcaatggaaaagaatgaacccacacaaatatgaccaactgattctgtaaaagtgcaagagttattcactagaaaagagataaccatttaaataaatgaataattggtgctagagcaactggacatccatagacagaaaaataaaatctcacactcttaagaatattaactcaaaatccttcatggacttcaaagtaaaacataaagctataaaacttttagagaaaaacatatgagaaaatcttggcatctagattgaaaacaagttcattagaatttacaaaaataacacactacattaaaaaaatgataaactgaacttcatcaaaacaaaacaaaaacttttgatttgtaagagatcaagaggatacaaatacaagcccaagcaacaaagtgagagaaaatattatcaactatttatcccaaaaaggactaatgtctagaatatataaagaactctcaaaacttgacattataaatcaaataatccaattagaaaattggcaaaagccaagaactatttcattaaagagaatatagagatggccgataagcatatgaaaagttgtttggcattattagctattaaggaaatgcaaattaataccacactgtggtatgactatatacctgtcaggatgattcattaaaataaaaagtagcgacaacaccaaatgccaaatcactcatacattacaggcaaagcaaattttgtctatttcttacaaaactaaacatacctttgccatatgacccagcaattgcactcttgggcatccatcccagagaaataaaaacttatgttcatacaacaacctatacacaaatatttatagaatccttattcataatagtccaaaactgggaacaacccagatgccttaaacaaactgtgatatgttcatataatggaatacatctcaacactaaaaatgagccaactatttttacaagcaacaacttgaataaatctttagaaaactaagctgaattagaaatgacaatcccccatgcaatacatattttatgagtccatttataaaatatttttgaaaggataaaattatagaaagggagaacaaattagttattgcctatgattttagaaggggtgtgggctggaaggatcttgtattctgtaaaacaacaacatgagaggtctttgtcttgatagacatgttctatgttaactctattaatgtcaacatccttgtcataatattttaccatagttttgcaaaatgttacccatgggacaaatgaggtaaagattacaatgagattgctctatattatttcttacaactacatatgaattttcaattacctcaagaagtttagttcgaaaaaggagaaagaaaagcattcagacaaacaaaattacttgtctcccatatttttaaaacttgaattcaatccaaatgactttgaggctttgcctgatagccacatgcaaacagtaacatataaccaacagctgatttttaattgtgcaggacaactatactgtgatagactgaatatttatttatctgagtcagggacttaagagttcaactgctcaggtcctgaagttttagcaaattattttctgccagaatttgttcatcagtaatgattatttctttgtttttctcagcatctgattcaataagattttcaccttagaaatgtaaatgtcaacaattgtgtgatagaacttgcatctataaaaaagaacaatatatgttttccagtaagagctatcatctatatttagttttcttgagtattttcaaaataaataaaataagaaataaacaaaaacaaaagatacttgagtcaggcataggtatatttggttaatggagagtcatttaactattcctctgtacatgagtagacaattctcaaaagaagatatacaaatggtcaacaaacatttaaaaacatgctcaacatcactaatgatcaggaaaatgcaaatcaaaaccacaatgcaatactacctactcctgcaagaatggccataataaaaaaaaaatagatgttggagtggatgcggtgaaaagggaacacttctacactgctggagggaatgtaagctagtacaacactatgaaaaacagtgtggagattccttaaagaactaaaagtagaactaccatttgatccagcaatcccactactggtatctacccagaggaaaagaagtcattacaggaaaaagatatttgaacacacatgtgggt

SEQ ID NO: 2490 - DNA, 428 bp, Homo sapiens
gaaagtgcaacgttctgtggggtggcgctggcgaccctttccttgacggaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgg

SEQ ID NO: 2491 - DNA, 399 bp, Homo sapiens
gaggtcttctccacttatctctctctggggtccagactgctgaggtggcagctactcagaagacagttttatcaggatgattgcagaggtacaagaaagcaagtctcaaggcataaatacatttcaagcccattgcttgtctcttgtctacccacctgccattggccaaagtcagtcgtgtagccaagtccaaagcagttttgtgggatgaactgcacatttacatggcagatatacaggaaaatgttacttatcatggaacaaatatctcgtgtttactgaaataaaagttctattacattgcttcatgtcagagtatacagagggtttatgtgcttctctgggaagaaaaggaaatacagctgttttgcagccctactctatgtgaaaacaatgagg

SEQ ID NO: 2492 - DNA, 12345 bp, Homo sapiens
cctgaggtcaggagttcaagaccagcctggccaacatggtgaaaccccatctctactaaaaatacaaaaattagctgggtgtggtggcagaagcctgtaattccagctatttgggaggctaaggcacgagaatcgcttgaatctgggaggcggagattgtcccgtgccaagatcacatgactgcactccagcctgggcgacagagtgagactccatcccgaaaaaaaaaagtgttaaaaaatttgtaaagcaaaaattgacagaattggaagaagaagtcagacaattccacagagttacggattttaacacccctttctcagcaactgatagaaaagttggggggaagtcaacaaagacataaaagatctgaataatgatcatcctccatacctaactggcaagtataggagactatacccaacaagtgccaaatatatgcatatttcaactcagcggttcaaaagcagggaaattttgctgccagaggacatttgacactgtctggaaacattttttattttcacatcttggaagatgtcgcatctagtaggcagaagccagtggttcttataatgcacagggcagctccccacaacaaagaacgacctagctcgaaatgtccagagtgctgacgctgacaaccctgcactgaaaaagtgaaaatactacaaatgcatcacatccctagactttcatagctttagagggtccccagctctccttcccctaccagcagcaatcctacatcctactgctgaattactcttttgtattctgtgttgctttgacgtaagaggaagtctcccttgctcagatgtcacttatctactgtgcttcctctggacccttttggttttttaaaaaggactatatgaataatgaaagcttacttcagggacaagaacctttgatcttccaggcctttgcctatttcctgcaggactttgctctctctccttcctcctctttggcataattctaaagccatatagccagtccttaatcaaactctctttgtaatgttagtagactgtagcttcaggaaaccagaccatatcttaaattgatgttacccccgttaaggttcaaatttacagtcggctctgcgtttgtggaaacataacatcttaacaatgagggtggccctcattcgtcattccagttaaactttatttttctagaatttcctttcaagatggtagattattgtacattctgggggcagaaagtgagaaaagagagtctgtccatgatagaaaaggaaacatagcagatttgatctctatgaggtaaaatgagaggttgagtcagatcatctaattctatgatttgctggattaacttggaattgtttattaagtgacctccaagtcttgaaacttttaagtaatgagagatgagaggttactcctccaaaataagcaatgctagcctgggccttgaaggattatgtagttgtggtgccagaaggtcaaaatttggagcttcacttttatgttccataaaatggaaagcaacttctgtaactatgacctcagatcttacagtgatttagaatttcccaaagagatttcacccacattgtgataccatttgttcctcatcacagtgaccctgtgtagcaggcaggtcaagtattgctatccacactgggctaaggaagaatgcaaagctataaaggttaagtgacttgcttaagataaacaaaacttagagctgtattaattcactgagagatgcatgacttttgaatataaccaaatgtttctgatttccccaggacaattaagatttaaaactacctgttctttgtcctcaatatgttcctttgtcagataacgagtcaatctttttagtcagaatatacagtcactagaacattgagctggagtggccaagtaggaattctttcatttattcattaagcagcctgattatttggcatgtgctatgtatgaagttttatactaggggttgaagggaagggagacagtgatgaatataaaatgtggtctttgccctcaaattgcttataatcttttagaggacacagacaggtaagctaccaacagtcacataaggcagcagggcttgaaaggagcagaagccagtttgaggactacagtgagagaagcaattccttctgcctgtgagggagtggggaagtctgcgtcaaggaggaatctgcatataaactgggcctggaaggagcagggttcggagaaacagaaaagatgaagtttaccgtagagaagaaagaaacattcacttcaaactcttaatattcctgatgaagctctgcccaaagttttcagtgtaacatcaacttaggtgctctcaattccttattagacagcatcttagactgcacaactgctgccagtttttgattctctatgaggcagtctcattctgttgcccaggctagagtgcagtggtgcgatcaaggctcactgcagccttggacttcctaggctcaggtgatccttctacttcagcctcctgaacagctggcaccacaagcacacaccaccatgcctgggtaatttttgtattttttgtagagatggggtttgccatgttgcccaggctggtctccaactcctgagctcaagtgatttgcccaccttggcctcccacagtgctggggttactgtttgctgccttattaatagaagggaagcattttgcctttccttctctgaaatgagtgtgtcctctagttaagcacacagaacaaatggaatttttacaagggaaagttatttttcatttcagttttcaaggtcaatgcaaccttgatcattaatcttttctctgtctccttcctttcagtataacctggtaaaagtcatatacagacacacacatacactttttttccctaagtatcaggcactgtgaacatatataacaatgatttaatctccataggcctattttacagttaggaaaactgaagtttattgaggtagagtaatatgttcaaattacacacatttaagtgagctacacaggaatgagaggtttctggttcactcaaaagcccatgctctttctaggatgctctactgcctcgggctaattctatcaaagagaatcacactgtggtacagtgattctctgaagatgaaggcttctcctaggataatgcatagaacaggatcaaagaagtactagtagtgtgttggtgattcttttcctggcattaactggcatgggcagttttggcatgttggatatttaactatctcatatcaaccatgatccttcttccccagaatccactctccttttaaaaattctaataatagagtgcgctccttcctacccctggacagtttcagcagagcacatggctatgacttccatctctaagcttgttttgcagctaggtgtgatcttgtgctgttctccaggatggaatgtgagcagagtactgtgagctgcccgggtatcacatccttaaagagagagtacctgccctgtacattctctcttttccccttcctggaagctggattgaggtgctgctgctggtggtctttcctgatactatggagcaacaagggagaaagagcctgggtccctggacaatttggtagagtgctgtttggaccacccatctaccactgagcagttagcaagaaactactatctcatttgagtcactgtagttttttggtaacctaaattatttactaactaatgtaacttccataattcaagagcactagtcaacatttcctagagtgtctgagctgccccattccagatatataaaaactgcacattgtgatgggttgccccctaaagcactctggaaaaaagctggtttgccttctggcattatgaggcttaatctctaaacagtgtgatctggctgtccctgctgctttaaaagtctgctgcagccgtcagatgcagactgcattctgcatatacctaaaatcacatggttagagtccttaatcactcttacatcccaactgctaatctcatgagaataaatctgctttcccatggctgagcaaaatgggtcctatcaccatgacatgtgccctgcaaccttccaatcaaatgaaggaaatacacaaaacaaatgtgagaaatctcatcacccatattctcaaacacacggattttattgttcgttatccgggctcattgaccttggctactgaaagatacctaagtagatgtggtgtactacctgtttgaacttgggcttctgaattttgctctaattgcccctgtcgttcactgtagccctcaccaggacacagcagaagtcacacttaggatatgagactgctacaggaggcctgtgcaaagatgccttggatttatatggaaaatggatgtccctggattggcattggctgctcatttgggtgactacaagccatcttagatgaaagtcagacatgttatttaggtatgacttgttctaagagaatgtgttgtttggtagagctactctataattaagacccagctcattctaatgctccaaggcctgctattttgctttgcttcttgtccagcttatccctctggctctggatggctggcaaatttcccctcaccaccagtttctaggacactgggacttcagcatgaatggaccacagcatatgtattatctctagacaatcagaagttaaactatgaatgcaaaacatttataattgttggagagtcccagactcctttgagcaactgacaaaattgacagaaaaaaatatgtttgcaccacaattttgtacaccatttcaggaatgtctgtacaacttcatgaagcccatccattaatcttcagattaataactgatgcatctgtgtgtggttggtactattgcatttgcataaaaatatatcacaatatttaatattatcatggactaagttgaaaattccttgaggacaagaattatagtatgttgacttggtacagtcctgtgtagtaggtgttttaggagatgtatagaaaaccaagtctcatagcctagatttttccatttggcctaaatatttccattcaaatgttttatttttagaaatattgagaaaatgaggtgagagggagagtgaggaaagtggtaggaacccaatgtctgggaactctcaattccgtccatatgtaaatcatttaacagcttgcaaatgatttagcagctcatcaatggtctgagaataaatctttctataggcaaaaagcctgcctcttttacactatttaggaaattcagcctaaaactgatgtaatactttgagctgtttaattaattttgcttactggcataaagatccttaacttgattcaattaaaaaaataattccccaccattttcttgccttctgtggcagagactattagttgtcctctagtacccattttctcctttctcagtagagaactccaggatgttggctggacacaggattgcccagaataaagacatttcccagcctcccttgcagctgggtgtggccatctgactaaattctggccaatgggatgcaattgtgttctgtaacaattagaaactgtacttaaactgtggtgtggaatgaaggcttcccttttcttgttacttcccttgtctctgttagtgagaatgtagggtataaaaaagagccatcctggactataaggtccagatgcatttcaagatagcagaccaaaaggtggcagcagtcggggtgcctgtcattgtggagctgccatactggtcctaaactatttcaggctccccaagaccacccccacattcaaagttttgctagaaggactcagaatgtcatgcactcatgcctaagatttatacagcaatgtggtaaggatacatggctgagatcatgttagataccctctgtctagccatgtaccaaaattccagactgccacaaggaaagcagtcttggcactgtgtttaatgtttgatctcaatttttaaaaaatcacctcgtctattagaaaatagtgcatgttgtggcagactgctagttgtttcccaatatcagctaattgttgactagggtcaccccaagagctatattcccagatgccagtcaaggctgaccttcaagcaatctttctaaggagaacagcctcaggcctgctatgttaactcttctgcacatggactgtctctatttacctgaaagagaaatatactttaatcttctttaaggcaacgcttgtgtgtgtgtgtgtgtgtgttgcagggggggggatgtcttttgaccacacctaattctaatgaatacccttccctcttcatatatttgacacctaggtagaacttaatcttggtgtccagcttaacaatggaggtgggcgttgcagtctggtgaggatgtgctgattcaggaacacaggttttcataactccaaattcagcagagagcatcaatttataaaataacctgcattcccaaggctcatttgtaaactgaccaacacatcagctcatgaagtaaacctaagatgactacatgaggccgagtctaaggtggaattggaggaaccagattccagtcaggaacttgcaacttaacttcttcctacttctataaaccctatagtggaacaggcaatgaccatgcccagtgaatgcttggcaatgacatttctccagcttattgtagatcagatgagtcacaaaatctctgtatcatttcagcttcactatggtagttcacacagataaacaatgctctttacagatctttctatatcaacattcaagctccagagaacagaatcataagttctttttttttatgttagtttgctttttaagtggagggaccctaaccaattttctcatttgatagaggaaaactgtaatatatctcacaagacccagcatggtagcaaaagtggaaatagaaatctgtcctcttggtccccattcacacaccaccttgactaatcatctgtgattatctactcattcacctgaactgggaaaactggagcctctgtgaagacagatctgggcacatggccagtccctaaacattggctcattgacagaactctcacgttgtgtggtaccttcaggagtaagaagaaaagtcttctagtagagctgtgcggatggatagaaggcaaatcattatatgacattacatatgcttcatgagtattttaaatagtgcccccaggatagtaaaaattaccctgcaacacaggaagcggctcaatccctctgtgctgattataaccccaggacttcctcttgaatcaatctcagacatttatttggcatattcttttgaggtactcctaagatatttattaacatttaagccactaattaattttcatgcatattaaacaatactgcagttttcacaggcttgtgtgggcacctgataaatgtgatctgaggacactaatatctacttatcaaaccaaaaaacattttccagttcccgaataacaacctcttttaaagaaaagtgtatatagagtgtggaaactagtactaagaagccaatggctcagtgggttttctggatcttatttggacctggtggtgggcatgtgctttcttcccacttatccaagattgtgtgcagcttcataactgagtacagcataaccatcacattgaagagggatgcttttttttttttatttaatggtaatgctgagcaaagaataggagttttatgagtacaaagaaaaaaatttttttttaatcaccgaagatcaagtcactttacctaggagcaagagggataatcatgaaggcatgaaatggggtgtcacattgcagcactatttacaatagtaaagacttggaaccaacccaaatgtccatcaatgatagactggataaagaaactgtggcatatatacaccatggaatactatgcagccataaaaaagaatgagttcatgtcctttgcagggacatggatgaagctggaagccataattctcagcaaactaacacgggaacagaaaaccaaacaccacatgttctcactcatgagtgggagttgaacatggacacagggaggggaatatcacacatgggggcctgctggggagtggggggcaaggggagggagagcgttaggatagatacctaatggatgcacggcttaaaacccagatgaagggtggtgtagcaaaccaccatgccacacgtatacttatgtaacaaacctgcacattctgcacatgtatcctggaacttaaatttttttttttttttttttttttttttttgagacggagtctcgctctttcacccaggccggactgcagtggcgctatctcggctcactgcaagctccgcttcccgggttcacgccattctcctgcctcagcctcccgagtagctgggactacaggcgcccgccaccgcgcctggctaatttttcatatttttagtagagacagagtttcaccgtgttagccaggatggtcttgatctcctgacctcatgatcctccggcctcggcctcccaaagtgctgggattataggcgtgagccaccacgcccggcctaattttttaaaaaaagaaatggggagtcacagatgaatctcagataagtggtcgctggctgttacttactttatctctaagatcctcagatctctgtaagagtggggtagtattactcacgtcttagagctgttgtgaggataaaagtgagaatatttatgtaaacatctgtggagagtaggggaggacacaaagagacccgagcatgcttttaccaacttcccagaggaaaaacatttttgaaagtataggaaatcagccacataaattgggagacatatgtcaagatattggttttattttttagttttttttttttttttccagatcggaaagaaatacagcacttttgcatttccacaaatgacaacatctaagtcacaccaccacttcccagacggccttctgaagccaaacaaataatcactgatcaagtaaagcttaagggaaaacaaggacattctgaaatgtccctttaaacaagaatcttgaattgttgaaaataaaaaatgtatttggatctgatgaccttgtttcattttctgagcaaagagaagtagaacagcagcaagatgacatggctttgccctttcagaagccaacagagatatttattacccaagtctcacaaatgctgaaattgtgattggaagcctttcagcttcctgcataaccccaggagcctcaggttgcaggtcaatggcctgatgaagtgacagcctctagccccaactatctgtacaccagtggagattagaagcatgtcctgggactggtttggagaaataagttatttttctttggtaggaaacaggggcaaggctggtgagaagacactgccctaaatatgatataatccagctgtccaaacatggacaactgagttcagccagtcatccattcccccaaatccagatgtttgccattacacaatctcagactatcttttcttctactgagtgtaacttgtactaattatgtttgtcagagtagcatttgtttttaattagaagacatctattttgaatcagctgggactccttagctgtatcacagagacacagcctatgttattaataatctttaaatcataactgccttttgctttgtggcaaattgttgaggttttcattccatctcagagttcaaatataagaaacatcgagactgcactaaaattggagtcgattattattaatagtatttgttaaaatgcaggtaattctattctatctaaacattctgcaaacacaaaattcccacgatggcagtgggcttttaatatttgcacatctttgtgtgtggaagtctccaactattatgtttcatagttagacctgctttcaaattccatcctaacatgtggtcttgctaaggtcacgaacaatgtctatgagcttaacttcctcatctgaaaattagaggattataaatgtcattgtaagaattaaatatcataaaatattttaaacacacagcagagtgcttaaaatgtagtctatgtgtaaatatatgctgattccttccattcctttaaaaatctatagacaggagtctgacttttctaaatggccatctggtcttacctccaggagactgaagcacattttccacgggtttagatgtagagctttagttcttccacctgagagacagttagcaagaaaagtaagggagaaatgctataggaacactcttgagtatgctggaagcaagtgaggactgttttgtaatctcactatgcttccttatgaaacacaattctagaccattctctgacctgatgttttgcttgctgagagcattctctgatgggaaacaccaagagagacacaaggcctgctgagataacagagagcctgttctccttcttgtccactgtcctgtcagtgcctactgccttccctgtcttctggttcttttccttcctctcttggctcttttcaggttctctgctttgctctgatctgctttgcatggctcctgctttcccctcaccatcaccaccttgcaccacctccttgcttcaacttccagtggttttgtctagtctatgagtccaacttaaggcagcatcaaggtgagacacacagcaaatatttgcaggacagaatatgagaggtccagcagtgggtatcgttctccagagcatgcctgaggactccccgagaccacccgaaggctggccaccacccagaagctggccctcacctggaggctggccctcacttgcaggccagccctcacctggagcctggcccttacccggaggctggggctcacctgcaggctgactctcacctggaggctgcccctcacccagaggctggccctcacctggaggctgaccctcacctggagggtcctcacctggaacctagacctcacctggatactggccctcacctggtttctggcctgcacaggtgcagcgtatcccccacttggtttcctgacccttctcaggccaggcagaagccaaacctagtctctgctttctctagtccctactggctctgctgtcatattctgttcctaagagctccaagcatgtatattcacatgaacagaaagtagcttgcaaaaacagttaacaggtactgaccctgtacaccaggtattctgccaactgccctacgtccattatgcactgagggtttgtgtttcctcaggactcatatgttgaagctctggtgcctagtgtggctatatttggaggtggggcttctgaggaagtaattaaggttaaatgaggccataaggaggaggattctgatccaacaggattagtgtccttataagaagagacagcaaagcgctcacacaccacgaaaagcaagcaggtggctatctgcaaacctaggccagaacactcaccaagcacccactctactgccaccttaagtttggaattccactctccagaactgtgagaaaataaatttctattgtttaagccatccagtcttttttttgttatgatattttttatggcatcctcagaagactaatacatgcactagttaatttaatctgctcaataatcacattaggtgttatgttatttccatttaaaagactgagaaaatggaggcacagggagggcaagtcatctacccccaaacacccaattattaaatggtaaaaggatttgaacccagataatctcagtcaagaacccaagttcttagcaactccagctttgcttgggcctataccatcaaaccaaaaaaaaatacaccctgcttaagttatggaggaagcaaacttctttcaaagtgtaaacgtggcaaagataattttgcaaaaaaaattgttttccattcagaagtattgaatttgacttaagacacaatgacagtgaaaatgaatgaattaatagtgggttaaatcatcggcatttatgtaatttttattgaactcaaaatctttttgatttacataattacatttaatattcactaattttcaatttcacaaatgtattttcaaattgtcattcattgctagtaagccttaaatcactctgccatgcagtctcggctgaaaagacacaggccctgctttgaggaggtcactcatggtgggaaaacaaacatgtacacaagggcatggcctgacacatttacacaataaatattttttcaaggctctaccatgggccaagtgctataagaatgatggtaagaggactaggagtttgcaagagtgtatgtgtgtgtgagtgtgtgtgtgagagagtatgtgtgtgagagtctggtgaacatgggtgtgagagggccctcagagagggaaaacgtgaaaaggct

SEQ ID NO: 2493 - DNA, 1918 bp, Homo sapiens
gggagagaaagatgcttacaatccggttcctgccctcaaataactcaaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttgctgggtgcagtggctcacgcctgtaatcccagcactctgggaggccgaggcaggaggatctcttgaacccaggagttcaagaccagcctgggcaaccttgtctctacaaaaaaattaaaaaaaaaaaaaaaaaagctgggtatagtgacaaatgccactccggaggctaaggcaagaggatcgcttgaaccctggaggtggaggctgcagtgagcagtgatcacaccaccacactccagcctgggtgacagaggaagaccttgcctcaaaaaaagaaaaatatatgtgtctggtataaaatcttgacagtataaagtaagttcagtaaaaaagtctcttccctaaacaatgttcccaatccttctccctctccccagaaacaaatgctgtcaaagttgtaacatccttccaattgctttttcccagtatttttttattaggtataactttcatactgtaaaaatcaccaatttttttctttttttgagaacggagtctcactctcttgcccaggctagagtgcagtggcgtgatcccggctcactgcaacctctgcctccctggttcaagtgattctcctgcctcagcctcccaagtagctgggattacagacacctaccaccatgcctggctaattttgtatttttagtagagacaggtttcaccgtgttagccaggctggtcttgaacaaaattcactaattttaagggtccagtttgataagttttgataaatgtatgtccccaaataaccaccaccccaatcaaaataggtaatattttcatcaccccagaaagttccctcctgcctccttttccagtcaatcccactagacgtaatcactgttctgatctatggattatttttggctattcttttacttcatataagtgaaatcatatagtttataatcttctgtatctggcttttttctcccaacacagtgttttggagattcatccatgttgttgcatgcattcatagcttgtgcctttttattacttggtagtattcggttgcatgaataagttactatttgcttatctgttcacctgttgatgaacatctgaattgtttccatttgaggactattatgaataaagctactttaagcattcatgtacaagtctctttgtgaacatgtgctttcacttctcttgtgcagatgcctagaagtggaattactagttgtatgctaattagatatttaactttatgtgaggttgccacatcactgtccaaagcggttgtaccagcttacactcctaccagcaatttataagaagtccagttgcacagtattcttgccggaactttgttttgtcagtgttcttaattttagccattctactgggtgtgtattggtatttcattgtcgttttaatttccatttttctgatgactaaagcttcttttcatgtgcatattggccattcacatattttctttggttttttggtttttttttttttttgagatggagtctcgctctgtcgcccaggctggagtgcagtggtatgatcttggctcactgcagcctccacctcccgggttggagcaattctcctgcatcagcctcccaagtagctgggactacaggtgcctgtcaccacgcatggctaatttttatatttttagtagagacagggtttcaccgtgttagccaggatggtctcgatctcttgacctcgtgatctgcccacctcggcctcccaaagtgctgg

SEQ ID NO: 2494 - DNA, 272 bp, Homo sapiens
cagaaagggaacttctggaactgagaaccaaagtatccaaacaggagtggctccttcaaagcatagctgagcatctgaagaccgccaaccagcagaaggagagcatggagcagttcatcatcagccagctaaccagaacacatgatgttttaaagaaggcaagcactaacttagaggaaccatgcaagaagcgcagccaccagaagtccttaaaacagcaggaaacaactacaagtttataggacatagatttcagtgccctcatctggcca

SEQ ID NO: 2495 - DNA, 5747 bp, Homo sapiens
cgggcgcgccgcgtgagtccgagccggccgctcagagcgctccaggctgggttcccgggccccgccgcgccgcctccttcccagctcgcccgcccaggcctggcctcctgcttttccatttgattccctgcctctttctattcggactggaatgccgggccaggctccggggcgcgccgctgcggcagccgcacctcgcaggtcccccggccgaccccgacgcggaagcggcggccctcctcgccgtcggggagccagggagccggggacggtacgatcagtcacataaggcttagaggatcaaggatcctgcccagatgacttaccgaaatgttacagattaagttggtgtggtaacctgggctgagcactctgggagaggaagagaagagagaagacaggaaacaactgaactatgaccaatcccagcacggaggcccagaaaactttaagatttgagtattaatgtctcaaggtcaggagcaacctcaaggctaaaactcagatctcaggactcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcataccttttaatggtatatatcctaaaactgaagtgttcaatatagacatccagattgaaactcaggcagtgaattacatacacaacaaatcagttgaacatggcagagcttgtcagacttatgaaagattaaatacattttacatttccacaagtgtggtattcacaggtctaaattggaaaattcttgggttgaagaagaataatcataatcttagcttcactcattgaggaaacattattcagggatgataagaggtaaaatcttaaaaatattgacaagctaatgagagaactttgaggtaagctgatatgcaggtatagttaggactgggaaaagcaagaaaatggaaggatgggttagagggtggcactacacggctgatatagtttggatatctgtccccatccaaatctcatgttaaattggaatccccaattctggaggcagagctagaaggcagagcctggtggaaggtgtttgcaacatgaggaaggatccctcatggcttggtgctgtcttaacaataatgagtgagttctcccgagatctagtcatttaaaagggtgtggcacctccccccccccccgcccccgccaactctctcttgctcctactctgccatatgaatgtttgttccccctttgccttcagccatgattagaagcttcattaggactcctcagaagtagatgttggtgccatacttcctgtatagcctgtagtaccatgaacctcttcgctttataaattacctggtcttggggatttctttatagcaatgcaagaatgacctaatacagaaaactggtactgagaagtgagtcattgctgtagagatacctgaaaatgtggaagcagctttggaacttggtgacaggcagaagttggaagagtttgtagggctcagaagaagacagaaagatgagggaaagtttggaatttcttagggactggttaaatggttgtgaccaaaatgctgatagctaggacatgaacagaatgcacccaagcactttgctaaggcaaaacatgcgtgacctttgctctagttcccaataatttccttatttccattcgagacctcagaagcctggacttcaaaccaaaatgctgatagtgatgtgaacagtgaagtccaggctgctgaggcctcagatggaaattaggaacttactgggaactagagcaaaggtcacacaatgttaacgccttagcaaagagcttagctgccttctgttcatgccctaggaatctgtggaagtttgaacttgagagtgatgatttagggtatctggcagaagaaatgtctaagcagcaaagtgatcaagaagtggtgtggctgcttctagccacttatattcagatgtgggagcaaagacaaaaggtagaacttatatttaaaagggaagcagagcaaaaaaagtttggaaaatttgcagcctggccatgtggcagagaaagaaaaaagctttttcagtagaggaattcaagcagactgtggaacaattacttgctagagatgtttgcaggattaaaggggagccaagtgctactatccaagacaatagggaaaaagccttgaaagcatttcaaagaacttcagagtggcttctcccatcacaggcccagaagcttaggaggagagaatagattcatggactgggcccagggccatggtaccttgcacagccttgggacactgctcaccacatcctagctgctcctgttcccactcttgccatggctcaaaggggcctacatacagcttggactgccactttggagaatgcaaacagtaaaccttggtagctttcatgtggtgttaagcctgcaggcacacaaagtgcaagaatcgtggattcttggcagcctctgcctagatttcagaggacatatggaaaagtctgtttgtccaggcagaagcctgttacaggggtggagcccttacaaagaacctctactagggcagtatagaggggaaatgtggggttggaggctccaacagggtcaccgctggggcactgcctaatggaactatacgaagtgggccactgccctccagacctaaggatgatagatctaccagcagcttgtattctgcacctggaaaagccacaggcactcaactgcagcccatgagcgcagccttggattctttaccctgcaaagccataggggcaggactgctcaaggcctggggagcccaccccttgtaccagtgtggcctggatgtggaacatgatgtcgaagattattttggaactttaagatttagtgacttccctactgggttttggagctgtgtggatcctgtagaccctttcttttggccaatttccccctttttgggatggaaacatttacccaatccctatacccccattgtatcttggaagtaaataatttgtttttgattttacaggcttataggtgaaagtgacttcccttgtctccaatgaggctttggactttggacttttgagttaatgccagaatgagttaagattttgggggcctattggaaaggcatgattgtagtttgcaatgtgagaaggacatgagatttggagaggccagaggtggaatggtatagttcagatatttgacccagcccaaatctcttgttgaattgtaatccccaatgctggaggtggggccttccttgtatgatgtgtttggaacatgcaggcaaattcctcatggcttggtgctgttttcatgatagtgagtgagttctcctgagatgtggtcatttaaaagtgtatggcacctccccccactctctatctctcttgctcctgctctgctatatgagacacctgttccccgtttgccttccaccatgattgaaagctttgtgagacctcctcagaagccaagcagatgccagtgccatgctgcctgtatagcctgcagaaccacaagccaagtaaacctcttttctttataaattacttagtctcagatatttctttacagcaatgtaagaatggcctaatacaatagcctaaactaatttgagggaggtgatgtgtctcttgctacacaaagtatggttcatggactaacagcattggcgtcaccaggaggttgtcagaagtacagactttcagttcccttcccagacctaataaatcagactctccaaaaagttttgggagcactgctccagccaatgacttgtggtagaattctgtttttgcctcaacagcatccattctcctttcagtaacaactcctagcttctactttggggaactttccatctcccacactcagacctagggttcagatgtggctaacctagccctgtgcagccagaggaaggcacatgatccaggcctggccaatgacagtgccttatgacccagccagagtgactggttcagcaaagagggtgtaatatgagctgagccaatgagacttagtcctggtacttttgggaaagaaatgctccccttcctgagtttgctgagctgataagatattcatctacagcagccatctttccactacctgagaatgaagccaacataggaaaatggagctgagaaatgagagagatcctaacaaattcatttatccactcactaccggatctaaatcctgggctttttagtaactcaagccagtatagtcttcatttctttggccagttcaaactggatgtctactagttacaactgaaagaatcctaatacatcagtctcttcctgtccctgaaattcattaggctcattttgaatctttgatatttccttttcctctcttctttgtctgtgtttaatccattttgcattgctgtaaaggaatacctgagactcggtaatttataaagaaaagagatttatttggcgcacagttctgcaggctacacaagcatggcaccagcatctgctcagcttctggtgaggccacaagaagctttaactcatggcggaaggcggagggagagcaggtgtgtcatatggcgagagagggagcaagagagaggggagggagacttctctttttttggcaatcagatctcgtggtaactaataaagcaaaaattaattcattactgtggcaaggacaccaagccattccaaaaagattcacccccatgacccaaacacctcccaccaggtcccacctccagtgttggagatcgcatgggagacaaatatccaaactatatcactcctctctaaaccagtttagagggttcaaactttgccttctccagatttgcctcttccctgagaccttccctgatagcttcccacacatactgctctccccagtccatcaatgaattcctgcatccaggtggctaatggttccatacttacccttcagctgtgaccagttttgtgtccacctctgtcttcctccctctttttgcttagatgacacccactcaacctctagatgtcccctgctacaggtgggatgcccttgttatatgttcttatagcaccacctgtcttcccttcatggcacttatatttgtaaatgtattcatgccatagagtactgcatgaaggcagtcgagtgggtggttcaaacgtagaccctggtgtcagcctgcctggactagctatatgaccttgggcaagtttcttaacctctctatacctcaatttccttacttatcaggtgaagatattaagagtacctcctcagagtgtgattttgttaatttatgtaaagtactgagaacatgcctggcatgtaataggcactgtataagtgatatctattattattgtacatgggattatttgatgtctgtatcccatcccccatcagacatgaaaaaataggtctgcttttgatcaccattttacacttaaagaaaagggtcaggctgggcatggtggctcacacttgtaattccagccctttgggaggctgaggcaggtggattgcttgagcctaggagggagggagggaaagaaaggaagaaagaaagagagagagggggagagagagagagaaagaaagaaagaaaagaaataaaagaaagaaagaggaaaaag

SEQ ID NO: 2496 - DNA, 766 bp, Homo sapiens
cttggatccccttccacactgtgggaggtttgttcttttgctctttgcaataaagcttgctgctgctcactctttgggtccagactgtctttatgagctataacactcaccgggaaggtctgcagcttcactcctgaagccaaggagaccacgaacccaccgggaggaaggaacaactacagacacgccggcttaagagctgtagcactcactgcgaaggtccgcagcttcactcttgagccagagaccacgaacccaccagaaggaagaaactccaaacacatccgaacatcagaaggaaaaaactccagacacgccgcctttaagaactgcaacactgcgagggtccgcggcttcattcttgaagtcagtgagaccaagaacccaccaattccagacacactaccaaaggcagaggggagctcctagacaaagaaaaaacagtgaagcatagacagtttttgcaagaggcccaagatcatacatcaaatatgtgcacagccaggacctgaaccagttgatatctacaaatgcctggcttttgccactgggctccttcagacaccaaggaaagaccatatgagcacacagcaagaaggtggctgtctgaaaatcaggaagaggaacttcaccagaacatgactccatcagcacctttatcttgcacttccacccttcataactgatgggaggacaggcatgatggtgtgtgcctgtattcccaccaactcaaaaggctgacatgggaggatcactagagcccagg

SEQ ID NO: 2497 - DNA, 519 bp, Homo sapiens
gtgtgttctctgagcacctcgtgaccttgctgggagtgtgtctgatcagccgcttcccttgtgaccaaatatttggtcatggcagcaggagagaattccatcagtggacagctctatttttaaggctctggctttgttttctctttcctgagaggcagtccctgcagcaggcttgagcctctctcactgacagcctgcctcgcataatgttaagcaggcatcggacacttgctggaaggcagggaattgcaatgaaagagcacggaggtgagaagctgtgctccttggggtgaaggcagcttctgtgctcctgggatctactgttaagccagggtgacgccagcttgcatgctaccggagggatgagtctttggctcagcagaatgggcctaggtggagcttgaaattaatgaagagatgctgcttccagctttttgagcaagaagaagtttggcctccagttattacaccttgagatcaaccttcaggcctccacttaagcgagttctgacgtcagtg

SEQ ID NO: 2498 - DNA, 25274 bp, Homo sapiens
cctgagacaagctggcagtcactaaatctcagcgatcactcaatgtgtgccaggcattcgcacacaatatcactaacacccatgacagtccttcaagagaggttctgctgtctgagagattatgtgacacgcctaaggtcacaggatcagcaaatactagggctgagatttaaacccagaactgtctactgccaaagcttttgcgctctccctcgtgccacgttgcttctcattttgggcttggtctccacttcccagtccttgaaggagttctccaggtctgccccattagcactgcatctcagaaggaagctgcagctgcgccgccaatctcccggtggtaggtgcttaataaacattatgaagtgcatgaacaaatgaatagcccctgatggacagacatgcttgagaaacactatttttcacattcctatctacactcaagattttacctatgatagcaggctgaagattcccaggatcttacatcctagcaggtaagacaaacaattaaccaacagaatgattaaggtcacagacatgctaaggaagaattgaagccagatgtgataagcaaaataacacctccatccctaaagatgtccatgtcttcatacctagaacctctgaatatgtcaggttatgcagcaaaggagaaataaggttgaagctggaattaaggttgctaatcagctgaccctaagatagagagattattctgggttggctgggtgggcccatgatagtcacaagtgtgcttaaaagtgaaggaaggaggcagaagaggagagtccaaggacaaagtgactacagaggaatggtcggagatacaattttgctggcttagaaggcggaggaaggggccatgagccaaggatacaggcaacctctagaagctgggaagggcaaggaaatgaaatgtcctttatgaaaagtaatgcagccctgtaacaccttgattttagcccactgagacatatgttggatttctaacatacagaactgaagacagtaaatgtatgtgtgtgtgtgtgcgtgcatgcgtgtgtttcctgagtcagggtcttgctctgtcacccaggctggaatgcattggcacgatctggctcattgaagcctcaaacttctgggctccagagatcctcctgcctcagctactctggctattttttttttttaatttgtgttttttagaaatggagtctctctatgttgcccaggttgatgttgaactcctggccttaaacgaagctcccacctcagcctcccatgttgctgggattacaggcatgagccatcacatccagctaagtctgcattgttttcagccaccatgtgagtatcactttgttacaggagtaatagaaaaccaatgcactgagtgatgatattgattgtaagcagggaaggtccctttagaggtctcacaaaatgtaacagtgtaatgaaatgcgaaaaagcaagaactaaccttaaaagagctgagagaagattccagaagaagaaagagctggtattgagttccagagggaggacactccttggcaaaggagacccaagtggctgagctggtggagcaagaaacagagagagaaaagatgagatggagctggagaggttggcagaggtcctctgcaggactgggaggtcatggcaggaggactggagtttattttaagagcaatagatggctatagaatagagcagaagggtgataggttgtttttcactttcttaatgatatccttagaggcacacaatttttaattttgataaagtaaaacttaaaaatcttatccttcatcacttgcagttttagtgtcatatctaagaaatcattgccaaaccctagaccacaccgttttactctggcatttccttctatgagttcaacagttttagcccttacatttaggtctatgatctaccttgagttaatgtttgtgtatggcatgaggcagggatccaatttcattcttttgcatgtggatatgcagtcgtcccagcaccatttgttgaagggataagtaacattttattgcaataaagacagactcagtaataatgctatgctgagccatgttgatgcccaaggcaaaagaaaaaaatcagtaacatagtgttttgtaaatattaaagatacaaattctttctaatttggtcttgaagtctctccctggagagtggctataaactctagccctgccctgacgacagggctccagggaaggcagtttctggatgtttacagcatgcctttcaagggatacatctttatcctggtagactgcctaatgcctaagtgtccggccatggccaggtgttccccatacagaaaacttgcttttattcacagatgtccctgtggctcttgtctaagctgtgtttagtttattcctaccaagatagccactccataggagagccctgaccaggaaagaagttaggctcatgtttgtctgtcaggggagacacaggaggaggcagcacaacaccgagcatgaaataacagacatatttattacttacagattccacagtgcagggggcagtatgcctcccagggtcactggaaagggggaagccactgaggacacgtgcattcagccagcaggtggggagcaagagagagagaaggggacctgtaagccaaattctttattgggtcctgggagttactcaagcaggtttcctgtggggaggtctaactggtggtacaagcaggcattagtttcatgggggtcacgctgtgactaagaggtggccactgtggcacacctgcacagtccatgtggggtgtggaggtcagtggggctaattaggtcagttgtatctggctgtctcatggagaggtaactatcacgagttatataagccagagagctgaactgaccaccttaaggaactaggaggagttgtaaaactggatactgcaccaagggtgactaagcctgcttctggtatgagaaagttaaagttatattcaaaatggatactgaagcaacatgaaattataagaattcactcaatactatttatcttaaaattttatttttttttcactgtgggtttttgcattaattttgtttaaaatattgcatttaatattacttatcctagttactgagaccttgaagcccttttacattttgtgcctaaaataggccttattcacctcactctagttaatgtcctacaaagtccctagctcagcttaccatgccttccacaccctaaaccctgcctgcccctccatctgcctctcaccccccattcctcaactgttatcactaataatacagattagttcatgtttccttgcacacatcatgctatgtcaagtgtctgtcattttgatcttgctcaccacttgacttggaatcacttatctttaatatcttgctctttcccatcctacaagatcaggtgttaactcctccagaaagctttccttgcgcctccgggtgggttggcgctcctcacccaggctcccacagtgccctcctcacccattgtgctcccataattattatagaataataacataataacatagcatgtattaccctgtaaaataattatttattatttgtcttctctccttctggactgcagcactttgtcccttatgtcaaactgtatcttacccacttgaacattctcatgtcctagcacagtgcctagaatatgacagataagtaatagatatttgtttaacagttaatctagctagaagtacagcaaggagaagccaatccaatctgcctaaagtgaacagagaaggttcctcatggaatctccctggtaggaggacacaagttaagcatctggcacagaacgcttccctgctaaaaaggtgagacatcccagagaacagaggctgtgcctgaggcaagagctccttgtctggactccgaggatggaagcaaagacttacaagacctcattagagagtcagccccatagacagaaggataatttagaaatttaataactggatctggcctacaagtgaagcagagaagtggctacttccaaggagtgaaacagtgagcaaaattaagggaaaattcccactgagctcacttcatttattcattcattcattcactagtcatttcataaacatttatggagcatcttttgggggtactgggataggccctggaatacagggatcaaagatcatctccttacccaaagaaatccatggccaagtcaactgctgcaaacctactatgtgtgggatgggaaaccaaaaaatacaggtattaacaacaaagtctagccttcagtgtttttactggattattctatttgcctatccaaatccactctctatctttgtccaccctgctattccctggggaagctgaacctgaaccacactcttgggctcccttgaccactgactaccaactgcacatggccagtgttgtgcatcagcaggagattggaaggagagaagtgagtgagggtgtggcatttattactattgccgtggggtttccatgggccagttctgttgaaagccaggaatcctatgtttcttccgcatagcccccgcagtcttctggctctctttcccctctctccactctttcaggcctacaatagcacctagatttcatagtcctctggcatttgactattcttcgtggtttccctaagccctgctcccagctttgtaagtagtcctttattaaattcatttcacattatccaagtgtaagtgtgccatctgtttcttgctgggaccttgactgacacaacaagctcctaagggagatgtgacaagaacatcaataaacgggggatggaaggaggaatccccttggacatgtgaatgaatatatatggccacccactgggaaaggaggccatgagaaaaagtcaaagccaaacacgttgggattatttgcctttatgcccaggaagctggaacagagcagggagctggtcgaaggtacccgagaatccatccctgaaggatagcagatttggagggtaaggaaagatttctttctacctgagaagtgcctaggagacagtgactctgagttttcttggggtagacagcaatgaaggcttaataagcagaccccccagactggtctcctctccccttgccactgtgggaccttgaggcaaagggaggagcagactgatgcacctcgagtgctatagagaaagggaaacaagactgtttcctgagttgcagaatatgtcaaaaaataagaggacaaaaccacactctgtcaagtcaccttaaagacacgaaataggttctaggcctataaaagtgcctgtggcttagcatagctagaggttatctagatgttttcagtctgagaactttcacctgaggaagaaggacacatcagactcttctaacagcattcgagtcacactactcacatccctcttttcagttccatcctcctcaaaactccttagaggtattatttggttcctcatgtggttttcttacatggaagaagaaccatatgtatgctgatcaggtttaaggtacctaacaagtagaattcatgctgaaaatcaatactttcggcatctgcagtctcctaaaagcattgttagtgagagtcagcctccccaagtccaggaaactcaaacactttgaaaatctaaacccacaaagccaaggtcaaaatcctggcttgggtgaagtcatgaatatcagtgctgcctggaggctccttggaagcccaccatccaccagcctgggacacacacagacacactggtactttgatgagccctgctgcccactaaagtgctgatttgttagaacagccattgtaccaggtctctctcatccctttcttgaacaatggattgctcttccaaacttttttctttttttttctttgacttttaattttaattttaattctttagttgacacagatcttatatatatttattgtgtacagcatgttgtttgaaataagcaggctttctgaaatggctaaatagtgctaattaacatatgcattacttcacatacttatcatttttgggggtgagataccttgatctgttttcaatttcatagcctggcattggctcattgttctatttgactgattctgcctgtcactgtatctaccacctctgtcagattagagtaatccacaaatttggtaagcaggcgtgacctaagtgactgataaaaatgttaaatatacaacctgaggattcttcaatcccatcctggcttctctccttttaaaactttggtctgtccttttcagaactacatgcagcatgacaagtgtggtctagcctgtgcatggcaaagcatgcctctcacctcgttgaaattctctgctcctgcaggctgagatcaaaataactcccttacacattatggctgatattactgaagtgcttctgtcatttttatcctgaagatactaagtcacatcagtgcatcttgttagttttcttttggactcgggtgtaacatgttctgttcctgttcagtttcagttttgcctcattatgcttagaccattgctgcagcctgttaagatctattaggatcctgtgcagaccagactcaacctctcatcactcgacttgtgcctaactctctagtaccatcccatccccacttctgtctctacactttatttctagcaatagtaattgcttcagggcctccccaatgtcttctagactgtgtgtaggatacaatctctcccacacagaaaaagtctcagactaacacaaagatccacatctcaaactccgacccattccactccatgcaacagaaggtaaaaggatatgggagatctctgagtcatgtgaccaggaggctggggtctagtcctgtcttcacccttaaaaggctcttgtctgtcctgtgagcaggcatagggtacagcagtctgaggatacaccagggtctttctgcccctctctagctggagcagaggctgctcttgcttcccaatatccattctctcattcttttctgctcgtaagaacagaccccagtatttagaacagcacatataaacccctgaaatgatggcattgccagctgctttatagccaggagtggtcaagagataaagttttggccaatgaagtgggaaaagtcatgtgtgactgactttcaggagggtcttaaaggggagggaataaatgatctttgtcctcatccacttgcgcctgctgtctgcctggaatgtgaatgtgatgacaggctttccagcagacatcgtaggaccatgcagtaaacttgaggttagaaactggtctgatgattctggaggagaaagattgaagcatggtctcggaaacaccatgccaagcctagactgcctttacgccaacttcttttatgggagaagggaagtaagcttttacacatttaacacacctttcagaagccactttcttctatatttatgatgttatctctagctgcttaactctggaaaagcctcctattctctaaccctatttatccaactgcaaaatgaaactaacaatataacaggaaggggaaaaagatcatatgtcaagcattgacaagacactaggaatatgaaggcaaaaagataaaggcaattcagtctgcagattttatgtgatgatcacctctcattgctcactcactatttctttctttctttcaacaagtatttataaagcctcaacagagatgacagttctgaagggactagggttgccatatttagtaagtaaaaatacagggacaacaaatctttttttttttagcataagtatgccctgtgcaatatttttttattaaaaagataattgttgtttatctgaaattcaagtttaactggttgtcctgtattttatctaatgaccctacctggggctaccatggtgaataacactgaaaaaagcccatcctgcaaggagctgtcttccagtggaggggatggtgcacaaaccatgaagctcaatatcagaactgaatgtagggataagtggcatgaaggaaataaaaccactacagtgtgacaggaaggtgactcttcaagattgtcagggaagtcccgtgaggatgtaacatttccccagatgcctggacattgaaatggaactagccaagccaggggaggaccagtccagcctcaggggccaacgagagcaaaggccctcatgtgggaacatgtttgggatgttctagaatcccaaggccagtggggttaatgttaagtggagagaggtgtgctggagcccagtcatgtaaggcccataggtgatttttttttaaaagaggccatggattctattttaagagtaagtagcagccatcagagggttaagaagggaagaatatcgtccaatttatttattattgtttattttttaaagaaggtcttgattgcttggtggggatgagacagggttggagaagtaaaggcagctgcaggagaatgagtaaggggcttttcaacagcacagctgaactgacagaggcttcagctggagagctgcagaagacctggtgagaaggatcccacgggctatgtgtttgggagtagggcagacaggaccagtgaagagattcactgtggaggctgcaggagagaagcgaatcaaatatgatgtgcagggctgggtcctgagtaactgagtaaaaagttctcatttactgagatggagacactattcctagggcaggtttgtggacagcatggggcagaatattaaggagcttgtcttggccagattccttagattagatagtcaaatggagatgttaacaattaaaagttgcttttattatccctaatttacagaagaggaaactgaggtctcgcaggttagaaaagcaggactcataacaaaacctgtccagacccagcttgcttccccagaccacactattataaacctccctgctgcagacgcgaaacaagcaccaaatgagatcatagacttttaaattataatgattattaacgtgggacagtgtctggagacaggcagggcatggaacctacaggatctagggagcaggtaaaatgtgctcggctctgctttggagctgagtcctccgcacgccagggtcagttacatttccacagacaagctgttccacagccagacttcacgccatcccctctgaatcatttaaattgcctttgctaaataatttacctccatgtagacaaaagggttccacaggctccccaaacattgtgggactggtgcataatttacaaagcattgcttagccgccccgtgcagggagaacaacagggcttggacacctgccagagccaaggagggcaccaactggaaaggaggcaaaacacagctccatcaaacagaggcaaaggcacctactgacacctggattctcaaggccaaaagcaagacaggaaaatgtgagggtcaaactgcctctgggcacaggctgaagccagtgagggaggggcacgtagctagcatgcgtgctggaagtctgaggaaaatatcatcaatgctacactcttcctgattaccaatatcctgagacctaattaattatgtcctttaaaaaagcagcattgcctctggtaagaagcatgtttagcaaatacctgagcattttaacacaggcaagaacgatgtggaattcagacaggaagggcaattttctgtgcctggaatgccttcctccacatcccttatgcacttgacaaattcctgctcctttttccagagctgtcctcaagggttacctcctccaggaagcctacctcactcccagaggcagaccaaggcttccttctcatcgtgaactatgttttatctctcatttcattgtataataaatgttgttttcctcccctggactcaggtccttggtaacagagtttctttaaatctgtagtcacagtacatgattcagtggtagcacattctgtattcattgtagaatgaaggatgaaacaaacaagacatgcaccataacttacaagatattttccccagcattgcatgtagtattgttgctttaagcataaaaattcatatcccaagagaatggcaaagtgtgtataaaataagcaaacataccagaagttgctcagcatcttcaagagtcgttctgccccttgctccatgtcttagcccattttctgttgctgtaacagaatatcacagattaggtaacttataaagaaaggaattttattcatctcacagttctggaggctgggagttccaagagcatgatgctggcatctggtgagagccttcttgctgtgtcataacatggcagagggtatcacatggcgagagggcaagagcacacatgccagctcaggtctctctccctctcttatgaagctgttgttctcatagtggaggctccaccctgacaactttatctaatcctaattaccttgcaaagaccccatctccaactgacatacggatttgggaattgagtttccaacacaagaaatttgggaaacatatttaaactatagtgctccacttggactaatacttcccatttctaaccacctgtcagcttcagctctttgagtttggcatctaattcattttacaatgcctgactcttaataggatgattgggttcttgaatcagacagatatattttttttggaagtttccagccatgccacttagaagctgtgtggcctcagtttagtaagttaacctctctgatcttcagcttccttacttataaaacaggcacagtagaagtatagaggtattaataatgcctacctcattgtaatgttgtgaatattaaatgagatcagtgtatataaatatcttagtgcagtgcctagaacttagtgatcattgaatgaatgttagctattactactgttttcactttactacaagatgtattgtccattctgtcactgcacctgctttctatgttctctaccagtacacacaccttcagttcagccctggacttgctgccatgtatccaataccccatgatcagacccagaacacatttggcaatcataggttctcttcttgtgattataacaaatttcctcttcctggatgcttctcaagatcaagagtaaaaatctgagttatcttaagctatgtttgggttgtcagtctgtgctgctttgaatataactcccccaaaatactgcctcatataaagccccagcttatattagggttacttgtgtttgagcctaaagatacaatggcagttagaatttaaatggcatttactatgtgcttggtactttttaaaagtcatttatatttagtacttaaaaccgaagaggtaccagtatatcttcattttgcttatgagaaattgaggcacagagaggtatcgtatgagggtgggagtgtgtcacactctgctcaggagggcttgctagtcagagctgtaaactaagtttacatccttgggagaagaaaaactttgtccattctaaagggtctgacttttcccagttttagacatcaaggaagaggcaggttctgttatagaaaacccagccttgtaaggcaaggattagatgggcaggaccaaggaatggtcatcattctctgagcccactctctttagttaagattttaatgcatctgaacatattgaaaaagaaggtggcagaaaactggcccttgactcaagatagcttttagacttagggcagggtagggagataggttgtaggaaaattgagactactgttaggtagcaggtatcccatacaataaaatgtcaagtggtaccctctagagttaattcgcttctgttatctgggagccctgttaatcattctttcatgccttggttgtaccatggggaataaaggagtggatttaggttcaccttggacacttgtgtgaaaataagatctgcagtctctggaaccagctttgttggatgcaaagagaaagtgtgtctcagggataagaaagaactccctgctaaccatggggagcttctccatctattgctagccaaggtggatgaagatttgatttcattaaatcacccggcacatttctttacctgcccataggtgagtgagtccataggagagtgaaaatggaggccatttccagccaaacctggaggcttccgtgggtcagacaactaggccccaagagaagaaaaataaataagttaaactcccttcatcgggaaaataaacatcaaatggcatgtgatagtgtgcactgcataagtgaataaaggaggtttaattctttaattattgcctctagtttccccatggtaacaaagggcaagttgatgaagagagataatcagggcataaaatattgtgtctccttggtttatttcacttaataaaataataaaaatatttctccttaagttcccagtcttgcttaaaaaaatgagacagtatttttatctaaactcatttcaaaacagatccataaagatttactgagtacctactatgacactgggttcaatatgatggtctctgctcagaaagcacaattctgacttccccttgacagtccccacaactcacattcacacacttttaagaaatttcaggccagacatggtggctcacacctgtaatcccagcactttgagaggccgaggtgggcagatcacctgaggtcaggagttcgagaccagcctggccagcatggtgaaactctgtctctactaaaaatacaaaaattagatggccatcgtggtgcatgcctgtaatcccagctattcaggaggatggggcaggagaattgcttgaacccaggaggcagaggttgcagtgagctgagatcatgccactgcacttcagcctttcagtctgggtgacagagcgagactcagtctcaaaaaaaaaaaaaaaaaaaaaaaaaagggaaagaaattttagttatctagtggactcttagaagatattttcgtttacaacattcaccatcaagagtctatgacttcactaatattcacctatattcctttgaaagattgtgtctagcaatcttttgtgttcatgttaagcaaactatatttattaagaaatactttgtttccccatttttgtatttagaatttccaataggaatttctttcaagaaataacccatgtgcttttactgagttaatagacttccagccaaagtgtctccgttcactcaataatcatgaatacagtaaatacctgctatgacccaggcattgtttgccatacttgggatacaacagtgaacaaaattctaggtcctcgtgtagcattaattctagtttaaacataaagtcaaaacaaaatttaccaagaaaaagcaaattacattgtatatcatgtcatgattagtgctactggaaaatgcaatgcaaggtaagagagggagtcatgagatgtcaggggatagtggtgatgaatgtggggaagggaggctgtaatttaagagtactgagcataggtgtattagtccattttcacactgctgataaagatgtacccgagactgggaagaaaaagaggtttaattggacttacagttccacatggctggggaggcctcagaatcatagcaggaggtgaaagccacttcttacatggtggtggcaagagaaaatgaggaagatacaaaagcggaaacccctgataaaaccatcagatctcatgagacttattcactaccatgagaacagtatgggggaaaccacccccatgcttcaaattctctcccactgggtccctcccacaacacatgggaattaagggagtacaaatcaagatgagattttggtggcaacacagagccaaaccatataattctgcccctggcccctccaaatctcatgtcctcacatttcaaaaccaattatgccttcccaacagtccctcaaagtcttaactcatttcagcattaatccaaaagttcatagtccaaagtctcatctgagacaaggcaagtcccttccacctatgagcctgtaaaatcaaaagcaagctagttacttcctagatacaatggagataaaggatttgtataaatacagccattccaaatggaagaaactggccaaaaccaagtggttacagggcccatttgagtccaaagtccagtggggcagacaaattttaaagctccaaaatgatctcctttgactccaggtcttacatccaggtcatgctgatgcaagaggtgggttcccatggtcttgggcagctctgcccccggggctttgcaggatacagtctcccttccagctgctttcataggctggcatgagtgtctgtggcttttccaggcaaacagtacaagctgtcagtggatctaccattctggggtctggaagatggtggccctcttctcacagctctcctaggtagtgccccagtagggactctgtgtgggggctctgaccccacatttcccatctgcactgccctagcagaggttctccattaggaccctacccctgcagcaaacttctgcctgagcatccgggcatgttcatacatcttctgaaatctaggaggaggttcctaaaccctgcttcttgacttctgtggacttgcagattgaacaccatgtggaagctctcaaaccttggggcttgcaccctttgaaaccacggcccgagctccatgttgacccctttcagccatagctggagtgggtgggacatagggcaccaagtccctaggtgcacacagcatggggaccctgggccaggcccatgaaaccattttctcatagatgtcctggcctgtcatgggaagggctgccatgaagacctctgacatgccctggagacatttttcccattgtctaggggattaacatttggctcctcattacttatgcaaatttctgcagctggcttgaatttcttctcagaaaatcggtttttcttttctatcatattttcaggctgcaaattttctaaacttttatgctctgcttcccttaaaaagttgaatgcttttaacagcacccaagtcacctcttgaatgccttgctgtttagaaatttcttccaccagatactctaaatcatctctctcaagttcaaatttccacaaatctctacatcaggggcaaaatgctgccagtctatttgctaaaacatagcaagagtcacctttgctccagttaccaacaagtgcctcatctccatctgagaccacctcagcctggaccttattttccatattgctatcaggcttttggtcaaagccattcaacaagtctctagaaagttacaaacttttccacattttcctgtgttcttctgagccctccaaactgtcccaacctctgcctgttacccagttccaaagttgcttccacattttcaggtatcttttctgcaacacccccactcctggtaccaatttactatattagtctgttttcatgttgctgataaagacgcacatgagactgggaagaaaaaagaggtttaattggacttgtagttccacatgactggggaggactcagaatcatgatgggaggcaaaaggcactttttacatggtggtggcaggagaaaatcaggaagatgcaaaagcagaaacccctgttaaaaccatcagatctcataagacttattcactaccatgagaacagtatgggggaactatccccatgattcaaattatctccaactgggtccctcccacaacacatgggaattatgggagtacaattcaagataagatttgggtggggacacagagccaaaccatatcaataggattcatggggtgctagttaaaggaggtaagagtcattcatacaatatcattctaaggtaagcattctaagcaaaggctggaaaaccaaagcatgcccagagtatctgagaaacagtcacttagtgcagactgggcaaaatcctaggacagtctcagatgatccacaaaggtagtggggctgaggaaaaaaaaagatggtgcaagaccatgtatggtgttggaaagacactggcctttacccccaagaaaaatggagagccttggagaattttaaacaaaggaatgatacaacaaaaatcatttttcctagcctgtgtacttttatttagcctacccataaggtatccagaaggctttttggaacaatgaaaacacctggagcagcttctaggacctcctctgggctacagaaaaggtctaagcacccaggtttggtgccaatattcattttacagaggagaaaatggaaagaaagaatgggcaatcgactggcctatggccattgctgagttagggacaagcccaggactggacacagggctctttctccccacaatgtgccactaaccaaagcaattatgcaagaagaaaccagtcttgggtgcattaattttatgttttcagctgtccttcattagccaggcatcatgttaagtgctttataagcattatccccaagatgtaggaaatgttcttcctaactcatagatgaaggactgagacccacagggtttactgcacttatttgaggcacacatctaatacatggaggaaccagggtccaatgcagtctttctgcctgactacagagcccactctttgttactgtaggggaaggtttgtaaaagaactgaactgaatttcatattggttgcatttctgcatcctgtcactcagctgcctttttatgactctcactttcaatatgttgacatgaactcacaagttccagaataaaacttttctaatgggaaagtaatgtctttacacaaaagacttgttaaatgggtctcaatcaagtatttttctaacagatagaaaaagatcatttcccaagaatagaggcctgtcctgtaatgcccaagtcaaggtaacctcctctgagaaggtttctctgctcctgtcatccagtgggaagaaatgacttctaattccaagcctttacagctgttcatgcgcagtgataacaattgtcctttatcgagtccttgctgtgggccaggtatttgacctccataatcccttaacttctcagcaaccccttgagtcaggtacagtcattttctgtatcttaaacagagattcaagtgagttcagtaatttgaccaagattacacagctatggagtggcaaagcttcactctaaacagcctcagaaatcattcttgttgcacttatcacaggaaacttgagtacaagtcagtttccagaatgccttacttatgaatacgttccaggaaggcagggagttcctgtcttctggttacaccagatccccagcacctagaataatactggtcccaaagaggatgctcagtggatattttctgatagaataaatgaccttctctctatggctcaaattcctaatccataaaacactgattccatgtaagaattgtactacataacaaaggagaaagtgttttatgagccacaagtacctacctaatgattattccaaatctgagatgctatgatttgaccttttgttgctgtaatgtctgtgcctaagaacacataagtaagatggtattggatgtaacattgtgccactatgtattctcatgaacaaataatcaggaagagagttttgttttggtgatgatgtgaaaggaataaaacgattaaaccagaataactgtgcattcctcaaagaggacctgtgtactatatcccataggatctggcactttaaaaaaaaaaaaagaagaagaagaagaaaaagagtggttactttcaagagtctgaactccttcctcaagttcagaacttcagacctgcaggtctttctccttcagcacccatactgactggcaaaaacagctataaaaatcaatagatgctacatgctggatggaaagagactgcaaaacagaggattatcctccctcaggaagagataaaggggaattgattaaaggtgttccaggccagtcctttcatcagagcttggaagggctgagcccacgggagggcaggttgccactgtggcagcacaggtagggccctggaaatgctttctccgagaagccttttgactgataaggctgccagagctacttttgaggcccaaactggctttctgttattctccagggacttggcctgttttctttcccaaaactgtactgttggactccacactctctcccagttatctccctgaaaacctgcttaggacagggactctggctctcagcctccaaccacctttattactgccacaagagggatgcacaagggcctttgctgcctcctgtagggaaattcagataacttacggtggtcacgactcgacagagggctgatgaacagcataggtttctggttccccagccaaggcttctgtcagtggagctgcccggtgctgggttgtctctggctgtcttctttcatccctgccatattccccaggatgtgagcgctgctcatttctgcagccttcttactcaccacatccctctctcccttcaggctccatcctttctgaaatccaaacagttccctaaaccctttaatcaggtcttttttcaatgggtacccgggactgttttaatcaggtatggtaagacacacaggcagagaaatgactgtcatgaaggaagaagtcctctcacagttctcatgccactctatgcaaggccatgcagggaagcagcagggtctgacccctgggcagaggggagaaggggaactgggggcaagagcctttgttgtggtttccagagaaatgggtgagacagggtaagcattaggactggctagtgtgcataattttagcaggttctagggcatggagggtgcccctatcttactggtacctggccctaaggcgataagggaaatagtggcctgaagtataaaatctctgtaaaggaggtgctaggggtatgggctctggatttgttggtttgcatatgaaagacatgctcagaaccagtttttagtaaccactaggaattagctagtccagggaggtgcaatcccaccaacgttagcaaggcctcaagttgtcaaaccatcaaaaatacagaatacaaaggcatgatcagtaaagctccacactttctcaagcatcccaaaaggactggtctcaagtatgtgagcactctgagggttgcaactttttaaatatttgcacaacatttaccttcagaaaaagctgggagtgacggcagagcagccacctcctccaggaagccttccttgaccaacccttccccacctcgctggtgctgagtgtgagatgctcctgtttgtgttcacacagtgactgctctgtgcttgctgctatccagccctgagcacacatggtttagcagcccatgacttgtctgtcaccccatgagatgggaatatcctcaaggataaggtcagaatttgacacagtgaccagaacagtgaggatcagtaataggaaaattagttggaatcttattaaatcttctttcttaccaagcaaaccacaatatttactccaggctgaatgttaaggctcatatccaggccactgctagcccataccacatctctgcatgaattcacaaaagatgctccttcttcaaatttacaacaacaacaaaaagaatcaatataactttggataacctgaaaaataaacagcatatccaaaaacagaagtccaaaatcaaagtgtcagcagggctgccctctctctgaaatctctagggaagaatccttcttgcctctttctggcctctggtggttgcccagcaatccttgacattctttgtcttctagaagcatcaccccaatctctgccttcgtcatcacatggctgtcttctctatgtgtctgtgcctctgtgctttttcatggtgctcttctgagtgtctgtgtccaaacctccctcatctgagtagcacaccagccattgcattccagcctgccctgatccactatgacctcatatcaacttgattacatctgcaaaggccctatttccaaataatgtcaccttcgtggtactaggggtaaggactttaacatatctctgtcaagggcacaaagcaaactacagaactctcccctgatgtgttctcccactggccagaaagaaagccacatccacaagtcacctgtgatactttttttgaagaaaaatattcagaaaagatttgggtattcacaccttgataaattataaagttctttattcactctgtctttttacttctctctcatcaccctctcttgtgtcagaatgtactttcagccatggcttaaaacagtatgtctgtgtccttagagaatgccaatcaaggtcactgtgaaaagcaacacaaagaaacgctgatcacgtctcacttcttgccaatattgctcagaagaaaaaacgaccagtgaattctgtgtttgaaaaaagcatctcaaataagtacaacctagaaaaactgaaagtccatttttcgagaaactagaaatgtcaactgttaaactgtactgcagtgaatgtggcagagagaacatggtatgtttgccatctccattacctttgcctcggcacacaaagacagactacatttcccagcctccatctttattaagtggagccatgacactgagtttggacagagaaatgtgaagggatgtgacatatgcctcatttaagcctggccagcccctaagcaatctttcctcttcttttgcctctgatcagtgcagagaatcccatcgattcccaaaggccctgggaaatggcaggtccgctctagggacgaagtgtgggtcttttaatcacagctgcatcatagcagatccacactcttagatagagacctatattgcattgtgacagggttgagaacaagggttcagccactggaattgggggattgctccgaaaataaattagcaaaccctaaagaaatgtgtcctttatagaagacacagtagtgtggctgaagtcaaaggatgaagttaattggaggagataagaccagcattatgtagtttggatttacgtaattacatggaaaaagactagcaaaggtagggagactggaaagtttaaagcacctcatagagaaaaaataaaagccattccacccaatgggaatgtggtgaaggtggagcaggtgggcatgaatagcactaaatatccttaagcagctaaaggacaggacggctcaggaaaggtaactggagaacttggggctaatgcaacaggcaagagagagccatcaaagatgactgaataagtgaataaattgttaaaaacaaagtgcccaaaagacagaaatgcaggtcgtgtgctggatggatttgaggcaggtggaggcaagaagtcccattaggaagctattgcaaccgtacaggtgagtgattgtacagacgtcacctgaggctggggaccaggggtgaagaggaaggcatgggggagatgacagcaataacaactttgtcttgggacacctactatgtgcccggtaatttatatacaccatacaatttaatcctcaaaattgtatgcagtagcactatggccttatgggacagttgaggaaactgaggcacaaagaaattacaaggctagtaagttgttaaacgtctcagcttggacccaaactcaggcatttgactccagagtactcgctcttaaccaccatgtgtagattaaggtagttaacaaggaagaaattcaggtgccctgacaggctgatctcgcttaaacaacctccacagcccaccacccagctacaacctccttctcattcccaaaaaacaatgtgagtttcaatgacaaattccgaatcatttgtattaccttcaaagcatctgcctgtgatcacataatacatccttttcaacaaatgatacaaatgcagtaaaaatgcaaattcttccctggccaggctgctcaaggccataaacacaggtgcaccattaactttgagcactgagcaaggattccaggtacaaagcttccccagagaaaaaaactgctctcaaattaaagggaaaggggcaactctgttcctctggccagacagggagcaaataaaatagaaacttagctcagagctatcccagaggttgtgtttcttagccttggctgcacatcaaactcatttgtagagtttccattaaaaaaaaaataccaacactcaagcctcatgctagaccagctgaatcagaatttggggagttcaggcccaggcactatatgtttaaaactgtcccccgggattctaatgcaaggtgagagttgagaggcactgcccttgctgagcaaagtagctgtttctgtgtcatttgggtgccctccttcaactacgcgtttgtccaaaatgtattgtgcatctctctgtgcccaaagtcatactatattctggagatacagaaataaatgacatgatcttgtcctcaagaattttagtgtggaatgtgtgaaaaagccaaatataatggagcgtaggaattggctaggtgttaggacagactgagggcagaacaccagggaggcacaaaaggaggcacccgtcttggggatcagaaaggaccttgaacaggaatcaacacctcaactgagtattaaaagaagaataaaactgagccaggtgaatacgaggtgggagaaagcattcacggctgagagaacagcttgtacaagagaagagaggtagaaggtgcagcaaaaagaacttaaggatttaaagaaattcaggccagcagaaacatttgatgcatttgagtggaccacaagtgaggctagagactggggcaggcaggggagttccatgggacctggatctagcaaaggctactggatttagcacccttgaaaaggtgtcgaggatcaaagaaggaaagtgtgaaaaaaatattgagatgcataaatacaaagtggatggtatcatttgcacatttattataccgtttagtgtacaattataatgaatcaggcccttttctgagcatgtggtcttcattcattcaataatttagcatgtatttattgtccatctactgctattgatcaataatagcatggtgtaggctatttcccatatacacaatgtataggcaaataagataacagtgaacagtcaaaaatccctcttttcatgggatgtaccttttagtagaggagacagacaactggaaaaataagttaaaatagtaaattagaggctgatagctgtggtgacaaaaataaacagatgaagaaaacagccagtattgtggtttctggtcttttgatgggtcaacctgtcagggcttcagtcctctataattccatcaatcattaacctaggtgttactatgaaggtattttgtagatgtgattaaagtccataatcagttggctttaagtaaggaagatgatcctagatggtctgggtgagcctgattcaagcagttgaaaggttttaccagtagagctgaggcttccctgaggaagaaattccatctgtgggctgcagtgtcagctcatacctgagggttccagcccacccttccccatggacctgccctatggatatttatcatgcctagccagcttccacaattgcataagccaatttcctgcagtaaatctcttaatatgtgtttcctactgcttctgtttctctcgttgaaccctggctaatagggggaagctgtcattttaaacagggatgttgagatagacctcactaagaaggtactacctgaggagaaacctaaagttggtgagtgaatgagcaagtaactatcatgtgaatgcaggatcagaatgtatatgttgggaggcgagacaaggataccagacaaagtagcagcaagcacaagggcattcttttatttaatcctcacaacaacactgtgaagtaggaactatgttatcatcaaaaattgtgaaggacaaggcaaagatatgacatcaacctaagtggtcatcaatggatgattagataaagaaaacgtagtttatatacacaatagaatactatattcagccagtttttaagttaaataatgtcttttatagcaacatagatggaactggaggccattatcttaagtgaaacaaatcagacacagaaagataaataaggcctattctcgcttataagtgtgtgtacacacggacatagggtatggagtgatagacaatggagactcagaagggtgtgggggtgggaagagggtagatgatgagaaattacttcatgggtaccatgtatgttattcagatgctggatacgctgaaagccctgacttgaccactatgccatctacccaggtaacaaaattacacttgtactccataatttatattaatttaataagcttagcattaataaatttaatacatttaaaaaataaatacataaatataaataaaattgtgaaggatctgatattttcccctgcttgccagctaataagtcaagctgccacacacagatgctggcagaagatatgagactcccgggtcagaagcaaagatgttattactcatggcacagcagacggcatgaacttcatgttcatatcagttccctttgctccacccaatttccacacagacaatggaggtgggcctgtgtagacactgcacacactttggacttgtgtcacagccaaggaatctgaccctaggaaacccctaatcttataaccaggccactggcaaacctgctcaacctttgtctcagaggaagacattatttttattatattggtcaggaaatagatctgccctgtccatggagggagacgctatactaaactcatccaacccacagcccacagggctgcatgtggcccaggacagctttgaatgtggcctaacacattttataaattttcttaaaatattacgagattttttgcaattttttttagctcatcagctatagttaatgttagtgtatttcatgtgtggcccaagacaattcttcttcttccaatatgatccagggaaaccaaaaactggacacccctgtgctataccttccaaggctatgtgctatacaaatatactttaaaggccaggcatggtggttcatgcctgtattctcaacactgattggctgaggagggcagattgtttgagcccaggagttcaagactagcctaggcaacatggtgaaaccctgtctctacaaaaaaatacaaaaatttgctgggtgtggtggtgtacacctgcagtctcagctccttaagtggctgaggcaggaggattgcttgaaccagtgaggtcagggctgccagtgagcagtgatcacaccactgcactcagcctaggcagcagagtgagactctgtctcaaaaaatatattttttaagtaatttttttactttatatata

SEQ ID NO: 2499 - DNA, 2915 bp, Homo sapiens
ttggaaacttgaaacccttgcctgggaaatgaagagcaaggccctgatttggaatgaatatgtttaaaataaaaataattacacagagttggaggagctcttaacacagatggagctcaatcatcccaatgtattgatggagaaacaggctcagcaagttcatggcagaaatggggctccaatcctctgtgaggctttgcccggtgccctagctatcagggaacacgaaatctgtccagtgcaaccaccttctctcatcatgtttgccacctgcttaagactctccttcaagtaagcaagtaagcagcatgttcttactgaccacaaagtagccattgttggggcaactctggcagtgaccttgatcgcctctagaatgcaaaatgcacttgacttatgcaaataccaacacttagtggccctttgactgccagggagcattatggacctttcgctgagtttcacttggacatatgaacttctgatctcaactgactcatttagttggagcagggaatcccaatgcctttggaaatagaaaatggatatgactcaggatgaaacatcagtggaaacagacctttcaagattttttaaaaaaatataactactggttagcatagtcataaaattagatagttcttcttccttatttagaaaacagaatacagaccgggtgtggtggctcatgcctataatcccagcactttgggaggctgaggcaggcagatgatttgaggtcaggagttcaagaccagcctgaccaacatggtgaaatcctgtctctactaaaaatacaaaaaattagctgggcatggtggtgcatacctgtagtcccagctacatgggaggctgaggtggcaggatcgcttgaacctgggaggcggaggttgcagtgagctgagatcatgccactgtactttagcctgggtgacagagcgagactccatctcaaaaaaggaaaaaaaaaaaaaaggaaacagaatacaaggtcaggcatggtaactcacacctgtaatcccagcactttgggaggccaaggtgggaggattgtttgaggccaggagttcgaggccagcctggccaacatagtaagaccctgtatctacaataaaagaaaaagaaagaaaacagagtacaaagggtggagtctgggtctccagtcttgtttgtctgcttgtaggtcctgctattccaagtgtggaccatgtaccagctccatgggaatcaccagggagcttgttaaaaatgtaaaaatctcaggctttcccccagacctggtagatcacaacctgtatcttagcaagatcccccagttgacttgtagacacaggaaaatttgagatgtactgcctgagagcaccaaaacatgtcaaacacaaaatagacctgaaacaaaggaagaaaataaagtatttaccatgcttgcattgtaatgagaatgcacgcaataacttcaggacatttatgacaataggaattctttttaaattagtagatggttctttttagaacagctttagatttacataagaattgtatagagttcccatataccgcccccttatcccaacatatacagattttcctcttattaacatcatgaattagtgtggcacacttgttaaaattgactcaatattgatatattattattaaagcccatagtatacattaaggttcacctttgtgatgtgcagttctatgggttttgacaaatgcataatgtcatgtatccaccatcaccatatcctacagaacagtttcactgccctgaaaattctctgtgctctgcctgttcatccctctgtcctcccaaacccctggcaaccactgatctttctactgtctccatagttttaattattccagaatgtcatatagctggagttatacagtatatatccttttcagattgaattaatttatgcctttatgttcctccatgtctttttgtgatttgatagcttatttctttttgatagcttatttcttatactattgctaaatagcatcccattgtatggctgtatcagagtttgtttatacattcatctattgaaaactcttttggttgcatccattttgggaaaatgatgaataaggctgctgtaaacatttgtgtgcaggtttttgagtgaccataagttttcagctctgttgggtaaatacttaggagtacaattgctggattgaatggtaacactatatttagctttgtaagaaactgtcaaattggagcagggtgtggtggcatgtacctgtagtcccagctactcaggaggctgaggcaggagggatttcttgggccgaggagtttgagactggagtatgctataatcacacttgtgaatagccactgcacagatgcacaaaagaaactgtcaaactgtcttccaaagtggccgtgccattttgaatttccactggcattgaatgagagtccctgttccacatccttggcagcatttgtggtgttaacgttttggattttagccatcctcgtagccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataaggaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattgggatggggtcaggagggcacccctcccactcgggatctaagtctcttgcac

SEQ ID NO: 2500 - DNA, 14677 bp, Homo sapiens
ttagaataacagaatttggtcccctcccacttccgtaagttgaattcttaattgctaaatttcaggcttttttgttgttgtttatgtaagaatttcaaggccacaactccatatttgaagtaaagtgctcataaaattaattgcaaggtaatttgccgttaatagttatctgatttctactttgatctagtggttgttaagaagagaggttttggtttttttaatcttgattttgctgttgattcctacttttaattgctgtactggagaaaatgatttctgtgggcttctttgaggtacagcacatgattcacaattgtatatggtctgataacataagaaaataacattttctcagttagtagaatacaaatacttaaaaatatatgtttttaaatatttgaaaaggggtctgctgattccattattaatgtattgcatccttacttgattaaattacttttgtttctggaggatttttttgtatatgtatatttgatgctgtgtccctggtgagttataaactccttgaactacagcttttatcatgcatttgttataaatttttattcattttatatatattgatattgtcaatcctcctttttaaaatttggatttgactttataattctgcacatccttttcttttcaacatttgccttcatttttcaagtgtgtttcttatagacagcacatgtctgtattttttaaaaacccaatttgatattccttgtttcataacaggaaaatttggttcatttgaattcagtgtgaagattaatatttcggtgttgttctcactttatttgctatttaccgtttattccttttttcgatttttacctctctttatattcttgctaataatattaagctttttgctagttctgttgtttctcttttggtttttgaattaatgttattttatgattccccatagccctaactataaacttattctaacaatataaactattctaaaaatcacatataatttatgtgtctttatttatgtgtctttattaacacataaaaattaataagtaagtgtaaccactcgagtatttaatttgccattcctcctgcccctttaaaaaggagacatttccactggcccctgctcttccatcctgagcaaactccccaccttcacagtagccaacacttgggtttacagcaatggtttcagattttcagcgtttcatatcctggctaacatttttgagataataatttcttctgtttagcaataagttcttaagatttaaatatattccagtcatatcattttattaattcatttttttctctataccttaaaatctatggcatctcatggttcgacattaggaaatccatcactatgattcagtaagtaaacaaattcaaggtgtcacatcatattgctttttatgcttttgattttagtaatatcctttcacattcataatccagatagagagataagcaagattgtatccaccaagcctcctctttattgatcttccaaactgaaaaacatagctgccattttagtcagcagttaaactttattatagaatatttttataccttttctgctaacattacctgcaactcccatggtgatgctcaaatcccatttgggaattcagtgaactagcagaatgaaattctaagagactggggcttgttgatgtgtccacgctttccatgggaactgatgttaaatatttcacaaataccataacttccaggaattcacatattctttattgaatgtagaattgtgaaatctttaagaaataactgaatcattatttcttcactgtctcctgcctgtgaaagcagaactatgaaatagctcaagggaatcagtgagagatttgtatccattatattcagtagcctgcatgtgtccaaatcacaaatgaaatgatgtgggcaaatataaattaaaattgaatgttgcagaagtggttgaggaacttcaccaggatacattaatgtacaaactgaaaactgatgaaaggtaagagtttggtcctatgtggtgtaaaggataggagcagttttgtggacatttcttcattcttctctttctgcttttccagacttctgaagagagatttgctaggaaaaataaaaagatatataaatttcagtgatgctgaaggtatgtgcaaacaaattgtcctcattaatagtaaaggtataaattgatgtggattttctagaagacaatttaaaggtacacacttggtttctaaaaagtacactttttaaaatctatctttttaatcccaatttatttacaatttattataagaaagtatttaggtaattatgcaaagatgtatgtaaagtaagttcactaattgttctcagtacaaaaaaaaggatgaaattccataaacatctattaagaaagacctggttaaataatgtattgtacctccatatgtttagtcattaaaaatggtcacttaaatctctagtgtattgacatcaaataatgtcaacaataaatttaaaaagcataactctctagtgtattgacatcaaataatgtcaacaataaatttaaaaagcataaatctctagggtattgacatcaaataatgtcaacaataaatttaaaaagcataaatatatagaaaaatatccctatctctatataaagaatgtctacatacccacttatgaatacatggaaacatatctgcaaggatatagtctaaaaccttatcggtagtgtttcttcgcagtagtgtgaaagaaatacagtagaaacatttaactccttccagtaatgggaaggagaggaagagctcacaaaaacagaaagcatatatttttgacattttgatattttaaatgtaatctcttttcttcatttttctggctacatatgttgattcaacacatattagtaagcaggatgtaatattcaataaaaacttctgtaattgtctgcattagttccaatttattcatatagaaactattcattttacatatctctttctattaaactaacatttagcatgtaaggcacagttttatttttgaaattattaataaattaaaatgttagtgacaaacataaactcttgagctttacaataggttaatgataaagaagacagccaatattagatggagaaaagcttcataaaacccacaggttagagaaaaattgttaggcatttaataaatgatagatcctttatattttgctgcacaaaaaccaaagatgaaaccttttttaaatgcatggtctcagcatgcatttcaaatcacatttttgaagtttatgaatttatgattatataggggaagaaaaaattctttgtttctccacccatcttagatctattggctggagctctgcaatttagactgacaaaagacggattaaacaagataaaaacaagtttattaacataggcacaatgcataagaatgggaactgtcactaatgtataactcaaatgagtggttagaccttagagttatataacaatctgaacaaggaataataaatatgttgagaagtgtcaggacaaaggaaaggaactttgggcttctaggggcagcaaattgtgggaaggtaaatttttgggaaaagttaatggaagatgttgggcacggtgtctcacgtctgtaatcccagcacttcgggagaccgaggcgagtggatcacccgtggtcaggagttcaagaccactccagccaacatggtgaaagcctgtgtctactaaaaacacaaaatattagctgggcatggtgggatgcacctgtatacccgctactccggaggatgaggcgggagaattgcttgaacctgggaggcacaggttgcagtgagccaagatcatcaagatcatgccactgcactccagcctgggtgacagagtgagactctgtctcaaaaaaaaaaaaaaaaagaaagaaagagagagagagagagagaaagaaagaaagaaaagaaagaagaaagaaagaaaagaaaagttaatggaggatgaggtctagttagtaggtttgttttatatactatgtagattcctctctggtgccttccttgggctggtagactttatagctgtttctggtgatatagaatcatcctgcccttcctgatagagggggaggataacagagagtttttctcgtgtcttcttgtgttttgttttgttttgttttgttttgttttgttttgtttaattgcctttgactcaaaatagtccttaggccagagtgacatattttggggtgacatcctctgaaccttttcaaatataaggtctgcctccttctttctacttcataacataaagtcttctttctcttccatgaatattacaattcctgcctgagtcttacaaggccctcctcttccctgtaggtcaggacacaattggtcctttgaattgaggtgtggtagtagccaagctttcaggagtgaggtttccacctttcatcttgtttctaaaagtaaatatctagtaaatgataaagctgtgtttttagttgtaagtctatggtgattgtatagcacagaatgattctaatgtattattttagcaatgaagacaagcagatttgatgcagaaatccttgacataaggagccaaaatatttatgttgcccttaggggatagatattaaatatatctacccatactaaactttttttttttaagagatggagttttgctgtgttgcccaggctggccttgaactcctggactcctcaagcaatcctcctgcctcagcctcctgagtagctgggattacaggtacatgtcactatgcccaactttcccaaattaagctttaacaaatcttctcaataatgttttcctaaattattcttgaatacagtcatgtagaacatataacaattatgaagttttaaaagtctttataattcaggaaattttgaattaataaaaacaaaggaaactttttgttttttgagacagagtctcattcggtctcccaggctggagtgcagtggcatgatctcgggttcaagggattctcctgcctcagtctcccgagtaactgggattacaggtgcttgccaggaaataaaggcaataaaaggtcattgctaattatctgctctaggtttaaaaagttcatctaaacttttcaagtatctttttttccctgaagcctacattttgttattactttagttggaaaacgactgcagtcaatgactcctcattccctcaccattctgacatgcactccagcatctctttgccattatttcagcaaagatagatataatatgctatagaagaaaaagagtagcaaccttaacttaagagttgagttcctattgtaaaataaagacattactgagactgggtttcaaacaaatatatttttaagctccactcctgtggatttttttgttttgttttgttttgtttttgtcttggtctctttgttgatcctgtcagccaatggtttctcacttgcctgtcagagctgaagagtccattccttgtcaattcagatgcgaagtggaacaaacgtcctttagtaacaaaacgaatccgaaatgaaaaaggatatgttactgctgactgtggtggttgtcaataaagatgttttcatagcaactattccttcaaaatacaatgaacatctgcaatagtcttttacccaaatgacaaattcctttcctactaaatcatgtctttacaaaattagaaggctctattttaaaccttgaattacttgacattgaaggtaatgctaattacaataaaatctcccacttacataattattaattcaaatttgcacctttttcctgaattttacctgcttagaaatccttatggtgctaatgatgaacataacgattaagaattttgttgctgaaatctctctatgcctcagtttaaccatgttaaaaattgataagataatacttaattgatagaaactgtgataataaaataacaccacaaatgtgattacaacagaacatggcaaaataaatgctagctaaatttttaaatcatggtttaaagatataatttgtgttactttaattaaataattgataaatagatttcttgccttgacattaaccttgagtattcatatttctgcaagtaggagaggaaggatgtgatgtctttccccatccgtcataagggtcatggccaacactcctataacaaaaggtaggctaacgagaaaaaagcatgacaaatatttaatcatgcttttacgtgacagagaagccttctgaaagaaggctcaaagaaccagggaaaactatccatctttatgcttagattcaatggagtggacagttgtgtagaaatgtgatcggacaaaggaagaattatctaatagtaatggactgcgtgtggaaacccataagaactgtctattctgattcttcttggcctctctgtgtggcatttcttcctcctgggtatggggcatgactccttctggaattagggtttgatgacctactatcaaataaggggaggtcagagaatgtctttatggccagctcctagatagaaaggcaggacaaggttagactaatcattctagcttttatttttggctttgaggaaaagcagatatggtttgtatgacccaccttagggaagaggaattccagtttttatggttcaccttgagggagaatgaggggcaaaagacatctgaatccttcacttcagggtatcattttctgaggctcaatatggacaagtatttataactaggtgcttaatatggccttttgagatacacagttcctatgctgcaatctcacaggcaatgaatggtctttataaaagtgtgttaaagttgaaaaaaaagcaacaaaacaaacaaaaacctgaagaaatattcctcattgaaggtccagcttacattaaaaagaaaactataataatttattctcttgagaagggttgtatagcaaaggaaaattcttgaatgttccctctgcttgccccatgcatcaattctattgatattaaagtaggcctagcaaatgtacttccattctcactgactcagtctttgtaattcaacaccaattctgaaaaatacttagaaattatttcagtaaacagctcttataagtgctacatgcataacaatatttcaatatcagagacttctatcccatgagaagatattttcaacctaaaatttattataaatgacctaacaaagaactattttttcagtaattggctattatggttcaatctgttatacccactttacactagaaactatcctatattttcttgttgcctacgtaaaagtgggcacgaaaaggttaaacagtaaacttcctgactcctgccagccaagggaagactactggtgttacctacgaagtgtcatggcattctcatttctgaataatgagggaaatctgctttcaatacaaacccccataagacagtcactcttccagacaaattaagctaaataatccatcatgacagctgagaagacaatgtgcaaaatgtcagtggaggccagggagagaaaggcagagatggactgtaagagctgcagcatgatgcaaatactgagaaaagacattctctgttaatacagctcttaattgtaggcattttttacagaacatattgagagtgaagcaaagcttccttagcagtactctgatgtcttctcagcaggataatgtagggtaattcacagtgaaggcaaggggttaggaaagtcacagccctaaaaatcaatgggctgcttacagggaagaaggtgcaacagatcttggagagcacagaaaagaagagatgagcagcctgtattgaacagaaaccaaaatattagttagatatatccagcaaagccattccacaagttcgttagtgagtaggtgccaaaagccaactgtaaatcctagatacttgtacatatgcatgcttatattacttatattttaagcagtcatatcctcaagctatattatgagttcagtcattctaaaaagatgcttccattgtcttcttggcacttactcagaatcttcagttatcttattcatactgtgtgcttactggttgtcttaacaggtgagggcaggggccctgtcttattcacctccatatctccaggatatagaatagtgcttggcacacagcaggaactcaataaatattcatactattttgagtcccttaatcctcatatcaactacaggatttagattttattgttatctccattttacagatgaggaaaatgaggaacagagaaattaagtaatttgcccaagctatgcatgaataagtggcagagtcaggatttgaagccaggcagtcaatccctagaatttacactccaacaactactgcctctagtggttatgtatgtatttatacacgtatatatttgcagaaataattgaaacttatttctgcctaggtgcatgatatattaaagcatcactaaatccttctgaatataattcaaacttcttcctaccatagacaaagtaatggcctatagtgaacataatgattatcccatcatacaccttgtactgtattagttttctttgcaatctcaattacacttgcatttttattatcatggttttataaaactttatgactggaaagtaccgtattcataaagagttgtgcctcatatatgttagacatatatgcatttttattagtaattataacttttatgcagccagatagccccaggtttatgattccacatcttttgtgttgtgtcatcttttgtagctagttgatattgtaatgtttgctgacttaattcattcagttattaatttctataaactagaatttaggggacatttcaatggactatggagagaaaataactgaaaattggaaattaagagcatctgagaaaattcaagttgtttgtacatcctggacataaatctcaggaaaactgacatattttccttccttgtcaagtcatacaaccaatgctatcactaaaactggtctaacatttaaacattcagacaatcagtttagtcaatgcttcaataagtttactgaactagcagtttcttaccaactagttacagaacagtcacagctgaaaatgatctatacattgtattataaatgggattaattattctgccagacaaccccaggtgtgccaaataacccaaccccttcctccaagacactcattgagaaactagacagcatctgagcattgtaggaacaaacactgaagtaaatggattctaaatccctttgagttctaaaatgctgtagagatctgagaagcccacaaccttataacagcaggcaacatagattacgcttaaaaagcaacatactttcaattgattgataaacccttttgttgttcatttattgcaaataggttttagagctcaattcacacttttgtgaataaacattgaaaatatttgattcaatggttatatttctgcctgacatgaggaaattatagaatctattaaccttaacaatttaattagcatgtcccagacttaatcactcactatctgggtagaattggcccaattagttaaccactctaaaccacagtttcctcatctgtaaaatgggatggaaaataataacaactcatagggttgttaagaggaatacataaattattcatgtgccctgtatggcacacaataagtccttattaaatgaaccggttgtagaactgtattaagaacaagtagtagtagcttccatatttagagagccatcaattctgttttccaacagctccattagtgagaattgtgctgtgtgttttccccccaccccgccccactacaactgcattgctatatgcaaggatataacttctgtctctaaaactattcaaatagtgagcctgggaaaaacaaacttaggtcaaaagagtttgactaaactggctgagaacatttaagttggataaaaatagatgtattttgtttgtataaatagattttggtcatgagaaagaaataaagaggttcctctcaaaagaaagcctggtttagcagtcagtaaacattgggaagagtcagcagttgacttccccactgtgtggaagaaactgccaaaagcccatccagaattaggtgtgtgggagggaagaacaaaggagaggcaaacaagaagctgtcactattcaccactttcaccttgaataacctttaattgaaaaataaagttgccaaaacaaggagtaaaagaaaaactaccattttattccctccttgagattgaattagagggaaacatactgaccacagtaatcccaaggttggactcacatgatggcaaatgtcacttagttctaaagctctaattagaaacagggctgaagttttagccagctcctgctactagaaataaaacatgaggcaacagcaacccaagccctggacaccccctgacagtgaactctgaggtgctttctgagtgagttgagtataaagctgacagagcctagagaattcatacttgagcaaatattgggaaagaataaactgggtcagttaccacctgtttctagattttatttttttctagacttcaactaagattgtctttcacattaataagaagaacgatgaacataatctatttcatccaacttctacattccaggcacagtatcaaccactttattacattttatcttctgtaatattcacagtgttattgggtagattaaacaacttgcccaagttcacacaactggtgactggcagaaatgggatttgaacttatttgatgccagaggaggtgtatcctttaatattttagaataacttatttatttcattatattttatgaaccttgaaatatgtttattgtaaaaaaaaaacgcagaaaatacagacaggctaagtaaaatgtgtctttacattaaagtatttaatttgcaaaagaacagttgttattttaaaatcctaccccacagtttttcatatttctctttctatgtagggttaatctcatcaggaatttctcttatccatccacagtttgtaggacaattctttgcacataatgggcactcaaatgtacgcagatcatattagtccaagaaaaagctgcttgttggggctaccaagccagcatggtaacaccttacaatcaccctttctacctgcagtcacattgttcccagagtggggtggtgatacttgccagctagcccaagtttctggatatagacctttaacaacttcacaagtacccttagaaaattcggttaagaccgaacatggacatgcttgctccatttttttccactctcaaaatatccttgagcagtaactcattcatagataagaaaaactttttctcttcagttttttcttttctttttgaatattctttgattttagcagaaataggcacagtaaaagaataaatataagagacgaagaataaaatttatgaaatttagaaagctcatgttagagaattgtactctttaggtagatccttatttaaagaataattagaggaaagaaaacaaaagatgaaagagtacaaatgagattcctgagcagttttttattttgattgataaacttttaaaatgtgtttgaattacaatatttatatatcaggaatatgaaaggtttaatcataaaaattacataatatttcttccaacattttcatcttgtccatttcttcatatctatagtggagaattatccctctgtaggcaagaagaagtctttattctcttcggaagctgctcctcttgcactccaaaatatagttctgatggaagctgccaatcactttatcccattcccagaacaggcatggtaccagactgaggtcaatcctatactccaccttatttgccatggaaaatagcctagcgatacttgcatgactcagggcagttggagtagtttgatggaattttttaaaccacagctgacaggaagtagctctgttccttattagttgcaaatgctgcaagcatatgaccctagagttatctgttgccagttgttgccttgtggagatcataggcttaagatgatgaaggcagcaatcagcaataagcagaggtgtgcttgtgtgtgtgtgtgtgtgtgtgtgtgtgtgtgtgtcagaatgagagagagagaaaaattactgcttctgaaaccaaatccatttccaaggtgtggttttagaagcaaataaattgccaatttcagagctgattcaagttgaatttttgtcctgtaaccaaaagagtcctgactaacagccaaaactcaggctgtcaagtaaacataatctgtaagaatccgctttccagcctccattccccttgacatcttcctgaaagaagatttgtataggaaatgctgacgtctctttggcaactgcataaaaattattgtattcaacaaatttattatatgtctctttgtggccaggcagcttgcttggcactggaaattggctagggagattggggcaagaaaaatacctctctccatggtggaggcatacataaaagccgattgctacacaactgcgtaagaagtgctttaatcaaagcctgaataaagtgttgtggaaactcaaaggagcaagcaaaatgcttcacatgaaagttggacattcgagtcaaagactcacaggattttcccaagcagaaaagaaaggagaggacatcatggacagaggaaatagcatggtgcaaaggcatggtatgaaaaaaatacacgacaaatttgtggaataacagaacttttgatgtgatcacagcataatgtggagttgggtaacagtgagggattaggctaaccagcttggcagaatactgactaaaaattcttaaatgctgtgctaagttgttagaattttatcttacaggttttgagaagccatctgcagctcacaactagatgagtgacacaatcagatgtgcgtatgcaagtaggtaatgaacatccatgtaaccatcaccctgagtcaataactatcccttcatgggtgaagttgggcaacttttcatatggttaacaacaattggccaggcacggtggctcacacctgtaatcctaacactttgggaggccgaggtcggtggatcatttgaggtcaggagttcgaaaccagcctggccaacatggggaaaccctgtctctactaaaactacaaaaaaaaaaaaaattagctgggcatagtagcaaatgcctgtaatcccagctactcaggaggctgaggcaggagaattgcttgaacccaggaggaggcagaggttgcagtgagccgagactgcaccactgccctccagcttgggtgacagagcaagactccatctcaaaaaaaaaaaaatccttttttttattatcatcaattttctgcagaccagtccattctactatagaattcctggcatttttcttctcaatctttaaaactttttatgttttatgaatatctttgtattgggtattagtattactaacttttctggtatagtttgcaagatatttgttcccatgctatgatttgtatttatttctttgcttatgttatatttttacagtgaaaaattttaaaaattatataacaaaatatatgttatttctcttgtgtcttctagattttgagtcatattaagcaatgtttccccattttcagaatatagaagaattcataactgctttttaaaaatacatgtacagttcctttttaaagccttgatttaaatatctgatccattgggaatttatcctggattatggtgtaagaaatggatccaattttatctttctccatatggctatccagttatctcagcaatgtttatttaactgtccatcttctacccagcaatttgagatgctacctataaagcatactaaatggtcacatgtgattgtatcttgtttctgaactttctaccttttcattagtttgtctgcctattcatgtgctaatatcaaactgtttaaataataaagtttttaatagtactttctaaagaaatctgatatagtttttccttccagctgttgtcctgaacattgcttttcttttttagagtttatctggttattcttacttgtttttaaattcctaatgaactttataatcaatttgtttaactctagaaaaaagcctggagacattgaactaagatcaaatttaatgtattaaatatggtagaaagaagagagaatgaaaaataatgttaacaatctaggtgaggaattgctgaggagacaaattaagtaaatcctgtggaaggaaagaagaaaggaggaaagaggattggatggaagaatctccacttctcagtgtagtccttccttagcctgctttttaatgagtgctgctaaagcccttagcctgcctgtttacccttggagtggagcaatgaactgaagatatttgagtgagttcaagagagactcagaagagaagaattggaggcagcaaacatagacagcacttttaatgcttttctcatatgctgtaagacatgaaagcaatctattgggatgaaagctgaaaggagaagcgggacaagagaagaagagaagcaagaaaccaaatactgggggatatattgcacaagtataacttcaagaaacccaagccagtgcaaacaattcaaaaaataatggaacccgaagacagc

SEQ ID NO: 2501 - DNA, 3810 bp, Homo sapiens
ggcccagcagggtcttggctggcggccccattagccacggcccaggaccccagggtgggagagtgaacggaaaggtactcgtgcctggagcggttgcaacatcctctgtaatgaggaagatacagctcagaggcactgggtcgaaggacccctctccccagccctcctttcaggtgtcggggcctaaagggggtccagttccagtgcggaaggctgggaactaggaagcgtcgcggaccagacagcccgccttcccggtctcccgggtgggggttcggggggcgtggtgcggcggccggggctgagaggggtcggtgcggcggctctgcctccccgggaagtgggaaccggccaagtcccgagcggggaggggcaggctttctcctgcccgcgcctggggggaccctacgcctgtgtccgaaggaggccggcgtccagcagatgctcccggggcgggtggggagtgggggaagggggcgggagagaggcggggaggagaaaacccacaacaaaacttgcgtcgcggagagcgcccagcttgacttgaatggaaggagcccgagcccgcggagcgcagctgagactgggggagcgcgttcggcctgtggggcgccgctcggcgccggggcgcagcagggaaggggaagctgtggtctgccctgctccacgaggcgccactggtgtgaaccgggagagcccctgggtggtcccgtcccctatccctcctttatatagaaaccttccacactgggaaggcagcggcgaggcaggagggctcatggtgagcaaggaggccggctgatctgcaggcgcacagcattccgagtttacagatttttacagataccaaatggaaggcgaggaggcagaacagcctgcctggtatgtgcacaggatatgtgagaccagagctccttcccctggattcttctccttggccttctgccctgattgaatttgggacctgggcctgtgcccacactctcgctcttagaaccccggactacagtggggtcagatgggcaagtggctaatggctgttgagctggccgtggagtttatgatgtgctatgggaatgatggtctgtagactgatgttgggtcaggggcaggggcagcaggggtgtggtggagtgagcgtagggctgggctgctgtgggagccagttgctgctgccgactgatccctggagcctggaagctgcaggtgtgccgggctccctgtttctctgccgggccagtggctgagacctgagtctccatcaaccatgtggatctgtagggtcaagcaagcctggctgccacccctcctgtctcctctagggcctcctactccttgggaccccttttacgctgccccctcacccccagtctgggtgggcagtggttattggtaccggggtctgttgtcccctccagatggaggacagggatcttttccacctcacctgtgtccccagtgcccagtacaggcccaggcacaaataggcccttacttcagagaactgggtgaaccaccaagtgagacaaagtggtatctgaactcccacagccaccacagggcagcaggaactcagaggcggctacgatgtctgcaacatcttctgggaggaggtgggcctgggattgggtcagaaagcccaaacgaaggtccaggccaagtgactcatgcctgtaatctcagcactttgggaggcaaagatgtgaggatcacttgaggtcaggagtttgagaccacccgggcaacatagagagaccccatctttacacaaaatttaaaaatttggctggcacggttgtgaccccctatagtcccagttgcttgagaggctgaggctggaggatcacttcagccccggagctcaaggttacagtgagctatgattgcaccactgcactccagcctgggtgacagagtgaggccttgtcttaaaaaaaaaaaaaaaaaaaagcccagcaagatctacaagatctagacaagggaaggaaaaggagcagcagcagaggattctggagtgagcagtggtgtggcaggggtgcagaccatgcccatggaacagacaattagtggcaggaaaagctaacgtttactgagcacttactatgtgcagtacatgcatttcactgacccctctcagtcttcccataaggacagtgctgttatcatccccaaggatgggggagaaagctgaggtttagatgattgtagtcacataagagccagagctgaggccagagccaaggttgcagctcaggccgctagctccagtcattaacatcattgtcaagctccccagtttacaaaaccctcctaggaccagggtcttgccagacccttctagctgctttatggtcatggtttctgatctggtgatggggagagaggctcagcctgagccagtgcttgtggccactcagctcaggagtgaatgtcccccgtgctggaggcatccacagcaggtccttgccgctgtccctgctgctcacttagtgcagcatgttgctgtgtgtcattgctgcagtggtgacagcagctcatcacctaattgcatcaccttatcacctcatcacctaaaagccaggtgctttgcatcttatcttactccacagaagctgtgtgtttagatgtattatctgcattgtacagacaacgaaactgaggctcagcaaggtcagaggtgggactcaaactgggatttgtgggacctgagagtcagtgaacctgagctaccagcatgtcttatcagagcccagagatgtctgagtccctgtaaacagaaaccaggaacccaccaagagccaagcctacgccacgggactgctgggacaatggcatctttcagcatcttcctctatgggcctgagatcatcccctgtaccccatccttgctggacccggggccatgccagggagtggtctctggcaggtggcagtggtcactgagcacatcaggccctggtgagggcagctgaggggatacacatcaggaatgggaggccatgagggcagcagcagctgtagtcgctgatcctttctctgtgctgggctctgggcttgacctatacccagacacagagagttgctcacagctctctgtgggaagaagatacctttgctattcaaaacccaacccaactaatgctaagctctgggtgaacacagtcatggggagccctggggcatctcagtgtcccgctgctccccctcttcccatgttcatagcactggaattggttcccagaaaagaaaatgctgattgcacaagacagaggaagggcactctaggcagaaggaacagcatgtgcaaaggcctggagggaggagctattcaatagtcctgtagaactgggggcagttgaggggacagttggaagagagtcaggaccaagtcaggaaggcctgagaatggcgagctggagagccgggacgcaccctgccagtgctggctcaccatggcctgtggctgctggaggaggcagggggtcttcccacaccgccagtgccaggatagcaagggttcagcacagtccaggtcgtgtctcagcttccccttctaggaaataggggtacagactccttagggccaagcctgctgaatgaaggctgcagaaggttttgcagacctgccagaggacagggctttacctcgtcccccgcctctggagggcagcctggtgggggttgggcaggtgcggagggcagcagtcagtcatcggctgggctctgaggacagtccagagtgggccctgctttgtgctcgggagggccccgtcatgactttcgagggccccagctgtgtccactgtacct

SEQ ID NO: 2502 - DNA, 3942 bp, Homo sapiens
gtcctgttaccccacccatacctgtctgctgcgcactctgtgcttctgtagcattctcgcttctggcctttaaagttggcaaggggaggttaataagcacctaggtggctgagtgtctctgtcttctggcttgttcacaggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattacgggtgcgtgccaccatgcctggctaatttttgtgtttttagtagagacagggtttcaccatgttggtcgggctggtctcaaactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagtagacaaatgaagaaaaacaacaatttgcattaaaaaatatccaattctttagcttttccagcttattaccccttctctggtactagctatgaaaatctgatatgaaac

SEQ ID NO: 2503 - DNA, 2229 bp, Homo sapiens
ctttcaggagtggggatggatttgcatcttccctttggcaggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtacactggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagccggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaaccccccggcctctgccctggcatggtctccgcatgggctgaggtgtagctgattggctgccacatttcggccatgctggctggcgtgcccatgttgcagatattttcccgagttccccagaatggatggtattgaatctcagccacatgcaacactgtgtccagcattctttgcaataaatactttttaaaaaataa

SEQ ID NO: 2504 - DNA, 26315 bp, Homo sapiens
gatgggtttcctgaatacagcacactgatgggtcttgactctttatccaatttgccagtctctgtcttttaattggagcatttagtccgtttacatttaaaattaatatttttatgtgtgaatttgatcctgtcattatgatgttagctggttattttgctcgttagttgatgcagtgtctttgtagcttcgacagtctttacaatttggtgtgattttgcagtggctgataccggtttttcctttccatgtttagtgcttccttcaggagctcttttagggcaggcctggtggtgacaaaatctctcagcatttgcttgtctgtaaagtgttttatttctccttcacttatgaagcttagtttgggtggatatgaaattctgggttgaaaattcttttctttaagaatgttgaatattggctcccactctcttctggcttgtagagtttctgctgacaggtccgctgttagtctgatgggcttccctttgtggctaatctgacctttctctctggctgtccttaacattttttccttcatttcaattttggtgaatctgacaattatgtgtcttggagttgctctttttgaggagtatctttgtggcgttctctgtatttcctgaatctgaatgttggcctgccttacttgattggggaagttctcctggataatatcctgcagagtgttttccaacttggttccattctccccgtcactttcaggtacaccaatcagacgtagatttggccttttcacatagtcccatatttcttggaggcttttttcatttctttttattcttttttctctaaacttcccttctcgcttcatttcattcatttcatcttccatcactgataccctttcttccagttgattgcattggttcctgaggcttctgcattcttcacgtagttctggagccttggctttcagctgcatcagctcctttaagcagttctctgtattggttattctagttgtacattcgtctaaatttttttcaaagtttttaacttctttgcctttggtttgaatttcctcctgtagctgagagtagtttgatcatctgaagccttcttctctcaactcctgaaagtcattctctgtccagctttgtttcattgctggtgaggaactgcgttcctttggaggaggagaggccctctgctttttagagtttccagtttttctgctctgttttttctgcatctttgtggttttatcttcttttggtctttgatgatggtgttgtacatatgggtttttggtgtgtatgtcctttctgcttgttagttttccttctaacaggcaggaccctcagctgcagatctgttggagttttctagaggttcactccagaccctttttgcctgggtatcagcagcgatggctgcagaacagctgatttttgtgaaccgcgaatgctactgtctgatcgttcttctggaaattttgtctcagaggagtacccggctgtgtgaggtgtcagtctgcccctactggggggtgcctcccagttaggctgcttggggttcaggggtcaggaacccacttgaggaggcagtctgcctgttctcagatctccagctgtgtgctgggagaaccactgctctcttcaaagctgtcagacagggatatttaagtctgcagaagttactgctgtctttttgtttgtctgtgccctgcccctagaggtggagtctacagaggcaggcaggcctccttgagctttggtgggctccacccagttggagcttcccatctgctttgtttacctaagcaagcctgggcaatggcaggcgcccctcccccagcctcgctgccaccttgcagtttgatctcagactgctgtgctagcaatcagcgaggctccatgggcgtaggaccctccgagccaggtgcaggatataatctgctggtgtgacatttttaagcctgttggaaaagcacagtattagagtgggagtgacccgactttccaggtgccatctgtcacccctttctttgacttggaaagggaagtccctgaccccttgtgcttcctgagtgaggcaatgcctcaccctgcttcagctcgcacatggtgtgctgaacccactgtcctgcgcccactgtctggcactctctagtgaggtgaactcagtacctcagatggaaatgcagaaatcacctgtcttctgcgtcactcatgctgggagctgtagtccagagctcttcctatttggccttctcagctgcccgcctcagctgtgtaaactttcaaacctgatccaaccaatgtttgggccctatgtaaaccagccacctgctcctgaagccagtgtgtaaaatccattgcgcttcactgcaggctggaagtcccactgagaggcactgctctttctcagaagagaagactattctcctttctctttcttttgcctattaaaccactgctcctaaaccatcttcttgtgtgtccatgcactgatttccttggcattagatgacgaacctcgggtctttaccccacacaggtgatgccacttcagtatgttaaaactcattaatttattagttaaaattgctttattaataaatatagcactttttttttttgagacggagtctcactctgtcacccaggctggagtgcagtgacgtgatctcagcttactgcaacctccacctccctggttcaagcgattctactgtctcggcctcctgagtagctgggagtacaggcgtgtgccgccacgtccggctaatgttttctatttttagtagagacagggtttcatcgtgttagccaggatggtcttgatctcctgaccttgtaatccacctgacttgacctcccaaagtgctgggattgcaggcgggagacaccacgcatggcaaaatatagcacattttaaagaccactgatgcacagtgcaaaaactgccatatatgaatatgacatcaaattatacttccagtaacagtgttaggaaaggtcttgttaccctacactaactatttatgaatagtttaatggaatatgctgttttaaaaaatattttccattttggtatgtgaaaaaatggcatctcattatttatttatttatttatttatttatttatttatttatttatttttgagatagagtctcgctctgttggccaggctggagtgcagtggcatgatcttggctcactgaaacctctgtctcccgggctcaagcaattctcctgtctcagcatccctagtagctgtgattataggtgtgtgccaccacgcctggccaatttttgtatttctagtagagacaggtttacatcattttggccagggtagtctcaaattcctgaccttggcctcccaaagtactgggattacaggtatgagccaccgcgcttggtgacatctcattattttaatatgaattttagtaactattaggtaacttgtttttatatatgtttagtgtactactttttgaattgcctagtcatggcttctgcttattttgctattaaattatttaactttttactgatttatataagcttttgctatccacattatagtaataagttgtctaaaattattttacatgtatcttcattcagctcccagagtccatcttcaatgcttttgatagaaaaggagttcctcccttctaaagatgtctactcttagtttaaatatgtaccaattagtaatacacaattagggaagtttaaacactgtctaattaaatttgatttggggaaaataaatgttctcacctttccatttttatttaaccatgtgtaagaaggcagcctatacattctggggtaaaaagtctctttttaaaaagagaaaatgtattctatcaaagagggtaccaaattccaagtttgcactgcactttgctgaacaccttgtattttttcaagcttaaactttctaaaaggttagcagtattctctgtgaaacacagagctgctcacattgcagccctgctccaaaacatttggtggttcataacagcctgcaaagctgagcccccatccatgtttctaaggccaacatctcttaacatcccaaatctatacgacactcccaaagtatattcttttgtcaaactccacttcttgtcctaccctgtccttaaataagcctcatatttttatacttcatgtcctgtacttaaactgcttttttgcctagatgtacatttttcttttcccacattcttcttctccacatggaaaacgtgcacatttgtgagtatcacctttactctctactgcaacttctcacttgccagttctccacttgttcttgctggttgtaaggcactgatgaattttagaactggaaccatattatatccatctttgcagttctagagcctggtatcaggtgtaggtgtcaagaaatggttcccaatggaagcttgctgatagtgatcttcaacagatgagacaagaaaggagccagaatgctgatttactaatccagattactttccactattgttttgctgaaactctccaatgtcatgagaaaaataacaatgataataataatactagtagcaaatacagaagataagtcagttaaaattgagctggtagcatgcataacttcaattctgtatttattactggtttcaaaatattccttatccacaaattggaagaaacaggaaacagaccctcaagtgtctttcacaatgcaagacctgccaatttcataacttgctcagccaccctcataaaagaaactaggcacactggtgaccccatctcacacacactcaaaggagacagaaggtcttcctctcactgtcctccagtacatgtggctcctccttcttaaaaagcaaaacaacaaagaaataatacctcccagagggtatgacacttgaacttggacaagtgtttttttttttgttgtttttttttaagatggaatctcgctctgttgcccaggctggagtgcagtggtgggatcttggctcactgcaaggttcgcccacgccaattctcctgccttagcctcccgagtagctgggactacaggcgcctgccataacgcctggctaattttttagtatttttagtagagaccaggtttcaccgtgttagccaggatggtctcgatctcctgacctcgtgatccacctgcctcagcctcccaaagtgctgggattacagacgtgagccactgtgcccggcctgatcttcaagtttttagattcgattagtaatcaagtcaattcaatttttgcccttacttggctcatatcacatattatggacctcttaggatcactctatgcaaattctgaggcaaaaccttgagtttccatattatgtaaaataacagtaacctgttatgaaacaacagtagagctgttcttaaggcattgaccctgcccaaagcacaacttaatttcccaaacagttatgagtttagtttcaaaatctcttcaaaaataggcttcatatgagtctttgaacagggctcagcactttcagtgaggttaaaagtgggtgtccacaaggaaggtttcaagagataagaaagccccccattaatcaccacacagaggactagcagaatcatagagtccatgcccaccctttttcacttctagaatatctcccaccatgtgaaaaaccacctctcttccacatgctatccttttcaatgagaacatggtaaacatttcatcctcagcaggatttgttcagggtttcactctactttcccactgggtctcagtctgccagctttctgctttagtgtctttttgaactccccctctttaagggcacagaaatcctcatcagtcagttcatctactaatatgacctctgcaagcccctcactctacaaaacaccattcctgaccatcacagaagggaaggtctaacttatgtggtcaaatattagctaaaatgtgttgttcaataggtaagctgtaatttaattctggaaaccagacccctgtcctggcacacttacactttttccttggtgtgccaatcttttcccttgatgtgcctaatagggaggactctgaacacaggaggttttcagttagtatttgtttggtgaatggatcatgtctctatggtaggtagtctggcatgggtcaggagcacagccctggagacaaacttaatagtttgagttctaatagctggctgcctctctgggtctttatatcctcatctgaatcctgaggataataattacatctacacctctctgtcgaagaattgtgatgaatgaaaaagatgatgcataaagaaaaattaggatgctggtagctagctctcagtaattgttagatctgatgacatttgctcctactgctatcaagctgagtgtgtttctatgtataaaagctaacaaccaacaagctgagtgtgtttctatgtataaaaactaacaaccaacaaagggtgaaaattaaagtaaaacttgattgttaacttgtcagactggagtcctatggattaacaggtctagcacaggtagaagagaaagaaatacttaacttctggtttatttgatttaatgcaaatacaggaaaacctggataagaaatgcttttcaccaaagtttgtctgcaacttgaatgctgtaggttaaactaatttaaaagtactctagacagattcatttgtaatataagcatgtcatagtttctggtgtttaggactggatttatgtttatttagttttctgaagagacacaagagacagcccaagctgctatcggaattcctagagacaagttgggcaaatgagcccttacaaaattccatttatggtaaagataataatgaaataaataattactgagaccagctccatcagcgagaccctaacccagcagtgctagaggaattaaagacacactcacagaaggtgtgaagtgggaaatcggggtctcacagccttcagagctgagagcctcgaacagagatttacccacatatttattaacagcaagccaatcattagcattgtttctatagatattagattaactaaaagtatcccttatgagaaatgaagggatgggtcaaaataaagagatgggttgggctacgtatctgcagcaggagcatgtccttaaggcacagattgctcatgctgttgtttgtgggttttttttttaagagacagaaaaattttattaatgagtatgcatacaaataaacctagacaaccatgaagagtccctcacagtttcatgtattcacaatattatttcatctctaaagccatcagtgaacgactagttctgctacttgttaaagttgtgcaaaaattctcaatttaaacatacagtcttaattataccagtgttctaatgtcccaagactgattgtaggtaatggaatctcaacaatatcttaaataataatttaaaaaactcaatatgatctacaagactaatatatttaaaggaaaataattcacattcactaaattcctcccctttcttccttcttccctattctccctttcacttgccaatttttttctacagtatatgatgatggccaaattacccaatatcaactgtttcaaaaaagaaatgttattttagaagataccatacagcaagagacttataggtgtaacaccactgaaattatttactaagccctggccgggcatggtggcttacacctgcaattccaatactttgggaggttgagcaggcagatcacttgaggtcaggagttcaagaccaccctgggcaacatggtggaaccctgtctctactaaaaatacaaaaattaagtggacatggtggctatcccagctactcaggaggctgaggcaggagaactgcttgagcccgggaggcggaggttgcagtgagccaagattgtgccactacattctagcctggatgacagaaccagactctgtctcaaaagaaaaaaaaattatttaccaagctgtgttttcatagtgttttttaattctctgaactgcttcagtatctgcagtgttttttttacatttcaaagacttcccacatgtaacatttcattggaattaccactttacatcatagttgatatggaaattattacatctaacagatgaagaaaatgtagacataaagaaccattcgctctaatgtcatccagtgtaactgctaagagttaggattagactcaagtcctattcctaatcctgtatactaccctaaactcctaagcccccatacattgtacttcacagaatgctactagtgactgtgctcatgcattcaaacaagttttggaaatgttgtgttaagcaaagctaaccagattcccagagtctttattatgcatcataaatccccaggaaagatccagagtatagagcaggtgccataaagttaaaagtcccacaagtttcaagcaggtaacaaaggtgagcatgcaagggaaagtaaggacttggggattagaggatgcatccccatctagtggaagcctggtcacatagcaatccagcccaatcttgctgggtctttccagagaagctataaatcttggctttaatttcaaatctccagttttgtgcgtattgcctcaaatttaagaaaaaaaggcactatagtttaaaacaaataaaatttttgaccagatcgggccagccacatttgggaaaactgaaataccatgtatcataatctcatttgcccacagaattttccttcaaaggacttatacatttcctagaatgataacggtgttaaaaaatgttgcctctggctgggcgcagtggctcatgcctgtaatcccaacacttttgggaggtcaaggcaggtggctttcctgaggtcaggagttggagaccagcctggccaacatggtgaaaccccatctccactaaaaataaaaaataagctgggtgtggtggtgggcatctgtaatcccagctactcaggaggctgaggcaggagaatcacttgaacccgggaggcggaggttgcagtgagccaagattgtgccattgcatttcagcctgacaagagcaaaactacatctcaaaaaaacagaaatgaaaacaaacgttttcctctgaaagcaagcatcctgttaccccagacaactatggtatgggtagctctgaacctcaaccatgaattatttcagagttttttcaaactgaaattgaaattaatgcccagccttaactgttcatgtagaaatatttcttttctgacaaatctagctcttgcaaatctatgcttagtagagacggggtttctccatgttggtcaggctgttctcaaactcctgacctctagtgatccacccgcctcagccttccaaagtgctgggattagagcataagccaccatgcctggctggcaaatatatacttctaaacaattatgctgctttagtataattgttttttatatatttttgtactgattaaagatatccttacaataagtctaattgaattataaaaaaaaaattacaggaattgactagatatgagaaggacactttgcctttccaaaacaattttatctttctttttttttcttaaaattttttcttaatagagatggggtcttgccaagttgcccaggctggtctgaaatttctgggctcaagctatctgcacaccttgtcttcccaaagtgctgggattacaggcatgagtcatggcactagcctccaaatcaattttaaacataaaagtggtttggagacgatttagaatttgggtcaaaactagtgagtttcaaacacttatatctgcaatgtaacttataagtcagaaaaggcagccttttccctaccgcagcctttttttttctctcttttatttctgaccttcttggttctaaaaatttgttcagaaatcctgatggttgtttaaatgcttagcaccatgacacacatgtaatacaaattgcataaatggacggggcgtggtggctcatgcctgtgatcccagtaccctggaaggccaaggcaactggatcacctgaggtcaggagttcgagatcattctgtccaacatggtgaaaccctgtatctaccaaaaaaatacaaaaaattagctgagcatagtggcagacacctgtaatcccagctcgtgaggctgaggcaggagaatcgcttgaacccgggaggtggaggttacagtgagatgagatttcaccattgcaatccagcctgggcaacaagagcaaagctccatctcaaaaaaaaaaataatgtataaatatgttgaatcacctggcaaatgattttcttcccctggtgtctatgtgttccatactattgtagcctcttttaactggtaaaataactaccccaattcagagatccagtacttaatgcatcacatttccagagtcgtgagaaaacagctaaacctgttagagtgaattatactcactttgtttccccatagaggaaataaaacccacgattagaaacctttggaaaacataggaaatgcaacatttggaagtatatagaaacaagagataatcatgcaatgcttccaaatgaagtctcacattggatttgctgattttggagacagattcccctcttctggacagctttgatggccaagatagaagttcatttgctatgtttccagggactattctctttgatggatacaggatttatggggtctaaagagaacatacaattctaaagtgttcatgtttgagagaaaactctgcaatgatcagaaggattgagccagttttagcaaaacaaattaggactacattaatgatgaggttgactatacacagtttggagtgggagagttactctacccagtatcactgacatgttggaatgccagatgaaactgaaacagaaaaattgtcttggagtctaaaagacatctgatgtgctgatacctgttcagtcttctgcagtcatgggcgtaaactctcaaagagcaccactgggtcttagtccgtggcataaacattattctcaatgtagatattgtcttctgcttggacttcctttttaactgcattttgcaaagctttagtttgaagactgctaaatgaaacacttagttgttgagtctcctctttgaagaaatactttttggcaatgatgacacccaaaagagcaagaagcaccaagacagaaatacagactccagcacagattcctttagtggtgttgaccatctgtggactatatgctggggacagttgagtttgattgttattccaaaggccatctgaagactctgtcatggtgtcattcccatctgttgtgaaagagtgcaatggtgagctggtgggttgtgtccttatttctccctgaagtgtcatagggtgggtttctgctggctgaggtgaagatggtgaagtggctactgattgatggttctgcgtgggcaatggcgttggaggaacaaaggtagagaccattgttgtcattggaacacttgttttcattgaaatgctcgttgttgttggaacagtctttgtcgttggaacagttgttgtcgttggaacgcttgttgtcattggaacagtgatgctcgttcaaacagtagtggcggttggaacagttgtgacaattggtgtagtcgtgaccctgggtggcacaatctccaatgatagagtgattttcatgtcattgaaccacccactgtgctcaacatggcaacaatataagccactgtcagacacagctgtattttctatagtcaaagggacatcccttcttgaaaggtcccccaataccttatagtgtgtgtccttccgataggtgacgtgggttccattggtccagacaatgctatttcagcatgtgaataaagaacgtgcgcctctattccagcacatggatgtgacagctccattgtagtggcagggtagcgtgatagacggacctgccattccaccaacctttacagaaccagctacagaatctgccagatgtaggatgaggcttaagatggccacttcaggatacattatgggatcagccagttagttagaaggcagttttccagcttcttctccctcctcctagtctctgtttgtggacggctttaaatggttttccaccctgggtgggccaggtgttccttgccctcattctggtaaatgcacaacctcccagcatgggcattatggccatcatgtacatgtcacagtgctgcaaagattttgtttatggccagttttggggccagtttatggccagattttgggaggcctgttcccaacaaataataatctctgaacataagaatttgactagtgttaatcactccacttctccagtacactgatacttctccctttttcttagcataacacaaaacagatacatgactacacaccatctgctctccagtgcggaacagaggaacaaaggcataagcaagcttcagaacacagtcagccatgttcaccacatctatatctagcactgcttaaaacaaagtcaatgagaaactgagaagatgagtgactaccctattttcagcacttattgtcacaagaaaagaaaacatgcccacacactgtctccttctaaggcacagcatccactttcctgaggaaaaagtaactttacagcatatatctcaatctcacattattagcaagatgacactggctttgagcacacaaagaacaggcatattatagacactcttaagacacatcacatggcctggcttacctgatacaatttttaatttctctgaagtaaactcaaatttcaaacatgtatttctttattaacttatttcattaatttccacagggacttcacagaaagtatattcaactttcattcacttaatcttaccacaatagatggtgtaacatatccagaagacagccatatgtaagacatgctcataccccaaagcatagaaaacttaacacaacagggccttgaggaagcaacactataacagtgcaaatatacaaatatttaagaaaacctacatcacccaacaaagagcatgtatggtcaccactacccagcactctccaaaataagtagctatgaatagcttattcaaatttggcttatatatacttgtcaccacaaattggttctgaacatactgttccaattttggatattcacaacaagggtaattatctggtaagatatatttataataacttgtaattagattcctaaatgcacacatatacttgtgtcacagtgaggtgaaaaaaactctgagttatttgtagagtaccttaagatttaaatttccaaaaaacattcttaagcttagttttacaagtattccacccagcatctcttcagcaagctatttcaattttaaaaagtgaggactagggagggcttttaaaagttttatttctttctgttcagtttatcttatcccatacagaaatggaataaagtgtgatgtctgtcctaatgatatttatggttgtggtaatacagaaatatctatgcttccaagcaagaaatgaaaaattatggtttccccaaaatagagaaaccagtgctacctggggcccaaagagatgttcaggttacatctgtcagaattgataccatgcaagacaaccatctttggagaacagtggggctcacctgagattttggtgagtcatgtggatgacatcagagacaagcattacacaaaatgagcatcccaataagactttcatgtgagattgtcttagaagatggtggcccaactcacacagaagaggacggctgtgcatccaagagagactgatattttttctcaggagcagaaatcttaatgtaggagatggccactcactgagtagttgaggaatgccctgatggaactctctgggggtcagatttcacactgtctccctgagttgcataaagcacagaacagcatgcctgcactccagcttctagcatgtaccaactcagcagaaaacacatcactgtctattttgtttcaaaaatgctttgccatttaaaaaaagttaattaatatagtagaaacccaagaactacctaggggtagggagcatgtctgtcatcagaagtttttaaatgctggctagacaaacactctgtggaaataaatttcactctttgtgagaggggtaaaataaatctttttcttgggcactgacagatctagccaagatcctagtatacagcagataaacagcaacttctgtttactaaactttattttcacagattactggtgaagcaaaatattgatataactctaagacatgaagggtatcacaagaccactcatgttctttatgtggtttcaattaagaaatgaggtgaaaaatctggccatgaaatgagttttgatgctcctaagtagcatcagaactgctctgatgtgcttaagccattgtgacagtcctagctttgttcctacccaaagtctcttctcatgaatcctaggcttactggtcaaacagataaagcatccgtaaatcaaacacaaacttcaacgctcttaacatgtaggtgtacatctcatctgaaaatcattcaaaagctcaagccatctacaagaaatctttcctttgcattttagtatcaataaaaggaaagaaggaaaagaataggagaaagccatttaataattttcataggtaaaaatgtaacattggtttctcagttacataagtacttttcttgcttcatccatgacatacataatttttaaccaactaaaacacattacaagtagagaaatagctaaaatcatggaaagcatacacataactcttcaaagagtaggaaacattccctgttcatatgcattgcttaatccagcattccaatctcactgaggcaccagcatccacgctgttctctgaagcattctttttcctcctgtcacccatccttcagatattagctcaaatatcacttccatgggtcaccttccttaacctgcatcccggcatcctccattcctctcccatacaaaaaggccaaactttatgttggggtgatcagacccaacaccacatcgttggggtgacaaagtccgggggagtcaaaggattgagaaaaagacagagagaaaaaagtgggacaccagggggccatcattatcatggaggctgcaaaggcactgagctctgggagcccatggtattttttggtaatccagcaaagaaacaggtggtgagaatgtgggggtcaaaagagcaggcacatgatctacagctgtgacggtttagcatttatatggaacatgttctgctacttgagataatgggaataggggcctaggaaggctagaaacaaggagccagcaagtctagacacattccagaggacattatgcaagccctgtctcagtttccctcccaacacagctttttcccaacatgcccccttatcttttttgtaaaagagaaggtatcattattactagctatcattattactagcataaaaagtgccctcttttaattgagcaaggcgattgcaggctttgcagcccttaattgatggtgggtgatccagctttatttttcttagcctttattcaaactggagtcgctctggtttgaatgcttgccatatagctcccctttcccttttacataaggaccttaaccctaggggttgcagaaggatgaaggtccatcttctgtaacttcatgctgaatagaggtgatgatattcctgcctaactattagcatttcttgtattcacgacagagaggagctgagtcagaaagcattggtccattaagcgtcatgactctggtcggtcctcgttccatcttctcattcagattcgattgtctcatggctcatactggggaaacccgttccatggttggtatccatgtgtccctccagtctcccattccatggtcgtacacatcttgagggtgtccacatggtttgttcatctcctgcaaaaacaaaagcataccctcacccccacgttagtaaatctactgaaacagaagcaaaaattttgtggctgtagccaggaggccactgataatgagaaacaggctttttctgattaacagaaggtatagagaaagcaaatcgagacttttcaaaccttcaattctcactgtacaggtgggtccactagatgctgtggcttatgatagatcttcagatatttggtgggcacccacataggcacctgattgtcacctggagagacacaagcaaatccccttccccataaaattatctttaggcagggatcggaggaagtagactcagaggtaaggagaattttggggcctaatggcttcctgatgtttgataggtgttcctttggaagttaggaattccctttccatattgctgtgtgggcatggaggtctagctaagcataaagtttgtacatatatttaccctttttcattctcctaattctagtgtataatggctcctgcttttgctaggatgtctctccctaacaaaggtgtggggctttcaggcataattaaaaaggcttgtgaaaagagtcaagttccccagtcacaacttagtggctgggagaagtatctagtgactgcctgttctaggaccccttggatagtgacacatctggaggacagttgtccaggacaggagaataagactgagaagtccacacaagtgtccaagagacagttagcctcctggacctcaatggccaagcatacctggggagggtgatggcgtgggctggtgcttgccctgggcaccctcattcctgctgctggataatttggttagggcttctgacgcagaggacctttgtcccctggggcagtgggccttccagtgattcccttgacataaggggcatggacaaggaggtggcttatttctattcggacaatctttttaaaagggtccttgcagaccacactggaagcaagccctattaagcatttgattttcccagcctttcccttttccagagcctccaaagtctgcttgcctgagggtcatgactaaagctatggccttttctcgttgttgttagtttgtcccattctgcctgctcctcctgatctatagtataaaaaaaaacaaaaacaaaaacactgaggttgccaagttcaatagggtttctaagttttgttccgggcctaaggcggacttttgaagttttttctaaagcctgcagctgactgagtgataaacttgtcctttaagattagttggccttcaatagagtcaggtgacagagaggtatgctttctcaatgccaccctttgtctctccagaaaggcagtggggttttattcctttccctgtgttatagtggacatcattgaatactttataggcttcttcctagttttcctcagtccttctagcatgcaagttagcaaatgtctgtggcaccaatctccatgttctgatcctgcatcccaatgaaggtctacactgggaacttcctactggcctgtggggaattgttctctttcctctgttgtcatcctatcattgacctgactgagataccagagatcaccaaactctcgggctgcagttatggtggattagtgtctgatctagctgtaacatttatatctcactatgtcagatcaaaggattgtcctaacccttgtaaaacatcatggttatctgagaatttacctaggtctattttaatttgtttcaagtctgacaggaaaaaagttacataaactctgactgggctgaattctccagaatatatcttaggggtgtttttgccttggggagaacatttcccatctgaaaaaaagaacatagagatgacagaacccctagtcactttccactgagcattagtcctagagcatcctctatgtcctaatgcttattcctttccagggtgcataatacccatggacttctgcttattggattagttatgttcaccgatgtagcagtcctgcatctgttttctcacctttcttgaccacagagaaaggggtctgggctgctggattccagtggtcctttaccagcatgcccaacattgcctttgcactcaagaggtgagttctagagctgggctgggttcctatttgataacaacccagctgccccatcaagatgcactcccataaacagttcttatgtaaattaatttcagagagggtgtaggtaaacttttgagtcaggattgagataagagttgttttattctgaaagtactttaaggattggctgagtgcaaagagctcgcacgcttgagaggactaattattagataattttcctaactgcttctacaagagtttccctattgttcccccgacccccacctcaatcacccaggaggaaccatctgtcatcctgtcctggagggagttcctcctaggtctggtcagacctttgtatggtaattaagatttaaatacctcattaggaaatctgctgggttaagggaattttcagtggttaatgttaaatcaactttttctaacagaatagccccatactttaagattgagttagtaagctacctttttgctccttttactttggatagctctgaactggtgagatgtgctcacaatgaagtttcttctaaaagttatttttctcttttcttctgttagcaaagcagtggctgctaccgatggaatacatttgggccatctacaggttactggggttaaggattttgataagaaggctactggttgtcagtggtcttagtgcttttaggcaatgcccttgtttacactgacaacaatatagtattggagtgttatagggtcacggagaagaccattagttatcaattataggttttaaatttatcctggcttttaaaggaataagttacactgttttttctttaactacttacatctctctttctcctttgtagatggattttggaaacacagcggaaggacatttgcggtcctccctgctggattaaagttacaggaaattgccatgcttcaaggtcttcatctactctagccttttgaatataattttatatagcaccaccaattgctccaggttttaatgttgcaactacaggagcagtaagtctcatagctaattcatcttctcacccattaaggggagagagaggaggtggccttcacttaattgatcaggtggagccaatgggctagtaaaacatacttttttcagtttccctttcttttaatttctgtttcctgttcctcacattcagaatctgaagttagtttttacactcgtcctcctcttctttatctgaatctgcttcatcatgtgtttgaaatacctcaagagctgcttttattagcacccacattgaacaaaccaagactggaatttttgctccatctttatacactttttaaaaatctctgctaattctctcccattcctccaaagccatagtcccttgttccgggaactatggacaaaactgctttattgcactaaaaagtgagtgataacaaattctgagtactaactttcactccccctcttcgtaataagtgctttaagaaatttaaataagcagaatgctttcacgttgtcccatttttttaccctggttcttccaagccctcaactttcccgccgacgttcttttaaacgtcctcgggttacctttggcgatgcgtcctctgctttcacatgctctagtgttccttcaccggggtctttgtcaccccacattgggcgaccaggaatgttggggtgatcagacccaacaccaggtcatgggagtgacaaagtccagcagagtcaaaggactgagaaaaagactttgagagcgaaaaaggtgggacaccagggggccatcgctaattgaggaggctgcgaaggccctgagctctgggaacccaccgattttattggtaatccaacaaagaaacaggtggtgagaacgtggaggtcaaaagggtgggcccattatctacagttgtgacggtttagcatttatatgtaacatgttctactacttgagataatgggaatggagcctaggaaggctagaagcaaggagccagcaagtctagtcacatttcagaggactttatgcaagtcctgcctcagtttgcctcccaacactcagctttttcccaacaactttacttcttacaacaacttatcatgggaatggtaaatttggtggtgaaaaactgtctcttttctaaaagaaggctaaatctgaatcagaattgtacttaggaaaattaagttgtgaaactttaagaagcttttgaacacaaaatggttcttagaaaacttattttcataatttaaatacacatcaaattcagagaaacacaagttaagcatcctttaagttactcttggtttaaaacttttaagtagaatattttaaccacatacatattcatttaactaaacaaggaggagggcaggacaaaggtcagaccagtggcactgtatggctaaaagatcacacctttcattatactagacagtttttgtctgaggcctggggtcccagaacataaaaatgatcactgtctcctttattgcttccctgtattatccccatccttctcagccagggcagctgactgacatccaccttctcaagaggacatgcaaggacagaagacgtggctcagaaacactgctctatgaaaagggcagatagttatgtaagaattttgtaaaaacatgagtttttaatgaatgcaaaaacatgaactgtcaagcaagtaagagctgttcaaacaatttttttttttttggaggggggagacggagttttgctctcttgttgcccaggctggagtgcagtggtgtgatcttggctcactgcaacctcttcctcctgggttcaagcaattctcctccctcagcctcctgagtagctgggattacaggcgcatgccaccacggccagctaattttttgtatttttagtaaagacgaggtttcatcatgttggccaggctggtcttgaactcctgacctcaggtgctctacctgtcttggtctcccaaagtgcagggattacaggcatgagtcaccatgcctgtctgtcaaacaattttttaaaaagatatactccacataacttaaaacatgagggagactggcagatgacagcatcagagcgagtttccttaataactgaggaggtgattgggaaaactgagccatctaccaaaatagctttacagaaccaatgcatctcatttgttgtagaagctgatgagttctagagctcttatttactatggagttttcaaatacattgaacaccacttaatgttttcctcaatcccaagcttcttgtaaaactttcacgttgccaaccatggcatcttagaggcaaataaaagcttacctactttatggaatttcagatttctaaaaatagcacatgcaatacaagtcatgcacccagtatgcttgtggatgttttaaaggccactactataccttccaagcaggcttccttgacttcagctctgctgacatctgtggctgttctgtgcattgtaatatgcggagcagcatttctaatgtctgtgcactaaaggccggtagcatccttccccaacacaagacattcaaaattccggaaaggaaatccacagtggatgcccacgaagcttcctaatctcaaaatataacacttgattacatatgtaggttttgagtttctggaacatgtattttatccttacaactatcccatgaggtagaaaatctactgaaaagatgcctatcatcgtagtcagcaatgacaatgccaccaaaggctaaagtttcattttaaattcctttataccttcaaattcaataaaattttgaaaaaaagatcttctttattaaaaataacaacacacacacagaggtaaataagcagtatacatttaaagctacattttttttagatcaagttgactctataaagcagtttttccatggagctaggggtagttatgcattgtggatcctgaggttaatttatttccagctctgggcatatcataaagcagctatcaaataggtcaacatacccacccaaccctaatagtgttactctgagtataaacatggaatctttgctgaatggtttcaaaaaagcagggtgaaaataacttagtccaagaagatacatcaaaataaataaggaacatttttaagtaattaaaccaccggaaatatcacacattttatgtaatcttatcccattgtctctgaggaaagggaaaaaagagaaagtacaaagccagctagagaaagacaaatacagcttttaaaagctctaattaaccccactaagaaatttttttggctacctggagtacgcaggcactgtataatgtagggcagttgtccccaacctttttggcactagggtctggttttgcagaagacaggtttttcacatatgtggtgggacggttttcttttggaataattcaagcacactacatttgttgtgcactttctttctattattacattgtaatgtataatgaaataattatgcaactcaccataatgtagaatcagtgagagccctgggattgttctcctgcaactagatgttcccatctggtggtgatgagagacagtaacaaatccttaggcattagattctcataaatagtgtgcaacctacatccctcacatgtgcagttcacaatagggtctgcactcctaggataatctaatgctgccactgatctgtaatatgaacaatggggagtggctgtgaatactgatgaagcttcgctcactcactgttcatctcctgttgtgcagcctggtttataacaggccacagactggtatctgtctgtgccctgggtgttgggggccccgatgtagggcaattacatttattcatttatttattgagtgcaatggcatgatcctggctcactgcaattttcaacttccaggttcaagcaattctcctgcctcagcctccccagtagctgtgattacaggcatgaaccactatgcccggttaattttgtatttttactagagatggagtttcaccatgttggccaggctggtctcaaactcctggcctcaggtaatccactcatctcagcctcccaaaatgctgggattacaggcacaagccaccatgcctggctggcaactacatttattaccatccatttattaccagggcacctatgttgtacagtgcctggcacacaacaggtagccaataaacagctattgatctaatgcaggaataataaagtaaggtttattttttctcctttaacatgctgtagttgtgtcagatgttaataagacctccggagtctgcctgaagtaacataaaacaaaagacccattcatcaaacaatcacctggaccccctaacttgttacaagttaggtatgaatgtaccacctgtaccagcttagtgagatgaatgtttaccatcacataacaaatacttgtttgccacgctaagggcttagagtttgaatttctgatgagaaataaagtggcatgtacaaaaccccagagaatgatattccatatatccataagcatcagtagcatatcttaaaagtctcacacatccagcaaatcctttaaaaacaagatatcctaatatgcagccagtttagcaattttttttttttttcagagtctctctctgtcacccaggctggagtacagtgatgctagatgggctcactgcaagctccgcctcctgggttcacgccattctcctgcctcagcctccctagtagctgggactacaggcgcccgccacaacgcccggctaattttttgcgtgtgtgttttttagtagagacggggtttcactgtgttagccaggatggtctcgatctcctgacctcatgatccgccagcctcggcctcccaaagtgctgggattacaggcgtgagccaccgtgcccggccagcaatatttttaagaatgataagacagtgcagcttcatttacctgaaatggagcacaagttctttttgaaggaattcatacccattcctgcaaaagttctgtggtctcttgaaggtagcacagaactaagcgtttttttgtgtgtgtgtttccaaagaggttttagccaagattttagtctctaacagactccctgattaaaatatggcttagaaactatacctgcctacttgaaaaagcatcaaatctacagaatacttttcacggatgtacaaaaatgaaaacaaaataacattctactttttgcaattcactttttctcaccttccacttctcttaaatatacttcagaatcattatgcacaggtgcagagaccactacatatctaaaaaaggagaaaaccctcaaatatttggggatggactggcaatattgccttgcagaaataattttgtttccttcagacagaaatgtctcactattttcagcattcttacctaacaggcaaattttgtttccattgactttgaaagggctaagcttaaatctaaactcttaaacaagaatgaagtttaaattttttattaatgaaaatcccagacaggtttttccaaatctttatatatttatatataaacgtaacaaatctttatatatttttttgaaaaggtggcttatttttttaattttattattattatactttaagtttcagggtacactgcacagtgtgcaggtttgttacatatgtatatatgtgccatgttggtgtgctgcactcattaactcgtcatttagcattaggtatatctcctaatgctatccctcccccttcccccctctccaccacagtccctggtgtgtgatgttccccttcctgtgtccaagtgttctcactgttcaattcccatctatgagtgagaatatgtggtgtttggttttttgtccttgcaatagtttgctgagaatgatggtttccagcttcatccatgtccctacaaaggacatgaactcataattttttatggctgcatagtattccatggtgtatatgtgccacattttcttaatccagtctatcattgttggacatttgggaagaacctgcattgccaagtcaatcctaagccaaaagaacaaagctggagtcatcacgctacctgacttcaaactatactacaaggctacagtaaccaaaacagcatggtactggtatcaaaacagagatatagaccaatggaacagaacagagacctcagaaataatgccacatatccacaaccatctgatctttgacaaacctgacaaaaacaagaaatggggaaaggattccctatttaataaatgatgctaggaaaacaagctagccatatgtagaaagctgaaacttgatcccttccttacaccttatacaaaaattaattcaaggtggattaaagacttaaacgttagacctaaaaccataaaagccctagaagaaaacctaggcaataccattcaggacataggcatgggcaaggacttcatgtctaaaacaccaaaagcaatggcaacaaaagccaaaattgagaaatgggatctaattaaattaaagagcttctgcacagctaaagaaactaccatcagagtgaacaggcaacctacagaatgggagaaaatttttgcaatctactcatctgataaagagctaatatccagaatctacaatgaactcaaacaaatttacaagtaaaaaagaacaaccccatcaaaaagtgggcaaaggatgtgaacagacacttctcaaaagaagacatttatgcagccaaaaaacacatgaaaaactgctcctcatcactggtcattagagaaatgcaaatcgaaaccataatgagataccatctcacactagttagaatggcgatcattaaaaagtcaggaaacaacaggtgctggagaggatgtggagaaataggaacacttttacactgttggtgggactgtaaactagttcaaccattgtggaagtcagtgtggcaattcctcaggggtctagaactagaaataccatttgacccagccattccattacgggatatatacccaaaggattataaatcatgctgctataaagacacatgcacatgtatgtttattgcagctctattcacaatagcaaagacttggaaccaaatctttatattttttattcacccttctctctctctccacaaccactaacataaccacccacaaaagaagaagacaatcccttcaatgttccccgaatgtgtgctgctgctagctcggaagctctgtagagttttgtaacggagtgtgaactgctggcctggatctcctaaccagtaaggagagagggaggacaaatccgctgagcaggtggtagtcggccacaacacaaccgccagccaggaaaaggccagggtgcggggatgcccgctgccccctcgacgccagtgtcctctgccc

SEQ ID NO: 2505 - DNA, 2343 bp, Homo sapiens
actcacctggcggctgccacgcgcccccgcccaggatccgaggcctggggcatctgaatgaggaccctccacccacatttccacttgggagcgagctccagtcggggaaagggcctgcagcccgcctcgtccccaccctgggaccccgcgccccccagtcccccactcccgcgccgaaggcagggccgcgccctgagccgggaagtcgaggggatggaagggaaaggagccaccggtgagggtcccccgggttctgagcctcccgcgtcgggatccgtggggcgcacagagcgccacctccggccgaggcgcagctcagagcgcgatgcgggggaggaacgcgcgcggaggccgaggtctgagcgtggctagacggctcccacgccgagaaagggcgggtgcgcctgggctggatggatttcgcctccctagaccaggagggattggaccctgactacaggtccaggtgctcgtcagtgccctgccagggggtctacgcgtcctggtaccgggtccagcggggtggcgtgctgtgcagaccccgaggctagacggcctaggcccctggagcccaggagacgcttccttggggggaacttgcggcttgggaggggacacccactgcatggcttctggaaagagccggactcgcagggccaggacgcaggccggaccccggcctcattcttcggccagttatcccggagtggcgcgcatcctgtcttcctgggcctcggactgctcgcgcgcagagggggcccgaggacacctctgtggggttagaggactcggtaagacggtgtggaaggcaaggaggaaggtcgcgttgtattggggatggggtacccgtccctcccagcttgagggatcctgggggtcctcgccgcctctgagggcctagatggctgcttccctcggctcccctgcccggcctggagctacgggtgcgcccagctagagtttagggccacctggggacgtgcaaggggcgctggagcgaggcgggggctggggcggggcgtgggtgcttcacccgcgggggacgcagagcttaggcgaaagcggtgcaggcatctctctaatcgccggccgctattaaaaataaaaccgcgacccgtcgccatggcgaccacaacaacagcggccgcgcgagggaggcgaaaacttgtgcagccgcgcgacagccgccttctggggagactcggggcacgacgcacccggcgtgggactgggacccccctgcccggccccgccacattctccgccggatccccggaagacacaaggagacgtggacccccacaggcttttttggggggattgggcgttgaaaccgcagggctgacttaaccaagaggtcaccgacttggataaaaaacccacgcccgcgcggacccccctccccggccttcgtttccattcaaactcccagcgtcctcattgcagcccctggggagggggacggagggacgaggtgggtttcaggtgctcggcccaggaggggacggtgcgacccgggccccgccggcgggttttgcgcgcggaggctgcggcacctgccccgcccgccctgccgcgatccttgcagacgggggcggtcacatgcttctttctggccaggaatcgagtttcacttccagccgctattagtcggttcacacagttcactgcaaacatttgataatgaggctaaatatactcccgcgtcggaggaggcgtgggcgtccccgcccaggcccgggagacagaggcgctgaccccgggacagagcctggctttgtgcgggaggcagacgcgccccgcgcgccgcccccgaaacattcgcaccccatgctgaggcgcgcgtctgggagtccgtgggcgccccgaggggcagtggaagccgttggagggcctcaggcaggaacacaaggtgtcgtggcagaaaggaagaaggggccgggcacggtggcccacacccgtcatcccagcactttgggagggaggccaaggcaggaggatcgcttcaatccaggagttcaagatcagcctgggcaacacagcaagaccccgtctctactaaaaccctaaaacttagccaggcttggtggcatgtgcctaaggtcccaggtcctcgggagactaaggcaggaggattgcttaagcccaagagtttgaggctgcagtgaactattatcacaccactgcactcagcctgggtgacagagtgactctgtctcaaaactaaataaataaacaataattgtgttattctgtctccatttctcgcatactgaatttaaggtggactcagccagcgggttcaggcccagggtctgtcctgcagctacagtcagggttggt

SEQ ID NO: 2506 - DNA, 9104 bp, Homo sapiens
ctttgctgtggttatggccctgagtccttaaattataggctctcctgcagtttcaaaaagctaattcacactactgtgtgcattagaaaggtggtatatatgatattccactaagggaaaccctaggaacattaaactcctactagtaactggtcacgagtcagggctagaactgacactagtcatttttcttcactgacaagttttcattatgtggctttcccagaacaatttagaaattgatctgcaactgatggaagctgggatgaattgggcgcataagtgaacccaaagcatcagagcaaagtcaaagcgaacatctggctccagctttgagtacaagattaataaaggagtctctccatatcctctctgtccacgttcgttgtggacggggtcaccaggaagatggttcctgggtgatgagagtgtccaggacattgtcttcggtggactactggcacagggacctgaataagacactgggatttacaaagtggaaaagaaatcactgagggatccctcaagccactgaaaacatgtaccatttgccataaaacagcattaaacattaagtcaacagattgcacatgaatatcaacaatcctgcaaaaaaagccagtcccttaagaaacatcaagattgacagttgtcatcagagaaatgatgaggaccaggatcttcagggtaccatctggtgctgtgtttgaagaaaatgagaatgagagatatttcctcaatagatgaaactattggccccagctccaaattcacacttgttgcagcagttaattctgcaaaatcacagaaggaaaaaaagtcaggccaaggtaggtggaccacgaggtcaagagatcaagaccatcctggccaacatggtaaaatcccatctctactaaaaatacaaaaattagctgggcatggtggcacaagcctatagtctcagctactcggaaggctgaggcaggagaatcgcttgaacccggaaggtgaaggttgcagtgagctgagactgtgccactgcactccagcctggtgacagagtgagactctgtctcaaaaaaaaaaaaaaaaaaaaaaaaaaaaaaaaaaaaaactcaggaaaactcctcttcttttttctttttttttgtcccaggctaagcagaaatgtactgactcattttgtggttatatgcattattattctcgtctcaggtcaggactgctagacttagaaagaattctgatatgaattgtgatatcattgtctaacagaaagtgtattggaagttgttcacaatctccagacacttggcaggtcacagagagaggtgcagagagctgccttttttctttcttttgggttcaggattgcatttctgaagtttgtcctttaccatttattgtacactgacttttgctgttagataactggtttccaaaattagtgtgtacacaaattacctgagtcatttattaaacatttcctggcctccccctagggcaatttatttgtagatttcaggtgaatcctagtcatcaacaatttagctaataccaccctttcccagagagatcctgagatgggtgatctgaaaacacctcatttgaaacattctaggttagtgaattgagtttattgttttacatataaattattttcactatgctttatcatagagcttgacctgttcccagaggaaatctataggcataaaatgaacacatgtgttctcaacggctttaattaaaagagtggcatgcatatttcattgctattaacaaaaacaaaattgatttgcttttctagataattgaatgtatgaaaatctcagtgccttccttctgtaacttaactctataaattctgcatcattttcattttataagtgctggcatgtattgtgaatttctttacagcaagaagaatgacttaatgttttagagttagttttgtttttttgttttgtcccattttttaccaaacataaaatggcctaaaatgagtgcacaataaaagtgtgacaccttaaactaaagtaacatcaatcttttccataaagtattttgttctgtgatggcagataccaccatatgattgaaacatttctaagtgtgccgtatattaaagactgagccccttctcctaaatacacatatttttgaatgatgtatataaaatatattaaggcaaaagcaaatggcaaacataggtcactttttttttttttttttttttttgcagttacagtagtttccagacagccacttctgttcctgttccaaaaactatgactaacatttgtctgtctggatggtatcattaaatgaaaggactaatagtctctatgatgccacctgaatttcttatcgttgtttatttgttctctcatgaaacatgcatcatatatttaccacatgctgattatgtagaagataaaaagatgaaaaagagaaccccagaatgaattttccctctcaggatggtatgacattaaacaaaactaatcacaatgcaaaagagtaagtgcagtactcagctttcaagatgaccctcaacgattgccccctggtttttacccctttgtgtagtcccctcctgtgctgaattgtggctgcctgtgttaccaataaaataccaacaaaatgacagggagtgacttctgagatttagtcataaaaaatattctaggttctgccttgctctttcttgaatcacctgctctggaggaagccagttgcatgggaagacatccaagcagccatgggttgtgtagagagaaactgaggcctgccatcagtagccagcatcagcctgccagccatgcaaggagccagtgtggaagccaatattccagagccagtcaagctgacttcttgactgaaactccaggagagaccctgaaacagaaggacaaaaccactcctgagttcctgactgatagaaactgtgagatgataaatgtttttgtcatttaaactagtaaggtttggagtaatgttttgcagcaataattaattaaatagtaaagaaaaaaatgcactaagaaaaatccaaagtgatataggggttatgaggaaaggtttcatggaagacatagcatttgagtgaagccttgaaaaataacaggatttagaaatgcagggatgagaaagaagcccattccaggtagatggaacaatgtgtgcaaagctacagaggtgacgatttgccagggattaggcaaacatcaaataatcttgtttgattgcaacattagtccctctcatttgctccaaggttgtcacttttgtggtgctgaggctagatgtaggacgatctcttgtttgaagccaaaaaagagataaacacataaagctgagcctaaaatttagcaaagtaagctcagtaagtcagagaaagagtccaaatagatcgccttctatctctcttatccaagaaataagcaagccttgtatgccactcttttaagagatctatttggactccttaagaagggtccatggggcagcccgagaaaaagggagcaaggaactcagaaatggcatctattcagaatgcaaatcttatggatgagtttctctctaaatctacatgtgacttgatatatttggcagactaactccattgaaagataactcattttataatatggcatttacacaaacatcagagaggaatagtaaaagaaagtaaaattatagtataggacagtattaattatgaatatagatacaaaaatcacaaaaaccaaattcagcattataggtaaaacaaatagggtttatttgagaaatattggggtagtttaaccatggaaaatctgtatatgcaattacattagctgctacagaaagaaaaaccttttggaaaagttcaacatgcatttatattaagaattcttagaaaatcaggaacagaaagaaacttctttaacctaaagaacaatagctatacaaactttagaaaacatactttttgtaaaataatagaattatttatggaataagacagtgtattagctaggggcaatgcttgctgttagcagataaatctcacattatcagaattttaatgcaaccagcaaagttgtttctggtcaacaggtaacactgccacgcctaactaaaagaggttgagaaatttagactatttgaaaatgtagactgaaatttggaccagaaagaagagaaaatgagttggctattcacctagcagttactgattgagtctttattttgtagttaccaaatacctatttcattaaaacatattaaattaaattaaactcttaaattaaattgttcattaaaacatcatgcataaagcatatccactcttgctcagagaaacatccaaagtcctatcttgtgggaaattcagttcaaagtcagcgttccaggtgacatgcattcctctgcattaggtctgaatggggctttttgtcatccagtgatttatgaatcaaaaggaaaatcatatactccctcccgtccccacctccactatcatcatggatagtataactccaaaaaacatatccattcacaaaagtgacaatgggagcacataccaggaagaaagccatctaattctgttgggtgggtattatgagttccctctgcctgacattggaatcattttttggttatatctcaattctgctctttgggaggaattatcttgtcctcagcacccctagagattccttttgcccatcattctttctaaaatgtctgaaatgggttaggaagtgtataatccttgggggctatatagaaactggatcttgcttcctgcttatataactttggggactcaagaattgtattagagctcaaatggtcagagatattttttatgccagtcttgcaatatctttcaatttagttatctcaaaaaaatagcagggggaaaatatggcagtcccttacaaatttgaacatgtgtttaccatatgacttagccattatactctacagcactaatgccagggaagtgaaaatatatgttcattcaaaaacctgaaggaaaatgtacgtagtgggtttatttgtaacagcccaaaactagaaatgacccaaatatccttcaacagaagaataattaaactctgtggtacctccacaccatggaatactactcagcaatcaaaatagaaaaactagggacacgtgcacagaatagattgattttgtattagcttcctattgcttctgtaatgaccacaaatacagtggcttaaaacagcacaaatttcttctctgacagttctggaggttgaaattataaaatcaacattttagctaggctaactcccttccagaggcttcagggaagaagctgtttccttcccccttttcagcttctagaagctgcctgcaatcattggctcatgaccctttccttatatcactctaatttcttgcttccattgtcacatctcctacttttctttaacctttttttttttttttttttgagacagagtcgtgctctgtaccaggctggagtgcagtggcataatctcggctcactgcaacctctgccttccaggttcaagcgattcccctgcctcagcctccctactagctgggagtacaggcactcgccatcacactcagctaattatttatattttagtagagacggggtttcaccatgttggtcaggatggccttgatctcctgacctcgtgatctgcccacctcggcctcccaaagtgctgggattacaggcggaagccactgcgctgggcctatctccctcttaaaagggccgttgggattattttaagtccacctggagagcccaggatgctcttctcatctcaaagtccttaatcacagcaatgatatctcttttgctgtattttctatattcatagtttcagagaataaaaacgtggacatcttttgaggtggggaagcattatgctgtctaccatagatcaaagcaattaggctgaatgaaaaaaagccatcctcaaatgttatctagtcatgactccatttatacagcaaaatacctgtttgttaacaaaaaagacaaaactcaaaaatgtagctcagatctgctaaatggattttaggtttaggcaaattcaaccaccttgccacaggtaatcccagcaagaagttgcagatacaaacttgagctttctgcagtcagattcattccccagagaaaggcaggagaaactgagctccacattccaaggttttccaatctgctaattactccacctctcaagatacattagtgcgttatgccaactgggtgccccttgcatgaaaagaaataaaagatatagggaagaactattccttttaacaattgtattgtttaattttgtttaggcttagcagtgcatgagactcttatactttttgaaggttgtacatatttcacaataaaattaaaattcgaaataatcaagagaaggccctaagactgtaagaagtacgttcattgtggagggctttcatgacaattctaaatttgggacttttgagggtataaaatggaaagcaattgagactttgtaatcgaggaagtaacaagttcagagctgcattgggagatgactgcaatgactgtataagataaggatgaataccgagggtgtataacaagatcagcgagaagaggattgccattgttccacctggaccaggttagtgaccacagggaggggaagcagggagacttaggagtatattgtgatatactagggaagagtatctcagtgttaggaaatgtcagctttgtaagtttttatcaagcagctcctggtatagtgtatgggttcagtaagacatggaaacagattagttgtatgaagaagggggcattaaagatgaggttaagatttaatggtatggggaatgttgggatcattaatatgaagaaattaggaggaggggtgttagtgaataggagcaccaatggtgagtttttgacagtctttgccagcttaagtttgtatctagccacatagcgagatgaggcattaacttataataaagataaatcaaaagctccccatgttccatgaatatctattctcatatcccggctgtttaagactttcaccaaaatttcttgtttatccttcatatagatctcgcatatttttcaggattaattttactcctacatatggtaatagtttctattgagatgataaatgaaatcttcgtatccattataaaatgataagtagttattacaagtctttaggaaagctctcattttttgtgtgtttcacatgaatcagtgttctgctctattgctctgagtatggctggcacagaaagagttaagttggggaggaaagctcttggtttctatgttttttgtaaaatggcattctgttctattgctgtaagagcctagcgggagaaaaacaagcagggccagggtgcaacagcggctggacagggagaaagcagcagtcaaggagcattcagggcacaaggtaagaggttcacattgcttttttgtttgttttcttaacgttcaccattcttttcttatactctattagtaatgagaaaacactaatatataagtgtatctgaagctttcaggaatggaaatggattttctatgactatcagtctctgaaaacaagcatggataggctggtgtatgacccttgagacctgtgatgatgggagtgatccccttcttgatgggtcctcagtaaatccaacaccctgcagacacagtatgctatttttacaggaaaggtgtcccaatccagaccccaaaagagcgttcgtggatcttgtgcaagaaagaatttgaggctaatccagagaataaagtgaaagcaagtttattaagaaagtaaagaaataattcataggcagagcagaagcatgggcctctgattgcccctttttatgattatttcttgattatatgctaaacaaggggtgggtggattttccatgaatttcctggaaaaaacacgggtaattccagagctgagggttcctccactttttagaccacatggggtaatctctggacgttgccatgacatttgtaaactgtcctggcgctgatgggagtgtaccagtgaggatgaccagaggtcactcccatcaccattttggttttgatgggttttagctggtttctttactccaatctgttttatcagcaaggtcttcatgacctgtatcttgtaccgacctcctatctcatcctatgacttagaatgcctaactatctgggactgcagcccagtaggtctcagccttattttacccagcatctgttcaagatggagttgctctggttcaaatgcctctgacactatgagggtgctttggcaggaattatctttggaccactttggctttgatctcccagggagtgatcatgtcatagaaatggaagtaagcatgtattttgtctctccaactgaactgttcagaaacagttaataatttcataataatattactagtaattgtagcagcagtatgtggttaatcgaggttccatgtgcatttctttcacggtgtcttaattttcacatgaagtccatgtttcaggggttgttatgcctgctttacagatgaacaaattgaaatgttaaataacctaaataaccttgcctaagagcttatgagagtgttggggctgggatgagaacctggtcttacctgaattcagcactcaggtgccaaaacactgtgagaaatagaggtagtttatttcttaaatgataaaatcatttaaatgttcccagtatcatacctagcatttaatagagactcagtacattttagttctctctttctctctttgaaacaactaacaaaacaaacaaaaacttgccacagttccaaattagagggatatgtgaaactcaaaggcatagtaaaataatggactttaggaatttaggagctccagatgacaaccaagaagtctaggggtgagggctcctccagagtagcccagaagagctatgctagacacgtccaaggcaaggaaggagagggcaggaagaggccgtgagggaggcagtgaccaccaagaggggaaatgggcagagagataatccagataaccagaataaccaaagaacacattagaagag

SEQ ID NO: 2507 - DNA, 6297 bp, Homo sapiens
gtacgcggggcgtctggaacttaaaggggcagcgtaccttggccgtcccgttccacaacaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccaggtcagtgccgagggtagccacgagcctctctctctgctctgaactaaccaacccgcccgcttggcagccaggcaggcacctgcttgtctaaccacttggggtttctcactgggcttgtgggatgatttcggaggtggcaggtggaggggtgtctgcaggtccagaatgttccaccctgctgctcagggaccatgtcagcccatctctcccactctctctccaccaccttcctctctcttttccaggccataggccccatgctagtcccagagatttccaccccccaagacagagaagggagcccacatttcctctatcctaccacgtgccagcagcctgctttacccgtgcacagtctctcaggcagagcccggcatgggcaattacccacctatctctgggacctccccacccatctactgcctacctgctgtgtgaccgagcaaattcactaccctctctggtctctgcatttactttctgtaaaggtggctctcaggtgaccaagagggtgcagggcacagtgacggatgtgctttggagcagtcggctattgctgcataacacagcatcccaaaacagtggtttacagccccagtaattaacctactcatgattctgcactttgggctgggctcagctgggtggttctgctgctgtccctggggctcacccatgtggtgctcatgggagctcagctgcacctgcatagtcagggggtcccttggccaggactgttggcagcaggggtcagattttcctcatggcctctccagcaggccagcccgggtttctcctggtggctgggagccaggagagcggctcccatgcagagtgctggtttcacatttgtgggtggcccatccgttgaggccagtcacgtggccaggcccaggaccagatgggagaggaccgcacaagtgcagcgtgagctgtgggaggtgtggctgaccacgcttagagagtgtggtgccaggaaagatctgatgtgtcaccattctatatctgtgatgggcagacgcaggcaggtcaaaggggccctggggacttaccgagcccctgcctattggccaggcactgtgattgtcctcggtgccatgtgccatggaagccctctcagaggtcgaggggaggcaggtggagacagagcctctgtaggcctttcaagctgtagccccagagcccagaggcagccgaattcatgtgtgcagtcagagagcacttagtgggcactgtagtcaatcagtgagcgcttactggacaccacaggcagcaagcatttactgagtacctctggcagttgatgcatacttcctgagtacctgttcatagcaggcttagctctggatgtggggtggtgaggaatcccacaggctgaggggtggcctgggagctttccagggggcctgaagcaggaggggctgcctgagtgggtcagcagcccagcccagtgccctacgcagccctgcccacacccccaacccagcctctgtctccccagtcccatcccccacaccctggtccctcctactttgtgcctcgaggacactgccccgctgccctcctcacttcccagcgtctgctgtcccctccgctgctgctgcccggcaggattgctctgtgtctcatccacgtttgtccctgcagagttcctcgcctctccctggaaccgccagcctcatgccgcatctcagaggctttttttttctctcttttttttttttttgagatggagtctcactctgtcacccaggctagagtgcggtggtgcgatctcggttcagtgtaacctctgcctgtcaggttcaagcgattatcccgcttcagcctcccgagtaggtgggactacaggtgcctgccacctcgcccggctaatttttgtatttttagtagagatggaatttcagcatgttggtcagtcaggtctcgaactcccgacctcaggtgatctgcccgcctcggcctcccaaagtcctgggattataggcatgagccactgcgcccggcctcagaggctttcattcccacttttcccccaaaactgcgcctctttggggtcatcagtgaccttcgcagggtcaagtcatccccctctcctgtcccaggaccttaagcactgccctgttttacagaagaggaaactgaggccccgagaggtaaggcagccagctcagggtcatcgcccacgcccagaaatgccaggattcccacccggacctctgaccaccaagctccaccttagtctggcccggggtcatccctcaggtgctgcctcatgccttgggtctgtctctcagaccaccctggcccttgcccctgctccccagcctgactgaagctgggccaggcagagactgaagactgaacgagtgtggccagcattcctcctgcacctgcccggagcctccaggcccagccgtccatgttcccagaagtccagaagtggctttgctgctcctggactctcactggccccccatcgacccttggaccaataactgccatcaaaataatcctgattatgcacctatcaagtccctggccctgggctaaagtcttcacaggggtcatctcatttcatcctcagccccaaaaggcaggtctcacccccaaatacatatggacaaaaagaggctctgccgggtgtgatggcgggcacctgtaatcccagctactcaggaggttgaggcatgagaatcgcttgaacccaggaggcagaggttccagtgagccaagatggcgccactgcactccagcctgcgcgacagagcgagacttcgcacccgccgccccccaaccaaaaaaaaaaagggcacagtcagagaagagcagagcccggcttggtttggtcccagccctgcctgcctctgatgtgctgtgtgacataggcctggtgctggccctctctgggtctccctttctttcttcctttcttttcttttcttttcttttcttttcttttcttttcttttcttttcttttcttttctcttccttccttccttccttccttccttccttccttccttccttccttccttccttctttctttctttcttttgacaggatctggctgtcatccaggctggagtgcagtggcacgatctcggctcactgcaacctctgcctcctgggctcaagtgatcctcctgtctcagcctcccaagtagctgggactacaggcgcacaccactacccccagctaattttttgtattttttgtagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatggacccctaaattatgatttttgccaaaatggctttgagtccgtttctgctgctgtttgcagaagggcctgcactgaccactgtgaatgccaagcctgggtgaccaggcctccacaagttatgcatctccaaggccagctgtgtgccaatgcagttaccccagaatcccttgttccagtacaatgtattagggaggtcagataagagttgtttggggtcgaggcaggttccagtcactgctctgggagggtccctcagcttggcactgtggggtggttgatggagacggatgggaagagcaggggtgtcccgaggggagacagagggcatcctgttaggacatcgggcctgtcaaggcatctgaaggcctggaaagggggttcagccctacctctcctccttctaggtcacactggggggcctctgtgccattatcccacctctccactgtcctactcagcttaggagtggggaggagcctaaagccaccccatttagggcactgattggtgtgtggcctccagagtccttctcccttcttacctgctctgaaggcacctctcaatgtccatctgtccttcgtgcgaccatttctccagcaaacactggtatttgtgagccagccctcttgctcagaccttcaggacaaactggcagcagaatgggattattgcctgcctcccaggacctgcctaggatgtctggggcgctaggagctaggggtgagggaggcaggtgtggggggccccaccagacccttctagggctctgagtcactcatagcccctggatgcaacctcaaccagcgactaacagtcatctctctctcttttttttttgagctggagcctcactctcgcccaggctggagtgcagtggcgcgatctcggctcacaataacctctgccgcctgggttcaagccattctcctacctcagcctccagaatagctgggattataggcacctgccactgcgcccaactaatttttgtagttttagtagagacggggtttcaccatcttggccagactggtcttgaactcctgacctcgttctcccaaagtgctgagattacaggtgtgagccaccgtgcccagcccagtcatctcttaaaaggagtctaggccgggtgcggtggcacacgcttgtaatcccagcactttgggaagtcaagactagaggaacccctgagtccaggagttggagaccagcctggcaacatggagagaccctgtctctataaaaaaacaaaatagctgagcatggtggctcacgcctgtaatcccagcactttgggaggctgaggtgggcagatcacctgaggttaggggttcaagaccagcctgaccaatatggtgaaaccctgtctctaccaaaaatataaaaaattagccgggtgtggtggtgcgcgcctctaatcccagctacttgggaagctgaggcaggagaattgcttgaacccgggaggcagaggttgcagtgagccaagatggagccactacactctagcctgggtgacagagcgagactctgtctcaaaaaataataaataaataaatagataaaagggatctgatcaagactctgggttgtcagacacctcgtcaccccgagtccaagggcttgtgggggcgctggttaatttgcatctcatttgaatgctcgatagccctttttgcctggagggcgccccgcccactctagccgccagggggcgcaagaggcaaagcgttggcgggaagttcagcctcctagcggtcattgtctgcagtcctggctggccctggtgggcacactgtgaccctccaccctttttcaccctatatgccctcgctcccatttttcagagagcaaactgaggttctgagaggccagagggctctcagaacaagagctcgcagcctcccttgtcagggtggagagcaagggcactcctagagctcactcaatagcatttactggccaggcgcgggggctcacacctgtaatcccagcgctttcggaggccgaggtgggcggatcacttgacgtcaggagttggagaccagcctggccaacatgatgaaacctcgtctctactgaaaatacaaaaattagctgggtgtggtgcatgcctg

SEQ ID NO: 2508 - DNA, 3248 bp, Homo sapiens
cctggcctcagcttcccagcagagggctcttctgcagaaagtgatcccaggatagggggctgccatgggagtcagggatttgcaccccaaatttcaggtggtatctgagctctgtgtgtccttcctacccacctctcagggcccagcagctcacctggaccacggaaagcacagaaagaactggctgaatgaatcaagagatcaagtgttctccctgaggccctgtaacagctctgcagctgactgcccagaaggaagcagaaatgtgagttccctgaaggcaagaccctgttggatctcacagcaccaagcactagatctggcatgagttagtcaaggttttggagcagaagaatggatggaggaaataatttctgaatcgaacttggaattgaactgcctgaactttaatgccctttccagccttagggatgataatgaattaccaaagtgagaaaaatggaggcgcaagctgttgtcatccttccagaggcaccctccaagtgtgtgtgggtgaaatgtgagctggagagaggattgacaaagagcagtgaaaacatattcctggaccccattctttttttttttttttttttttttgagatggaatttccctcttgtcatccaggctgaagtgcaatagctcaatctcggctcactgcaacctccacctcccaggttcaagcgattctcctgcctcagcctcccgagtagctgggattacagacacacaccaccacgcccagctattttttgtatttttagtagagatggggtttcaccatgttggccaggctggtctcgaactcctgacctcaggtgatccacctgcctcggcctcccaaagtgctgggattacaggcatgagccactgtgcctggcctgaaccccatttttatctctggatttttctctctgttgaagaattgctgcagaaaccatattctaagtataaaaggcctttagatacctaagatgatccccagaaccttgatgtgaatccatttactcatactttacattctcactttacactttgagcatgaagcccatggtgatctggttgtaaaaggtttaaaggttaattggcagccaatgttgggggtgagaagttgctgctgcaggcaggcaggtattcaccaaggcagcagagagaggaggcatctgccaggctggtagaaaggaaatagaaaaagaaaacaggccgagagcggaggctcaggcctgtaatcccagcactatgggaggccaaggcgggcggattgcttggttgcagtgagccaagatcgtgcactacactacagcctgggtgacagggcgagactccatcttaaaaaatcataataaataaaataaaaatacaaaaattatccaggtgtggttgtgcatgctgtcgtcccagctactcggggcgctgaggcaggggaattgcttgaacctaggaggtggaagttgcagtaagctgaggtcacacccctacactccaggctgggtgacagagcgagactccgtcaaagaaaagaaaagaaaatagaagagaaaagagaagaaagaaaatgggcaaaagcaactaaaggtaccacagatcaaaacctttaagatcagcattgggtacaccattgcatatctgctctgggcaaatccctttctgggcctcagtctccccatccgtaaaatgaacaggttttaccaagggctctgagggcttatgattctccaggagtttccttatgtgaggcctttctgtccccaaccatacagatcagatgaggtgtcatcaaagtcaagactccaatttctagggtttgtgggttatcaggctttcctgccacaaactttcctgccacgaacctcctgctaggctcctcagggggagttcactactgtggctgtctgggccgagcccccaagaagaaacaaaactctccagggtctggtgcagaggctgtggcccaaggtctgcttgctgcctaaggaagatatgaaaaggaagcctggctctgggtgaaacggaagtgtctgaggtctgacagttgctctcagcatggtctctgcagccaggagggaagtaaaactgtctgggcatctggtagtttctaccctgagagtccacaggacagtgacaagtggggcctggtgcaggcctgttctctggtccagagccctagcttaggccagagacagtctttggagagatgctggcccaaagatttggagggagggcaaaggagaatactctgaagctggttcatgaccttaggcaaatctctgtgcctctttgggtccagtttctccatttgcaaaaatggagtttgggctaaatttgcctgtgcaataagggtttctggaatggtgggcactggggatacagagacaatttggttacaaggaacctggattgttaccctgctggcaagggactcacagcctggtaggacatagttacagaatcattggttaattgtgattatcaatgcatgtataggtgccgaaaagctgtggacatagagcattaattcagcattcatccagagatccagggaaggttaagcaacttgcccaaggtcatatagatattaagtggtccacctggggccagagtcttgaaaggaaggggaattcagaagaggacatggctaaatagaagtctggaagaccagtctgcttgtgcttgctgctgtcatcaagatctgaacaaagttatggagacccagaggaggggagattaattctgacttaggagaaggaggaagacttcacagaagcagaggttttgagctggggtttaaagggcaaatatgagtttatcaagtacagaaagggagaagggtgttaaaagctgagggaacagcatattcagatgtgtgatgttgctaaaaagagcctgatgagttgctggaaaagttgtctgtgtgtgtttgtgcgtgtgtatgtatgtgcggtatgttaggaacaaagagtacctaaaatgggaggactgagagatgaggtttcatagtctggctggaatcacacagtgaagggccttgaatgtgtttggagggcagtgggcagccataaaagggtcttaagccacggatgcatggtcaaaatagcctattagcagtcttgctcgggctgctaggagggcagaggaccaaagtacagggctggggccaggcagaaacaactgtaaagaggcagtggcagaggattgagggtgtcaggtgtcaggcctagcccctgtcaagaaatagaaacttttcaag

SEQ ID NO: 2509 - DNA, 796 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 2510 - DNA, 12669 bp, Homo sapiens
cttgtggaatgggtagcagccattgattggttaggtgtattaatgctggcctgttaaatgacatgcagacgtgtctttgtgctaaatggcagctgaatgggtgccagcgagagaggttattaagcacagataagaggcagcacctctattcactggcaatgtcactttctcccatttgaggagagacatttgttcaagacactttttttctcctctcactgacaatacgtaaggcagaaagttggtgtctacgttgctgcatggctgcagaatagattgtttcgagaaggtgaactctggaaagggtacaactaggaaaggagaaagcatgttacggcaccaggaaattattataggagtgataccttgaactattttggaaagatctgggaaaagaaattaaggtctccaaggaggaactggagaatcaatgagtgactggcctggtcaccctgagcagcaaaacactgaagtgggactacaaaaaaggaagttggcacagggatatatggaaactgttgactccgaggctcctcagccacatgtttagtgatgggcccagagctgttgttgctcagcaagaccagcattttggaagaagatgtgagcacaaagctgagaagatctggggagagcaaaggcacactggaacccctggttggttacatcatggccgtctctcattgcttctcactataatggcctccagagagtgatagttgctcttttgcttctgtaaattcctcttttgaaatattctaacctagaaccataaagaccagggaggttgtggaatgtcaatttgatctaaacaaactgatgaagcacaaaccactctgctacattttgagctcattggaactgaacttgcttagggcctggtattgccctttgtgtattttctgacagagaagtagacaatcacataacaacaagtgtggggaacagtctcataaaatagctaggcattgtggcattatttcaaatgagagacaatatactgtatgactgatttgctcataggtagaattatttcattgaaggagtcaaaagtttcaaaacaagcctaataataatacaaaaagggataagaaagatacagaataaaaagaaaagtataaacataagcgaaatattaaactaaaaaatacaattgttgaatcgaagaacatgtttgttggaataaagtgtggaaaggatgtatctgaaggataaatgtgtgtattaggaggtaaatggaaatgaagccatgtaaacagcatgtttgttgcatcagcactataatatgttctaatataatggggaaagtgtagagaaatgtgtatctcagacttcatatttctttttttaattgtacattattaagggatacagagtgaaatttcattatctctatacaatgtatgatgatcaaatcagggtaattaacatatccatcacatcaaacatttctcatttctttgtgttgtgaacatttgaaatattctcttttagctttttgaaaatatacaataaattatagttaaccatattcaccctacagtgctgcagatcaccagaactcattcctcttgtattccctacactcattactctactgcttaccatcttcccctcccctacaattcccagcctttaagagccacaactctactctccacttccatgggctcaagttttttgtgtttttgtgtgtgtgtgtgtgtgtgtgtgtgtgtttaatattagctctcatatatgagtgagacattcagtatttattttttgtgcctgaactattttgcttaatatgatgtcatccagtttcacctatgttattgcaaatgacagaatttcattctttttaatgactgaatagtattccattgtgtttgcataccacaacttctagccattcacctgttgatggacgtttaggttaatgccatatcttaactattgtgaacagtgctccaataaactttggataaatatccagtagtgggattgctggatcatgtggtagttctatttttagtttattcagaaacctccacactatttttcataatggctgtactaaaaaacattcccaccaacagtatataagggctccatttttttcacatccttttcagcatctgtttttgtcttttttatgatagccattctaattggggtgacataatattttataatggttttaatttgcatttccctgatgattagtgctgttgagaattttttgtatatttattggccagttatatgtcttattttgaggaatctttattcagatctttttcctattttaacggtattattattatttgctcttgagttgttattagtcccttgttggatgaatagtttgcaagtattttcccctattctccatgttgtctcttaactctgttgattctttcactgtgcagaagcttttagtgtaatatagtcctatttgtctgttttgtttgtagtctgtcactttggagtaagatttcatatttcgtctatctcaccattacctgtgttttcacaaattattagcaaatgtgatttgtgagtctgatttagcaatcatgcagtttatatcttacaatcctttaattattcttttatttaaaaaatacacctatataggtaaacacatatgtaatataaataacacgcaaatttgtatcacgtttacatatagatatgtagtactttgatgaaccctatgcatctatcaacgacagtcaggtgctttacacatgcaacttgaaagccttgagatattactagatgagaaaagcaaattataaacccatatatttagtacataccaaattttaagaataagatatatacggatatacttaggcaggtaagtgttcctatatatttctgcactaaaaaattatggaagtggaaatattttattataatgtctagttatccatgtgtcatgggtttgggagaaataaacttttcattttaaatactttaatattatttggatttttatatctatttttatagctaaggatagttgatgtacaaacaacaaagaagaacaaaaaatatataaacctctggatttaagaatcagaagaactgggttcaggctttagctctgtgtctctcagaaacaggagtgaatttaggtgagttgctgcttctatttgaatattcattataattttttccttaaactttttgttgagggttaacatatatatgaaagtgccttgcccactgctgtgcaaataacatgttaatattccagaaatcctcatttctttaacagataagaggaggaggaggaataattcctttcttttgggtatttttgcttaaagtccttgtgggagtcagtagcattccatgaaacagattttaagtaaaagcaaattagtacagtgctaaagctataactttacttgccacccactatcaaatgttatttgtggaataccattgtataaagattagcaagggaaaatacagataggcagagcaattgattttacatacttctcaaaaatgaaaactacaggtggatctcaagctggcctaacatcatccaagatttatcttacttttgggtggatttgacttggtaaggtgcattgcctgactacagagactattccctattcttccctctctgtcagcagactatttgctagcatgtcaatcatcagttttgtcattgaacgtggtctctaccagtggtaattaggaaagtaaattcaacagtgaaaatcagcaagcaaaactcatcaatcagcagctcttaaaaagagagatcacaatcatagcagcaaaagctgggagatcatgtccctcagggcattaggagttttatataaaaatgtacgtgatgactttgcaatagggacacccactgtgcaaagcccaatgtgtggctctcattttcaattcagatatcgtcagtctgaagtcttataatatgatcacagttacaacagaaagatattcaaatcataatgactgatgagcaacaaaaccaatttattactagatctgtctccccacacactctgaagaattcctggggatgtttacatttgctcatgaaaccatttgtattgctatgctaaaaaagcagaaactcagacatcagcacttgcaaccaatgttgtaaatgctgccctctggaagcccactggtgaggctgtgtccataccacccttggtaccattagtaatatggaggtaagctttaatcttgaaccaaaatgaaaaaagtgctgtgatagcaactccagcagtctccttttgtttagtacttccacaaacagcaatgcagtttctgctaatgcacccaagcctgggtgactctacttcaccaaagagctggtaaaccttcagtattgagcctagtttgggaaactcctgagtacaggctttaagaccacaaagaggccgagttgcagcaaatgcatcttagaatttacacacagccattttcccaaaggcagagcactggtgtacaggggaaggggagataacagagaaaaagtggactgcatattgtgcccaggatctattatcacttcagatctcagtaaatttgcaatgattttcttacattcaaaatgtcagaaagaatttatcttacttcttgccagtgggtctaaaactcacatgcatgttttgaggtgtattctcataatagtgaataagtctcacgagatctgatggttttaaaaagaggagtttccctgcacaagctctcttctcttgtctgccaccatgtgagatatacctttcaccttccaccatgattgtgaggcttccccagctacgtggaactgtaagtccaataaacttctttctttggtaaattgcccagtcccaggtatgtttttatcagcagcatgaaaatggtaaattggtaccagtagagtggggtgctgctgaaaagatacctgaaaatgtggaagtgattttggaactgggtaacaggcagaggttggaacagtttggagtgcacagaaaaggacaggaaaatgtgggaaaggttggaacttcctagagacttgtttaatagctttgtccaaaatgctgatagcaatatggacaataaagtccaggcggaggtggtctcagatggagacaaggaacttgttgagaactggaggaaaaggtgactctgttatttttttagcaaagagactggtggcattttgcctctgccctagagatttgtggaactttgaacttgagagagatgatttagagtatctggcacaggaaatttctaagcagcaaagcattcaagatgtaacttgggtgctgttaaaggcatttggttttaaaagggaaacaggcataagagtttggaaaatttgcagcctgacaatgcaataaaaaagaaaatcccattttctgaggaaaaattaaagctggctgcagaaatttgcataaataaggaagagcctaatgttagtcacaaagacaatggaaaaaaatgtctccagtgcatgtcagagacctttgaggcaacccctctcatcacatgccaggaggtttaggaggaaaaaatggtttcatgagccaggcccagggtccttgggctgtgtgcagcctagggacttggtgccctatgtcctagctgctccagccagggctgaaaggggccaatgtaaagtttgggtcatggcttcagagggtgtaagccccaagacttggcagcttccacgtggtgttgagccagtgggtgcacagggtcaagaactggggtttgggaacctctgcctagatttcagaggatgtatggaaatacctggaatcccagacagaagtttgctgcaacagtggggccctcatagagaacctctgctagggcagtgcaaaagggaaatgtggggtcagagcccccatatagattccctactggggcactgcctagtgaagctgtgagaagagggccaccatcctccagaccccagaatggtagctccattaaaagcttgcactgtgcacctggaaaagccacaggcactctccagcctgtgaaagcagtcaggagaggggctataccctgcaaagccacagggacagagctgcccaagaccatgggaactcacctcttgcatcagcatgacctagatgtaagacatggagtcaaaagatatcattttggagctataagatttgattttcctgctgggttttgtacttgcatggggcctgtagctcccttgttttggccaatttctcccatttggaatggttgtatttacccaatacctgtactccaattgtatctaggaagtaactaacttgcttttgattttacaggttcataggcagaaggtacttgccttgtctcagctgagatgttggattgtggactttagagttaatgctgaaataacttaagactttggaggactgttgagaagtcataattggttttgaaatgtgaggacatgagatttgggaggagccagaggaagaatgatatggttcggcttgtctctacccaaatcttatctagaattgtaactcctccaattcccatgtcatgggagggacccagtgggaggtaattgaatcatgggggctggtctttctcgtgctattcttgtaataatgaataagtctcatgagatctgatggttttaaaaagagagtttccctgcacaagctctctgcttttttctgccaccatgcgagatgtgcctttcaccttctaccatgattgtgaggccttcccagccacatggaactataagtcgaataagcctatttcttttgtaaattgcccagtcttgggtatgtctttatcagaagtgtgaaaacagactaatacaaagtgtaactgcatgttaccttccccagattcagtgcttttctatgcaattgattagaaacattgccactactgcaactgcatactgcaactgccaaaaaaaaatgtttgatggaaccactggttcttatactgactctatgtggcctgggacagctcatcatcaccccctaaacctactctgaaattcctcattcttcagaatgtgaatttcaagagggaaggcagcacctctcttctaagtttcaagtcggttttctttgcctcaggagaaactattttccagtatgatttgcaataggagtatacattcatttcaaagcaaaactacagtccatacatttgtggttgtttttcctacagaagctcaataggtaattgaaataatgtcaggaaatttaccagtgtgtttaagagccaggctccctggcctatgtctcagttcattatttattcaccgtgtaaccttgggcaagacacctaccttctctatgccttgatatgttaatctgagaacaaaagggatatcaacagtatatcacagggctgttgtgaaggtgtatttaaggtacaaagaataatgcttgacctatagtaaatgttctatagtttattttttactctgacacaggtttgtctcacaaatctgttatagttaattatatctagggacacattttaacagtagccactatatgtatatcatatcacaagaggtgacaaaaatggaaaagagtagacaggttctgcagaaaaaagaaaatgaaagaaagtagataaggacttaaaactgtacacctcaaatgacctttgcttaaatcctgcacttttgggttactacagacatttttccttcaaacactgcttaaattctccaacctttcaaggatagtggtaaattacagcattttaaaaataaaatcattgcactgtaaacatatgtatatcttatgtgtgttttgggattttttgttgttgttgttggatgatggctattgtagtctttttgagacacaaatgtatgtgatagctcaagccttgtcaactaaagacctccaaaaataactctctggcaggggactttcagagacttttaccttttcttttatatcaagcaactgttcccaattattcttttgtgctgtcatttataaacagtgaatggctatgaaggaagagcttttcagcaaaggaaagcagtaacatccaacccttagctgccacattctattttctgattcccttatttgagacagtcatgaaaatgccagcatttaaattgtaagacttagtgacgatatttcgataggcttctgaaaaagcttataggtacttcagttcaactcttttatcgaataatagaagttctttatattcattgtacaaaatgtaaaattcaaaatgcaaacgagtgaatagaattaaaagtcatctgcaatccaataagcagacacaaccatttaaaaaatattatgtgtatactacacacatgcgccagagacaactaattttcacacttcacaatatatttatcacaattagacagataggcagaattcctacatgttatataaataggagacaaagaaatttgaatcattctaaaaaccaatgttggtatcatttatttggcattcattaatactatatcatgaggactttttcatgtctttggatatgcttgtagcatgatttttaaaggctgcagaaatgtttttatatacagacaccatctttttcttaacctaaactctatttatttatttatttatttattgagatgagatctcactctgtcacccagcctggagtgcagtgacacaatcatggctcactgcagcctcgacctcctgggctcaagtgattctctcacttcagcttccagtgtagctgggtctacaggcatgtgccaccacacaggctaattttttttttaaattattcgtaaagatgaggtcttgctatgttgcccaggctgatctcaaactcctggcctcaagctatacatctgcctcagcctcccaaaatgctgggattacagatgtgagccatcgtgcacagccaagattatttaatgtgtttaacatttctctgttgctgaatattaggttgtttctattatcttttaattttaattaatattttgaagaactatctagaacataaaacacagtttgattcttgattatttttattggtaaaactaccaattaaaagaacaaatttccctccaaaaagcttcagccagtttttatttgtactagaagtatagtattaattactagttttaggcttagctagttagaaagataaaaatatcctattgttcttttaatttgcatttttaaaattatcgatgaaagtgaacatttttctcattttatttctttgccttttaaacattggaatgccattttacttatgtttgggaaattgcttcacatattttattaaaatatacattcaaaatatttccgctaatcatttatctattggtttatttgtcatggctttgaatttatcaactttgaaataccaggtaaaacattattcgcattacttatttttgtagggggtatttaccaatgcatttatagtatattttatcatattgttttacataaaagttattatttgacttctttaaacctgtggaatttatttgggtatatatgataaggaaatacaccaacttaaaaattcccaagtaacctctatttcccacaccattgtgtaactctcccatcagtagggcatataatgaactcagtttcaagactgaatagtctgttctgtttacctacctattaaattttatgcaaactaactttttacattattctattttacaacatattttaaaatcttgtaggaaaattacatttttgtatttttcaaagtatctttatttgaataatttaatgataatagccgctacactctgatacccctactacctgtactacaatgcttcctgattacattgaatttaaaaattattttgccaagctctaataaaaatccctgtgaagaggtgttatatgtctttttacatctataaattaatttgagaaaacataaatgcttacactattctgtttttcttccatctcttaatttattaaaaggcacttttcgtttattcaaacatatggtgtatctatggagtgtatctattgagtcactgtgttccagatgctactcttaagttttgggaatatagcagtgatataacagatgaaaaaaccctgccttcatatggtttatattctaaacggaacacaaagacaatgaaaaacaaacaactaaaagtaaaacttatatcacagctttatgaaacctatgtaagaaagcagaagacggaaggaggataaagattatatgtgcctgtgggatgttgaggaaatagctcactgagaaaggaatatcttagccggggcctgatgctggggacaccactagccagtctaatatctgaaggaagagtgctccaggcaaagggaaccaactagttgaaccttttttatttaatgtaacagcctttcaggtttttcttatttagatggactctaatcctaccttgcagagttattttgatgtattttatattttttggtatgaaaagtaaaataaattcctgtaattagtatcattaatattattgtaccatctaggttactgctgtttgtagaagagaaattgattttttctacttctcattcaatttttattggtactagaacactatttaaaatagatacccattgacatgtaagcaaaaatagaggccttgtctagctctccctactcccaattcaggcaccccacaagtaaaaacttactattgttgcctatgtcttcagatggttccatccatatttctaaatactatgcttaggctaccatttagtgaattttcagttttagatacttaagaaccttctcccatcaccatcctctatacatacttacttctgatagtgttcccaatacaattatattatgatttgtattaaatcaatattctgtgattacattactataactaagcaagtattcagatctgtacaacttagttatgatgtttaatttttttcttgaatgacttttctgattttgttttaaacagttaataattatttattttcctgttcattttttcctaggcagactcagatgttttgacttaatgattttttgacttagcaatggtacaaaagcaatacacattcagtttgttcctcaacttacaatggggctacatctggataaactcatcctaagttgaaaatattgttaaatcaaagacacactttcaacatacagtattttcaatttacagtgggtttatcagaacatagccccatcaaggaggggctgtactcgtaagtcaaggagcacccatactcattatgattccttctctccaagactccaacaaaccttataattcttctcaagatcaacacattgagaaatctgtaatttctattttgttttgtttggctttgtttcattgttttctttggtgacatgtctctggggcatatatctggacggtgaaatatattatatctggaggatatgttgaatatgttacgtcctccagatatacatggaatggaggattgacaattaaggctgaaacaagtgtcccagagacaccatcctggaatgtccatcctcctgttccaaccttgactagtggatcttgaggccaactacatcactgttttcttagaatttcccttcatcttcctcctggggattccctttgcctcctacctgtattggattctctgtgtccttgattttataactccctctttcaaagttaattctatccggaaggaactcatcttccagtagctcagtggtcagcaaactatgggcctgcaggataaatctggctctccatctatttttgtaaaactcacaagctaagaatgatatttacatttttaagtggctggagaaagaggaatattttatgacatgtgatcgttacacgaaattcaaatttaagtgttcacaaataacactcatttggaatataggtatacccattcctttatattgtttgtagctgcttttacactacaagggcagaactgagtggctgcaacaagaattgtattgtccacaaagtctgtaatatttattaactgtgcttttacagaaaaagtttgtcgacagctgaaacaacccacaaagtgtggagcatgacatggaattgttctgaaatttttgcatctaaaaatgtctttattctaccctcatgtctaatttttagtttagctaattatgaatttctaatttgtaaatcacatttccacaaatattcaaggtcttcagtgttcagggctgttattgagaggtctaataacattttagctctctctcctggtatttttcctctttataagttatgttgttatgttttctcaagtgctttagaatcttcttaatttattttactgagatctcagtaatagtgtgttcattttttattatttttaatctggtaatacatgttcttcaattctgggaagcttctttgaagcattcctttgataattttctcccttccattttctcagtttgcccttgttgcaactctttttatttagaaattgggccttccgggctgatcttttctcttttatctcctattttatattttatattttatctcctgatattaattcctttatattttagttgtctctgggatgttgtttcaaccttagttgtcaatcctccatttcatataaatatacctcttacagatataacatatttaattctccagatatatacaaagacacatacacatgaacaaacacaaaataaatagaagca

SEQ ID NO: 2511 - DNA, 6778 bp, Homo sapiens
gcctgttcttccacttcctcaaattcacaagagtaaaaaagacctcatagacaataaaagaggctgccagtgtcttgcatcattctagctgagcttcttcattctccttcttctccttcttccacaaagacccatatctggagaaggtgtacaactttcaaacacaagccccccaccccctgacccttggccttccctcacaccatctccttccaggggatgaatctttgggggttggtttgaggtcttagaactctgggggatattcccctgagcaaaacaaacaacgtgagatttttactcaaacagaaacaaaacatgaaggggcatcctcaaaatcctttgctaatgacctggctttcaaggcatctgtctggcctgatgagaatggacatcctggatatgctgggagaggcctgaaaaaagccacacacacagtaattgccattttatgactgtcaatgccgttactttaaatgttgtcatttttgcactggctactgatgatacagccatgctgacattcatcaccgcaaagatgatgattccagtctctggttcctttcctgagtcaggaacatttgttttctccaatttcctttcagacttaaaattgttcttatgctttttttcccacttctgtaatacagaattctgtttgttttctaaaaaagattattctataggaatctttatttgatggctaatttattttctctgtgcattcattagtataaacctgaatgttcagctggtgactgtactgttgagtgggaacccattgtttccactggtagcattgataactaagtggttactgaaatttttaccactggctggacatcttcttttggatatctgtggttttatttcatcactcttctttttattcagtaaagtgctaagggaattagtatcagggagatatggcagataattctttgcattttagtgagtttttaaaaatacaagatagaagtggattaatagcacgaataaaaaataagaatagtagatgtagcatggaaagagaataacattgcagcccccttgagaccaaattacaggtgggatctaagggagtgcaagtaaagtgggattttatgagtctaaatgatgtgatttagataaaagtgattcttaaaatgtggttattggtcacacaggaatctctgagtccttcccaagagtgaagcacatgaatatgctgatgatgaagtggggattagtaatagaaagagagctaggcaataggtttaagtgtattccccactacagatttaatttctacatgaaaaagcacgagaacagatatttaaacgtccttttattactaaggtgaaatattggcattttttcaggcagaaagaaagagactgtatgtggtcttcctggacctttgccttgccaaaatgttccccaacagaaagatctgaagaactttgtagtatcgaatgcacaacagcatgctgatatttgaacagatttcttctgtcagctttacattttgccttggagaaacacttagatttttctgttgtgctccctgtgttcataacaatgacctcaccacataatgtggccagaaattcaaatgacttcaggggcctagcaggtcaagtaaatgaataaagcaagccatgtaatatcacagtcattgtggtaaatggcaattcatagtgggcctttgtatcagcaagacaggaaggagcaatggggactgtgagaaattggagagggtgggtgctgtcaaaacagggtagttggtaggcagcaactgaatttgagctgtgtggggatgggggtcctagatacctaggatttgatataagctctctccaaatttttacatattgacaactaactcaaaaacttacaaacactgtgctaatcaaatgaaacatgcctgtgagctgcattcaatccatggggcattggtttgcaagctatgttcttagaggtggtatgattttgtattgaaattaaatataaccaagagtatgtcaatttttgaccttggaacctggaccttttacctcatttatattctgtatttttgtatgtggggctttttggccagtcaaaatagaaagtctacagcttccattttataatctaacaagcaacaagaaacaacatttgaaaaagaaacaggaatatagccattttttctagcaccaataaaaatggaaatgtttttcatttgctttaagtcattaatcagctgaaaaagaatagaaagagaatttcattccataaagaacttcacctaaaactctcagtgaagcaaaacaaaactccatgtaactcactcttagctttaaatctttaaaaagtgtttcgaagggatattgagtaaaaatgcagttatctattaaaaatacaaaatgctatattatatgatgctatgaattgatactggagctgataaaacattaaagtaattattccaaatcagtgctgactgcaaaagcaatatttccaaagctctagcttattttctgcggtcttttaattcccttgaaatagctttcttcaagttgagcagcaatttgggacaaacattattctattgcacagattatggcatcttactctggtttacacacacagagcaagggcttacacacctgaattaagaattaactagcatgtggggacagcaatagggatagtcctaccacagacgaaaccatgcgctctacacgtccctggataaaatgtgacaagttagcccttgaatttgggtccccatgtcaccaaatagctctatatttaagttgtgttaatgtggtacgtttcagtggcataatgacccattcttatcgaggcctttgttccatattttatttgtgccaatctttcttaggttatgagccctaatagtttatggcagcagacaagagactcatttctaacccattaaattcaaatggactttcttccactgtccatttcatttttggagctgttataaactaccgaaaacatttgacaggatcccattgtggatctgatacacttaaacagtaaaatgatatctaaacatctgaaagccaaagaataacctagtgcacgtgttcattcatttgtagaatttaagccattgtattatattttccacttggaaccatgcctttagatacaaaagtgtaaagtaaaaagcaacattatcatgggatgtgagacggtaatccaaaagttgaagaccaatttttgttatccatattttggaagtatggatactgtttattttaatatcacttctctcatgggtcacttttccttagataggtaggtaggtagatagatagatagatagatgatagatagatagatagatagatagatagatagatagatagatagatagatagatagatagataatataatatattttcttctttcttaacctatgagcagagactttgatgatggaaattactttgtaacattccccatggagcctaggaaaaacaatagaaaaaaagcatgaaatctttttctcatagtgaaatagagaagattctaagattggaaatctgtgtatgtggtgttctatcccaaataaagagaatttagggaattcaggcaacaatttttttcctaattggaaactttgttctgatcctgagatgcccacacaccccacaggagacgcagtgctggcccaccacagtgtttggaacacggtcagcattcaggaaacacattcaaaatcgtctaactgaattccactatccacttgtgaatgcaaacaaaattcaaatttccctgaaaatttattcaacttctatatgccaagcacactgctaaaggcttatcttctaagtatatgcaggcataccctactcacacaaatagcttattaccagagataggaaattgcaggtaatttgggagaaattgtcatagccaaatttatggaaaaaataaaataaaaacttctctatggcctcttgatttaagaaaaaaacagaacaatacaaaaaaaaaaaagcactaaaacaggatttatctgagaatgtctttccaaaagggaagatgacaccaatctatataaaacgtcagtggatttactgagaatccgagtggaaacttttaaaaccttaaacagactctcctacagcaaatagattctctatgtgcagcatgaggaatcactgcatagttctgctccaccaataatatgattggtacagcaccaaaccatggcaaagttagatgttaaagaacataatgttgcaataatgatgttatattggatcttatgcatgaacaaatggaaagtaataatttatcaactgtgatccatgattaaaggcctcattatcactaagaaaatgaacttaatgaaaaaaattataatgagcaatgacaatattcctataaaacctccctctgggtatcaagagacatattacctgccaaggccagattttactttttaaggtttcctctctctcaccaaagacactagtgggcacagaggtgacactagagttagaatgttaccagagtcatttgcattagacagtttatctgatcatgaacatgttcccagggagattagaaaaatgggaagcaggcctctaaagatcctccttggacatttgtaaaaaggctggctgcttctccaggaatgtctgaattaagcaagaattgtgccactgaaatagcttcttgtttttatattaaacaaggaacgattgtgcagtggatgacctggactgaaagatgtatgatggtcaagtttaaacatattaattcctgattgttttcttaaatacccaccctagtcattttttggaaaatattgccagacatatttgacatgaattcatgtttattctggcttctgttcccaagcagaagtggattaaccctggcaatggctggcttcactaactgtacttgcacccagcctgggctgccatctgctcagccaggagaagcagggagtggggtgtgggccctttaagttcgctcagggcacactcattcagtctcccctgaggagaccttgtccccctttgtggggtgaatgctggctgttgcaggccagaggcagtgccaactggagactcatcctctcagctttggtcagcttcagccacgtattcttcatgagtgctggcttctgaacctgcaggatcatttctcagtcagtttatggtgcagggtaattcatttaaaataaagcccattaaaaccccatggctatagaatgggttttaaatagattgtcctggagacacatcattgtatagtctttgcttccctctcatgacctatcttggagtagaatttgtgtactactgtccttgtctttgagtgggtatatgtgtgatggtacagaaatacagtcacatattatattaatatatatagatggataggaaaaacctacagccataggtattgtccaataactgattctagaggtagaactatagagtatacatttccttttttcttgctttgatgatatttttatacaattttatatgctataaaattttcaaaaatatatttgctattttcatttgtagagcttggttaggtttttatcagctcttgtgcccactgtacaaccagattcccctcatctaatttaaatgtcttccctttttcaaactctcctttatgttttcctttttttttcctcccatttttctacccttcacaaattccttcttttgcttctgtccaggtaacccattctgcttgcagtatcattttagcacgtacaaacacaaaataatgggaaaaataaaagcaccttgttccatgcaattcgtatgggaaagttttgggtgtcaaaggtcgctggggatagatggggaggcagaaatagcttgggaaaaggaagcaggaaaaaaggaaatctttatgggaaatcaattacccaaagcaaggtgagtcacctagaggtgaatatgatgttgttattgtcctcccttagtgtacagcacagtttttgctctcacagggtttttctctttaggatgcgtagcaccctatgcattaaatacatagcatcctaaagacaccctactcaccttgagtctgtaggctctttcctgatgagggcactggccatatatgaatggaaaactcaactcatctcctcagctttagatgttgctgctgttcagctggatttgtgagaaatatctggattactatcaagaacatttagcaagactcaaaagagagaggcaagcagaaccaaaacccaaacctcaaccaatgactagctgaataaacaattctttggaggaataaggaaggtatttctggatgtattctgagaatgctcttccaaaagggaagatggtaataatggacttgttttgatttcatggttgtgatagaatgtacttccatgatgtgaaatacacttctggcagataaaatgcaggttgtaatttgcatttgtacatcacagggtaaaagaatggccatccattctgaggaagagtgttctgttctctaagatgctgcttaaccaatgttatccaaatgccatagcatcatatctccaaatacaagattaaatcataaggattcatgtaaaacagagtatactgagctgttctcagaaaaattaatgatgtgtttattgtaaatctttattgcacagatgagcctgacagtccttcaatgtataattttcccccagcatctagtaatgcataagtacttgtatgttcttctgattaccaaataaaaacaatgagttaacctcttaattggaattggaaaaatgaaaa

SEQ ID NO: 2512 - DNA, 363 bp, Homo sapiens
ggtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtg

SEQ ID NO: 2513 - DNA, 3009 bp, Homo sapiens
caacattctttgacaattttattagttcttggaatccaaaacactgaggcctgagacatccaagtggagacacagctaaggccgggattatctgtgtggtgttggaggcccttcgcaagtgcttaacagagcccctccactggctgctgcaccctctgagtaaacatccatcagactgagtgaatggaatgcaatttagatgagttccttctgaaaagctgtcagagagactgtgaaatgtgactactttgattgactctcctactttctctctccccaaataagccagattggcaggattcaaaggagacataaaattagttattattggctgattcagcaataaagccaggaagcaagatctgctaagtggaaagtattctgggactaggaatgagaaattatgattataaggcaaggcttaactagctgaggaagtttctccatgccggcagctgataaactgctttgtaactggataaaatgttggtcttagtcaggctccatgtcatcagaagatccataagttgcagaaatttgagcagttggaaactaaattgatattgatgatttgaaaacattatcagaagaaagtaaaaagtagaaattaaggaaataaggataacaaaaggaacacttcagagacccaactcgaatgtttggacttagaaagtattatagcatttaaaataccagtattaagagttattttcagaaatgctctaaggaatgtttctattctatgtgcatccctgtgcccttgtgttaggggttgaattgtgtctacctctccaagaaaaaaaataaattgaagtcctaacatccagtacctgtgaatgtgacctcatttagaaatgagtctttgcagatgtaatcaagtaaagaagaggtcattaagtggactctaatccaatatgactgatatccttctaggaagaggaaaaatgccatgtgaagatggaaatataccataggatgacagaggaagagattggaatgatgcagttgcaagccaaggcatagcaagatttgatgtttatcactggaggctgggaagaagcaaggagagattctacccagagtctcagagcaaccatggccatgatgacaacttgattttggatttttggcctccagaactatgagagaataaatttcttgtgttttaagctattcagtttgtgatacttagtaggggcatccctaggaaactaatacaatttatttatctctttcttatatcatcacatcacttaaccagcaaacttttattaaacatctactctgcataggtaattctgccccttcatttcacagctttgagaatcacactcttaacacaaaatttgtcacttagaagatttacaagtaagaagagacagcacagcacaggatactttgctttatcttttttccctcaattgtactgaagacattcccagtagtgccatctttgagaaagaatgatacatatagatgaatattttccagcatttatgggtttttggctcaaaggtgtgctaaaagtgtcaagttgctagaagatctctagataaatggtatgcacgatgctaggcttaaaaggcatgtttagtgataagcccaacaccacctgttatcattaacatgacaccagagttagaaggtataaaaggttctcagctgcatgtagagatttactaggatttactaccatccccaccaaaaccagatctgcttcaaggtttggttgttgtggggcaaaacaatttcgagacaattgctgaaaatttgattggcatggtcttttagggcacattagtgtgttgtgatgagaatgactttgaaaacccttggaaagttataaactgttcacaaaaggaaggaaaagaggaatatatataccttctaatactttactgattctgtttgtgtctcttctattcacaaaataaaaatttggaagagattcagatgatcttttaagtccctatgttgattttggttttttaaggagaggaaaggtacttggaagcagtaacctgtgtcaggagaacacttatcaccacccctagatatgacacctgaaacacagactaatgcaaggggacaggtggtagagaaggttgtttgaaagaagcgattgtgaccttccagatgcagaatttcgggacataaagatgtcatatagaagaagaaagcttaggatcctggagcatgccttagaggttctgcagcagtggcaggtggtactgaatccagaataggcaacagttagggatgactgagtccatgattcagacatggagatcatcatacttgcaagggaaatatttaagggattgtgtttgaatatttatgtaatactcatcatcataaaaaacacaggcaagtgtaacacccacagtcttataaagcagttacacaatcaagactgcaaaaacaattaggtaacaattaacattatgctatgaagaaaatttcacatatcaacactaaccttaaacataaacaaactaaatggtccacataaaatatataggctgctggaaaatattaaaaaatcaaaatccaaccattggctgcatacaggaaacccacctaactgataaatacacttacagattcaaagtaaaggagtggaaaaagttattccacacaaatggaaaggaaaagtaagcaggggtagctatacttttatcagataaaacagaatctaaatccactacaggtttttttttaaaaggccattatgtcatgataaagaatcagttaaacaagaagatataacgactctaaattatatgcatccaacactggagcacccagattcataaaacaaatactactagacctaagaaaaaaatagaaggcaatgcaataatagtacgatcttcagtatcaaactgacagcactagagaaatcaccaaggcagaaaatcagcaaagaaactctggatttaaattgtaccctggacctaaaagacctaacacacatttaaagaacattctatcctattactacaggac

SEQ ID NO: 2514 - DNA, 762 bp, Homo sapiens
tctatttttaaccctaatcctttcctttgctgtggttatggccctgagtccttaaattataggctctcctgcagtttcaaaaagctaattcacactactgtgtgcattagaaaggtggtatatatgatattccactaagggaaaccctaggaacattaaactcctactagtaactggtcacgagtcagggctagaactgacactagtcatttttcttcactgacaagttttcattatgtggctttcccagaacaatttagaaattgatctgcaactgatggaagctgggatgaattgggcgcataagtgaacccaaagcatcagagcaaagtcaaagcgaacatctggctccagctttgagtacaaggagagatttgtgtatgattgagagcaaggaaaaaaggctttgaaggggaattcaaatattgaagacacaagagaaaaaataaataataaaatactgtgatctctttgaaattgagaatgaagtgaaatgaaagaaatataaaaagctagtttggccctgtaggaaagatgatctgttcttcctctgacacagaaaggaaggaagaaagaacatgctggaagcagagcaaagaagagagacttgtgtttccatggaataatcttgggatccatgtggagtgcaagagattggaacagaaggagttctcaaaaaataaaaacttcgggcgggtgcggtggctcacgcctgtaatcccaggactttgggaggccgaggtgggcggatcacgaggtcag

SEQ ID NO: 2515 - DNA, 388 bp, Homo sapiens
cgggagtgcccacacctgatgtctggggtttgggcttcacacacaaggaggagcctgacctgcagatgctctgctactgcacctccagatttttttgcctttgtcttcatgttggaggggaggttcggggattcagataatcaagtaatacaaggtaattgaagataatcgaggaaatgaaagaaaatgaaaattagtcgtgccctgtcattcgattattcagctttaactagcatcaacattctggaatgttgctttacttttatgtttatggttgtatttatatattaaacatctattcataatatgtcatgtacaatttttgaaactctagccttacatttttttctctggatttttttttgagactgggtctcgctctgttgcc

SEQ ID NO: 2516 - DNA, 8191 bp, Homo sapiens
tgacaagataaatgaggccctatcagccagcaataagtaccacactgagcactgagacagggtaatgagatctggcattgctgggtggctgctttccattggatggtcagggaggcttcttggaggaacaggatttaacttgaggccaaaacggcacaagggtagagccatataaaactaaggagaaaccattttaggatgagggaacaaaccctgaaggtgtgaacaagctcggtgcatctagacatgtaaggaaggttccagcatgtgaaggagcgaggacggagaagggtccggtgaggtcttacagcaacagagggtccagccacatgaggctgagcagccaagtgatctgcctaggccagctccccttcatcttctgccatgagtggaagcagcctgaggccctcaccagaagcagatgttggcactatgcttcttagacagcctgcaaaactgtgagccaaagaattcccttttctttataaatgacccagcctcaggtattcctctatagcaacgcagatggactaagacactcatgcttcctttcattagctatttcaagctcaaaaattgtgagactgtgccaagaattagggcaggatcttgtcattgcgaacttacaacttttctatctaaagcaaaaggtcctaatcccaaaccataattggaaaggtgcctctactccaacctcattgcccttcaactgccccttctctgcctcccattcccctcttactcaccgaaagacaaatgagtttaggctgggcacagttagccatcgttctcagaaaaacaaaatcttgctgcttggtattctcacttagaatcccttcacttagcttatggatcaccctacacagattcctgacagctcactgggccagggaaccagccagatttttgagctacatctgcagtatcttttctactcaggcagctggcataaggtgggaaaattcattaacatgctaatgatgtcctatttaaaattctagtcctgattattctgtgattaaatctctccccttgacgtcggtttcctttatagctgagttacagtgcgaaatcaacaatattaataaagtacaatacagattaccaatttatacacaagggatggtgaaaaactgctgcgtaaatctgagggctgtccttttaacttgaaaagcagttgtaggccgggcgcggtggctcacgcttgtaattccagcactttgggaggcctaagcaggtggatcacctgaggtcaggagtttgagaccagcctggccaacatggtgaaaccccgtcactactaaaaaaatataaaaattagctggcctataatcccagctacctgggaggctgaggcaggagaatcgcttgaacctgggagacggaggttgcagtgagcagagatcgcaccattacactccagcctgggtgacaagagcaaaactctgtctcaaaaaaaaaaaaaaaagcagatgtagcaaactgtaaaagttgctgatttttttcattccacccttctttaaataaacacacacattggaatccacaataattaaatgtttatagttaatttccataaatattcaaggcttggaagatagatttagcttttccttctatttcactgcacttaacattgctccgaattcaaatgtgttatcctgaagtctcaagaacagctgacaggagttaaagcacacttctttatcatctctttatagagattgtgtcttggcaacaaaagccaatggattcggtgatgaggtctgtctccctttgcccttgagtaccttggcatatttcagttccttttctatcaccgtattgttctattactgacactccaaactgaatatccaactcagacaactcaagcaccttccaagaaagacaaacttatcactaccctcattaatttggaaaatgaataaagaagcagaagattcaaggtccagatctgcaatctaaaatgcaggaagagaggactcattcatgtgtcattttaacatctggccccagtaaatgaacaaatattgatggtatagtatatttactattttaaaagacatcatgctggacaccaaagcagtacagtgaaacctaagaacaatgttctgacctcggtggactcacaatctagccagagacacaagatacaatgatattttaagtgatgcatgcagcaaattcatctcaggtgcatcattagagatacacttcacatcattaaaaggtctctgtacgagagacactgctaattgttccctaagactgcaaatctccccttttgctatggaaacagaattcatcactttagtggggcacattgctgcccagggtaaggacagctcccagcccctcttgcaagtagctgttaccatataacaaggttaaggtcacagggatgtggccgtagcagagatgtgtgcagatttctaaaagcgtacttaaaggggatagatgagctctcttccttctttgttttttttctgactggacttggacatgcatgtggctgggtcagccaggttggactgaatggcacatgttgtggggcagagaagaacaagatagaagagtctgggttcctgacaagcagggtggcttgatcatccatgagttgcctttttcccctgaacgctgcattccacaactattgttggaaatcaaaatctttttttaagaatactacatattgctcatttcttaaatggtttcattctctaaggctaaaaagagtcatggtacatgcatgcatatgtgtatgtgcataagtacactctcctttgtactttctctacatttaaacttgaacacagagctccctctgaatttttaaccctcaaaacacaaaaaaagctgaatatggactttgccccagttttatcacattttaataaataaaagcttcaatgtattcaggaattcattatttatttgtttcccacactctcaaccctagattattaatttggttcacctaaagccaactcacctcaaattggttaaaaaaaattaagcacgtgtaaatcaatgtatagggaaagggtggctgatccagcaaaatccaagtgtaaaaacataaagagaggcttcacaacagtaatgagccatctgcaatttagaatcatccatggtaacaatctctcattccatttgtttatgttttattcatcattgtgaaaatacttagtgaagtgacgatgatgagattcaaaaatactgcatggttctttttttaaaaagagatattaatggctttcaggggctcaactattcaaatgaaaatattgctggactaaatttgctcaaatttgttcacttcctcttcattcttggatataatatattcttcattttatgacaaaaaactatgtggtgaaaacatgagaaattccgtagtttccatcgtttatacatttaaaaaatcaatagcagaaacctatttcaaatgtacaatcctcattcctatcatgacagagtaaaccaggctgcggtgtcttgggtgagcgtgttgtcattccctagtactacagttatttagcctcaaacgtactgtctctagttacatatacggcaaaaacaaggcttgacctttaagaatgaaaagaaaaaaagataagtactgagctgttaagccaacttaagggtattcattacaaagaagacagaataactactgaacatactctttgattctaatatctctatgaagaaacctctctctacacaaattgatagacattttaaaagaaaatttattcatcccaaattgatgcacttaacttcagctagctgattttatatttctcaatctagcttataaatactactcttcatttacttcaatttacggagtatttacaaaagccctatttcaaatctggttcctatcagccccgttttttcttatttcttcttaaataagcatactttgtaaaatatagccatttattcatatatatatttctttcatttgttttagtaaatgacatttatttaggaaccattttttaagaaataagtttttaccatctcaatttgcactgaaccagcgtcttctgagaccatccctctgggtgcaaatctcagagtaagctcagttactcctaacgactggaaaaggaaagaacacaggaacacttgaactcctctgacaagcagacactttggctaaggcggcattcacatcttctacatcatccttcctggggaaagaagctctcagaaaagtccacacatagaagagccactttatggtcttccctcaattttctcagatcagcctgatttagtctatgattgtgcagacaaggagacggagccaagggacaaaaggaagataattgtcacacaaagaaaatgctcaagaccttgccaagggagagactgctctaaataataacaaggctattagcaaacacaggttgagacagggaacagaaaaagaaaagatgtcacatgtgaatatgaaaacaaaagctgacaagtaattccattcggtttgccaaggcacctgccaaaaatgtccccaaggaaaagggccatgtgctccatgacgctcttcacagtgacgttcacataaggcacagaacattctgcctggccacaaaacacaacaaatatcatcaatatcttgccggggaacagttgtgcactacctaccataggcagtctcctggtgctccacttctcttctcagtctgttgtaatcttctttaacacttcccagctttttgacattcctggaactcaacaccaacagcttgctgaggagtccctccagcccttctctctctgatgttaatgatctaatctcctcggtgaggtctttagccgtccagaaatggtttcctacagcacgttgtgggagagaagaagggaaaacaagctttacagcatccacacacatggaagatctagcagcagctaatgtacattcacagcatgggcaaagaaactgcactttgagattatgtacaatttccttagcagtcctctggggaaagaacctggaaaaatattgctctccttaaactggaaaaatcaccgtcttttttatcaccttattcttgttatgtccattttaggagttccattggtgaagccatctcccgtaaagtatgatgacccaaaaatgtcccagtggaatccagagaaaccacaatgtgtcactccattccaataatatacaaatgtcaaagagatgacatattatagcagtgtggaaggggactgggccatataatcagagttgacctaaattaaattcctcccctgttactcaaactgtgtgacctggagcaagaaaattagcacatctggggcaaatttcttataaaatataattgcaataacacctgactcataggtagttacaagaataaacaagaaattctgtaaagcactgagaaaaatatatgataaattaaatgtagcaagattgcaggatacaaggtcaatgtacaaacatcaatcttatgtctaaataacaaaaaactagaagatgattttttaaaaaatacaatttacaaaatattttaaatctcataatactgagggatactttctttaaatatgtgcaagagctctacagtgaaaactatttttcaaaaactgctgagacaaattaaagacaaataatttaaaagatacactgtatacatacactggaagttcaatattggtaagatttcaattttccccacattgattcattgatttaatataattccaatcaaaatgttatgaggttcttttgtagaaatttatgtgcttattctaaaacgtctaagagtgagctgggcatggtggctcacacctgtaatcccagcattttgggaggccgaggtggtgggtcccttgaggtcaggtgttcaagaccagcctggccaacatggcgaaaccctatctctactaaaaatataaaaattaatctggcacagtggtaagcacctgtaatcccagctactcaagaggctgaggcaggagaatcacttaaacccaggaggtgtaggttgcagcgagctgagatcctgccactgcactccagcttgagcaacagagtgagacttcatatctaaacaaataaaatctagaagaatgagcccatgagtttgaggctgtagtgcactatgattgcacttttgaacaggcactacactcttgtctgggcaacatagcaagtccccacctcaaagaaggagagggagaaagaagaagaaggaggaggaggaggtgaaagagggagggagggaaggaaggagaagacgaagaagaatgaagaagaataggaagaaagaagaagaaggaagaggaggaggaggatgaccaaagcaatccttaaaaagtgagtcttggtttcaagactaatgctaaagccactataaatcaaggtaatatggcattgaatatacatagacaaacagatcgatggaatagaataaacagtccaggagtggattaacacatatacagccaaccaaagtgccaaagcaagtcaatgaggaaaagaaagtattttcaataaatggtgctggaacaactagctatctacatggaaaaaatattaaccttgattcatacctcaaaccacacaaaaatttaattaaaggtggatcacaggcctacatgtaaaagttaaaactataaagcttctacaaaaaaaaaatgaatatttgattgactttggagtaggcaagaacttcagataagatacagaaaacactattttaaaaaggataaatgggctttatcaaaattaaaaacttctcatcaaaagacacaactaaaaaatgagacgacaagtcacagacttggagaaaatcattgcattatgtttaactgacaaggaattgaatactacaacttgacaattaaaacacaaatggtgccattgaaaaatggtcaaatgacttaacaggcattttacaaagtagacgcacaaatggctaataagcatatgaaaaaacatttgacatcattaatcattaagaaaagaaaaattaaaaccataaatattccactacaagcccactcaaatgtttcaaattaactcaactaaaaatgtcaacattcacaagggtatggagcaactggaactctcacgcatgtaaaatggtcccttcaagaaaagttctgccagtttctcataaagttcaatgtatacctaccctttaatccaacaattctacttccaggcatttacacaaaagaaatgaaaacatgtcatcaaaaatatttgcactcaaataaatggtcacagtgtcttatgcctgagagccagccccatactggaagcaacctaaatatccatcagcaggaagatgcaaaaataatactatagctatgcaatgaaagactactcagcaataaaaagaaacaaactcgtcatacatgcagcaacatgtatgtgtctttttctttctttcttttttttttttttgagacagagttttgttcttgttgcccaggctggagtgcagtggtacgatctcagctcactgcaacctccaccttccagtttgaaactattctcctgcctcagcctcccaagtagctaggattacaagtgcccaccaccacgcccagttaatttttgtattttttagtagagccggggtttcaccatgttggccagactgttctcaaactcctgacctcgtgatccacccacctcagccttccaaagtgctgggattacaggcgtgagccaccgcgcccagccaacatgtacatgtctttagaaaagatgcaaaagagtagtgccacatgattccattaagttctagaacagccaaaattaatccatggtagaagatatcagaacagaggagggacgatgatgactgggacaagatagggtgttgtttcttgagtgatgagactgttctatctcttggtagggctgttcgtaacacaggtgtcaaaattcaagaactgtaaacacttaagacctgtgcattccactgaatataaaccatacctcaattaaaaagaggaaaaattaagaaatttttaagcatgaacattgaacaataaataaatatataacattaatgagtgtcccataaattagttagtgttaattagaaaaccccactgtgttttctcagaatttatagtaaccataatcacaataatagctacaaactttctcacctttaaatgtcatcacaactttaggaaacag

SEQ ID NO: 2517 - DNA, 6755 bp, Homo sapiens
agcaggcactttgagggtggggaggatgagacaggaatgtgctgaccgtggtggctgagaggctacaggaggcactctttgaagggaagttaaagacaaagaggaagaggctgtatttcattctcccagatggctcctgccagcctccagagaaaaggcagctttcttctttagaaaattggcaggacaaaagaaggaagtcgacttggaaagtccagcgacagacctcgtgcccctgctctgggaggccgcaggtcaatggctccccctggcttcaggggacacagctcaagcctggaaggagcccatggccagcctgaaagccttgctcacacccagcatccgcagctggggcaagagcggctactcccaagacaggaaaagacacacagcctaactttgccactgtgaagggagacttctctctaatgcctaactagacacttatcttccaacctcctcaaaatgccttcaatagaagtcccaggaagacacggagccccagccgcccactgactcctacaggatgcagctgcgccaggcagcccatcccagggggcccaggccaaagaggggccagggtgcttcccctgagaatgaaaagggatgtcgggtagagggggagggtgatgtgggactcgctggtggctgttaaaggagctcgcgtctcggttcctgcaggaaaagtgctttgagcactcgcctggcctggtgaagaaggaaggcagttggcgggcatttttggaagctctcaccccccatgctggtcctggtaccccttctccagggatgcggggcccacattcatcacagtggggttccatagatgatggtcctgtcatatcagggttcccattgaagggggccctttttggcactttcttttattccattagtctgtttgcctggtcacacattttattgctttttcccgcaaaagaatcaatgtgggaatttatttatttatttattgagacggagtctcactctgtcacccaggctggagtgcagtggtgcaatctcagctcactgcaacctccgcctccctggttcaagcaattctcctgcctcagcttcccaagtagctggaattacaggcatctgccaccatgcccggctaattttttgtattttttgtatttttttttttttctgagatggagtctctctgtgttgcctaagctggagtacagtggcgtgatctcagctcattgcaacttctgcctcccaggttcaagcaattcttcctgcctcagcctcccaagtaggtggaattacaggtgcccactaccatgcctggctaatttttgtattttttagtagagacgggatttcaccacattggccagattggtcttgaactcctgacctcatgatccacctaccttggcctcccaaagtgctgggattacaggtgtgagccactgcacctggctgattttttatatttttagtagagacgggtttcaccatgttagccaggatggtcgcaatctcctgacctcgtgatccacccaccttggcctcccaaagtgctgggattacaggtgtgagccactgcgcccagccaggaatttatttttaaattaaatttgatttatttagtttcctaacccttttattgtttttaggcaattttttgaagtataatatgaataagaaaattatggtgaattgttacagcatcgagacctccaagaccaggacatagaacaatcccagcccccagaaacctccaccccataaggctccacaacccctcttctaacacacagattaccttcagctcttcttgaacttcatataagtgtgaaactcacccatgctgttgaacacagcactgtttcattcatgtaagcggccttatagtattccattatgtgaacgcagtttattatccgttctgttaatcacagtagtttttacctgttgtgagtaagggtgtcacaaacagcctcatgtgtactttgtggcagatggaattcttgtacagatgtggaacatacactggatttgaagtgctgggttatagagtatgcacatgctcagctttatcaaacagggcttaacagcttttcagagtggctgtgccaactcacactctccaacagtctatgggagttccagttgccccacacccttgccaccacttgcaattgtcagctgtaaattttagccattttgtcgggtgtatattggtattttattgtgtttttgatactcgttgctcccgcaatcgttgaagttgagcacggttgtatatgcttattggcaatttggatactgtctttgcgttttcaaaaattgggtttttgtcttttattgatttgtagaatttctttattctgaatttgagttcttagttgtgcttgtgtgtgtgcacatagtaaacacacacacaggttaaaataattgggagatcattagaatgagatgaccccagcgccttgggtttcaactcaagcaaaccaaagtccatctcagtgtacatggttatagttcaggtaagcagaaaccaccggctgatctctaacacggggcttttgactggaatgatttctttccctttctttctctttctttctttctctctttctctctttctttctctctttctctcttcctttctttttttctttcctatctttctgcctttctttccttccttccttccatccttccatctctttctttttcttttctctttcttttctttctctccctctctctttctttcctccctccctttcttccttccttccttctttccttccttcccttcctccttccctccttcccctccctccctaaaattcatagaataaaaaaatgcctgaatagccaaagtaatcctaagcaaaaagaacaaagctggaggaatcacattacctgacttcaaattatcttacaaggctatggtaaccaaaacagcatggtatttaggattgttttcccaattctttgaaaagcgatgttggtatcttcataggaattgcattgaatctgtagattgctttgggtagtgtggtcactttcacaatattgattcttccaatccatgatcatgggatgtatttccgttggtttgtgtcatatacaatttctttcagcagtgtttgctaggtctccttgtagagatatttcacctcttggtcaagttatttctagttattttattttactttttgcagctattgtaaaagagctcgggttcttgatttgattctcagcttggtcattgttggtgtatagcggtgctactgatttgtgtacattgattttgtaacctgagacttcactgaattcatttatcagcaattcattcatttttagaggatacttggtccatgcacatgtcagagattgttgtaatgtttctttcttgcaatgatctcatcacattttaatcacaaagtcaggctagtcttttaaataaagttgcaaagcattaatcattttttctcttctctggaagagtttgtgtaagattggtgttttttctcccacaaacgtttggaagaatggtttgctggtggagccaactggacctgaagttttctctgtgggaacattttaaataagattgttcaggactcataaatttttcttgcatcagttttggcaagttgtgtttttcagagtttgttcaatttttctaaattgtcaaatttattggcataaattgttcagcatattcttttattattaacttagtatctgtgggatctttagtgatgtctccattttcatttttgatatagttaatgttgggagaaaagctgagtgttgggagaagctgaggcagggcttgcatgtctgacataatgtaaaagagtcttggaacatgtccggggtccaggatctaaaactcctcgtggcctttggaacaccgagctctgtgctaaagagtggaagcctaccctgatgcaccataatctaagcccagggcataaaacccctcatggcttggatggaatccaggtcagaaactatgttctgtatgttttcaacaccaccaattttggggggactctttaatgatccaatgggccattagttttggtaatgttccttgtctacttggagaaattcataggctgaagtcagtcctcatgcacggggctctgtccatgctgaccaagtcaaatttgttgatcatttttcccaaacattctgctggttttctgtttgcatgagacacctttcctatctgttgggagcaggccccccaaaatctggtcataaactggccccaaaactggccataaacaaaatctctgcagcactgtgacatgttcataatggccataacgcccacactagaaggttgtgggtttacgggaatgagggcaaggaacacctggcccgcccagggtggaaaaccgcttaaaggcattcttaagccacaaacaatagcatgagcgatctgtgccttgaggatatgctcctcctgcagttaaccagcccaacctattcttttaattcgtcccatcccttcgtttcccataagggatacttttagttaatttaatatctatagaaacaatcctaatgactgatttgctgttaataaatatgtgggtaaatctctgtttcggggctctcagctctgaaggctgtgcgacccctatttcccacttcacacctctgtatttctgtgtgtgcgtctttaattcctctagcgccactgggttagggtctccccgaccgagctggtctcggcactatccttctgcctttaggcacctgcactaccgagtaccatctaaaggaacatatcatttgttttgttttatttttataatccagcatgacaatctttgtcttttagttggagtatttgtgtaatttatatgactacattaattaacgatacttctgtgcttagatttaccccattacagttttcttcattgtgacctcattagctggttttcatcttttcctgttagtttttgatgagttaatactttttcttatttttctccactaagcttttagtcatgtgcattttaaatcattctcttaatgactcctcacctgcattggtgatgtatcagacttagcacacttgctcctggatgcaagcacgttataattctttaacctcattttcctatcctggcttttgcatcatttttctgtatcctaattgtatgcatatttaattctacaatatatcattatttttattgttttcagtgggtttgcccacaagtttaccttttctattgattttcaaattttctcctattttcttgtgtttgaaaacaagatatttttggataatttgcctttggcctgaaaaagttcctttacatttattttagtgaagattagtggtgataaattccctcaaacttttcatctgaatacatcttcagttcatgtttattttcataaaaatattttaactggatataagattctaggtgagctgttatttttaaccccagaatttaaaaatacatcattcagttgtctttcagcttccattattttctgttgagaagtaaaacatcagcctatttactgtcacaatttttctcttcctttttatttttgactgtaagatgcccaggcgtggttttctttgcattcattttgcttcatgtttgcagagcttcatagatatgtggtctgatgtctttcattgattttgggaatgtcttaaccagtgtttctttaaatattcttctccctcattctctctcttcttcttctgggactccagtccatacatgtcatgcatttgcatcatgtctcatacgttgtcacgcccttttttctacttttttccttttagttttgattgcattattctttatgtgttctacctacctagcttctggttcactgatctttattctgatgttcaatcagttgctaaccccatcttttaagtactttcagttaatacagttcttagttctagtatttccatttgattttcaaaaaacaaaagacttcagttatcctgtagtattgttcatattgtcatgtgattttaactaaagttaatttaaaatcatatttggtaagtccaacatctgctcctattcagttctgtttatatttcctttttgtctcttggtgattggccttgtggtctttggcatagccagaagtttgtattttggatgctatgcatgaaaatagaagttgtggaggatgtatcttcctccagaggtgattaaacccacttgtagaggaaggtgagctcttgggtgaagggaactaaacgcccaagcaatttaaatatcacaaaagaaaaagccacaaactggaaggtgtatgacagacatctgaagcaggtgtgttagaatagacacatgacttaacatgagtaggatgctcatatttaacatgataagaaaagatgttagcggtgtgaaaaagaaaaatgtcctgaaaaaagaacaaagtggaaataatggctgtaaaaaaatacaatagttgaaagaaagaagtattttgagggtataataaaaatagtctcataagccttcagaagacttgccaacaaaacccacaatgaaaacatttatggagaaaacctcaaaatgaaaagaaaaacaaatccaggaaaagctgcaagagatatgaaaagaaagaaagaaagatgaagactaaactctcgtaaagtttgttgccatcattaaaaaaggccaggaccaaagaaatgtgcatagacaaacacacagacacatacacaccacacactacacacacatagacacacaaacacacaccac

SEQ ID NO: 2518 - DNA, 841 bp, Homo sapiens
gaccattccattaatagctttactataaatacttcatcataagacagtttggcacattctccttgttttttacatgtggtttagctctttttggaaacatgatctcttttcttcagtgctacattcatcaaatttaaaggattaaatattttattcctggaataaaatgcttttgcagggggttggccatgcaaagagaattcatgcacatagccactgcaaaccacaatcaatttttcacttaagagaacccaaacattttgctctgacccaattatccaaagtgactgtcccaatgtactagattcactaggtagctgtgactacattttccttgggttacagaactgtggccttcagtgtccttggaatcctaagggaagaattcactctacacaagataaaattttgatcaaaattctgttttgttgaaatatttttaaattgttaatatacactaaaaaaagcaaagggaccacttgacatttcaaattaaatatgaagcaaatgccgagaagcacactgtcactgcaggtgtagaagttcggactgccctcaagccatcctactgcctttgcaggccaacttcgcagctttgagtttcctttcctagtcacaaggatgcagtgagaaatggaaccgatgtcttagagaaagcctgtttggtggtctctccacatggaagcgagtgaaatttggtgccatgactcggatcgggggacctcccttgggagatcactcccctgtcctcctgctctttgctcggtgagaaagatccacctatgacctcgggtcctcagaccgaccagcccaaggaatatctcaccaattttaaatcagg

SEQ ID NO: 2519 - DNA, 1103 bp, Homo sapiens
cgtctgttctactccgctcttttgtatttttttccaaggtggcgtgagctcattatgctgattacatgattggctagtgggttaggacctgcagggctggagcacctgaagacaattcacaaacccaaaggcaaagacccaaaggcaaggcacggtgagacaaggggtggaagaaagcaagctgccctgacagttgagacagacacagataaataaacaagaacaaaagcccaggaccacaggcgggacacaggcctccccgcgaggggtttttggagattgttgggcaacggaagccaggtgactccaggccgggaaggctccatagaggtggctgcatcaccggggaggcactgactttgaactcagtggcatgaaagcatcccagaacgttcagatgtgtgcccagccctgtggctctcacgcatctcctgtgctagggggacgatctggatcagtgcctggcccatggaagactcctgacccaggcttgttcactgaatgaaggcattccacatgttctgtgatgcgggcaagtcattcattcatttatgcatttagaatgagctttgagaatatggcagcctacaaaatggacatggtcctgccttcagggagcttctggtccagcctatggcctcttgcctggaaagagatgttaccacgttattaggaggtagtgtggtgtggtaagtgctttcgtgggaaaagcagaggggattgtgggagctcagagtggggtacccaacctggatgggaggtcagagaatgccacagaatctgtttggccttcaatcactaatctgtatagttagcaatatggacaagctggtctttaataactcataccccttcatttctaattctctgtcatgtgttctatgtggttcctgagggagatctccaaccagggagacaaatgaaagaatgaggatttagctttatggaaaaaacacctaaaggtggaacagtctccaggtacacaggctgcctcacaaggtagttattggtagcagcacagtaaaatgtctaggagatcaatgacttaagccaccgactgttttgttattcttgtgattctgtggggtgacagggctcagctg

SEQ ID NO: 2520 - DNA, 6815 bp, Homo sapiens
tttgagtttatttggaaaataagttgactgttaattttcttgctctttaaaattttatagtcataagtgtcattctgtaagctttagagacatgggactctggattttgttgctagtctagcgatgtgtgttttcttacctgccggtaccatcgtgccttcatccagcaggtgccgcagggttcccggcctagagacgtgggactctttatttttgttgccagtctagtgatgtatgttttcttacctgccggtaccatcgtgccttcatccagcaggtgctgcagggttcccggcctagagacatgggattctggatttttgttgctagtctagcgatgtgtgttttcttacctgccggtaccatcgtgccttcatccagcaggtgctgcagggttcccagcctagagacatgggactctggattttgttgctagtctagcgatgtgtgttttcttacctgccagtaccatcgtgccttcatccagcaggtgctgcagggttcccagcctagagacatgggactctggattttgttgctagtctagcaatgtgtgttttcttacctgccggtaccatcgtgccttcatccagcaggtgctgcagggttcccggccatgctgtgtgcggtgtgactgcacttttcatggctcctttgtatattatgaattctagtttaccagaagtctcctctggatctaaagttaaagagaaaactctttgcacctgttctcctgtgaacagtctttctgatatggacgggttcactcattaccgctgaattgaactcctgttctggacaaggagggggcctgggccttgggatgaggctggtggggttgtgggtccgagctccaggcacaactgaggaaccatgaagaacagaacgcgatgcccatggaaaagccagtgccagggagatgctcagagccaagattctctctgaaggccccaaatggggacaggcactctctgagtggtccaaggccaagggtctgcctggggacccaggaggaaggaagccaagatgggaggctgagccggggaaggttctggagtccagagggagaggcctcctaggaagagaccctctgtgcagttcttgaaactgctgagctggcttggccacctctaatgaagataaacttcacctcacagtgaagatggaaaagtgtgcacagttcctcatgaccatgttctaaacattggtgcttattacaggaggttgaatgaatgtctgtgcaacccagaaaaaccctggaagttgctcgacccacctcctgcaacacagtagcctggcggttttcttgtgagttgcctcatgtttttaaaaactgactacaggaaggatttcttgccggtaatgacctgcgtggtgaagccacagtcagccagtctgtgggcgtgccgtttcgtgtgctgctgggccacgctgctgaggttctgatgggaccttcccacctgcgtgtgcttcagcactcaccgcacagtctgctttgcttccccaagaccttaatggaggcatttttgcaagaaaccaaataagccttcttaaatgcttgaaagcacgggatgtgtaaaatcaaaaccagctttaagcaaactaatataatttgcaatgtagccctttctattcttctagtgaagacaaacacaaattttaattcatattcatctcactttctagctcatttattgtcttctgggacagttcccaaaacaaacttcctgtggtgaagtacaggccgagtgacttgtggggcccttctgtcagtagcggccgtgcttcccacaacgcctgacgtgctgtctgcatcctattaagcgtccatgaatgtcctggatagaatgaattaaactaaccaaggataccaaacacattcagcaagaaacacaaatcttacatgagaaactgggcataaacaactcccaccacaaatcatcccaaaatgctaaatcaaacataacaataatcctttaaaatgtgtagctgggatttcaagaaagtaagaaaatctaaaaaaaaaaagagctgagaaccagagtgaccgcagtggcagcaccgggccctgggtcgtgtgcggagtcctccgtgcagccctggatgcaggggcggctgcttggaatctgaccccgggacagcaggaaaaattgccttatatgcctttgctttccacaaagaagatttttaaagtccttcccaggaatctcacgatgaatatgccctcctaaagggcaagttcctttttaccctcggtacagaagccctgagctgagactttggcgttggctgttgctgagtgggcagccctggaggtaccggacaaagcaaacaggttctgtctggagggaaatgtccaccaggcctcacaaaattcccatgggtaaactccaaacatcagctcacattccgggttgacaaactacagaaggaaaaagcaccatgaacaagaatcagccaacgacagacagtaaaattacacccaatcttcagctcaggaaatcatcaggcaccaaaaggaaataaatgcatttaaaatgttttttaaaagggggaactgggggtgaaagtgtgaaccagaaacaaggtactctaaaaagtatgggttacattagtttcccttatttggggggaaaaatggagcagatgcattaaacagcatattagacatgatgcaaagagggttctggaccaggaaggatccgtacaaagaaaccagcccaggtgcaggcagagagagggacagaaaacagggttggagaccaggattgaccaaggccagtcacaggcttagtagaggttttccagagtttttgtgaggctccaatcctcagattcaaaaagcctgaagaccctaaatacagtgaataaaaggaaataactggccagacaattgtggtgggtctggaaagttctggagacaagagatggattccgcacacgtgaggaggagtgcagcaggtgcattgttgtctggggcctacagccgttcgttcccaggagtgcatacccagccagactgcacgtgggttccagaaagcagggactggcagggtccccagccagcaaccctcactcggagcgcctggagaaggtagttcaggggaaactggacacaggaggaagaactgacaggaagaaaaagtgagcagggagaaaggcccccatgagccctgagcacagttgctgaggcggtagtgaaactggagacaggtggagtggacaccgcacagccaggagcctgtggggagatggaagccctgtgaggagtacctgcagattaaggctgcccagtgaggtaccagaaccagaacggttcacgcggctcagtgaagcctaaggccgtagtactgcacagcccagagacaggggcctgccagcacccactgagattttattcctgtgcagttctctttctgctgtttgttagtagctgcgtgtcttccttatattgttttctatgcttttggtaggtttgaaacactgttttctgactgtttagtctgaactctgatcacaagataattggtgaagagcagccattccactctgctccccatgggaatgtctcagaaaggaaattggaaaggagacagtggcctcagtcacagctgtggagacgccttcagaaccctcctcagaccctgccttctttctgaggccgtgctgttgcacccgccgtccagaagcgccactcctacaacaaacgtcacagcagccaacagcgggatctgctttctccctcacactcaggcctgtcctggccccggcaggctttgtcgtgggtgccagggctgtctgcgctgacttcagaattgaacaagagaacagacaacccacttctaaacacacacgctgtggaacacagaaggctggccgtgtgggaaccctcttcctgcattgagccctcgctgttggctaattagaaatgggtcacggctgctgatggtgttctaggggaaagagcactgggtttggggtcagatggctttgccattaatgctgagtgtgcttgatttctctgacagattttaattagttctattccccttaaaggaaaaacatgtgaaaagagaggggctgtttttttaaaaggccttgagtcccaaaggcaagaaccctggggctgggctgactctcccctcacggaagtgaggacctgctgctttgggtcttggcacactgtctacacactgttggggcagggttagtaatactcgtatctaaggccaggttctaggacgtgcttgatattttcagtaaacacaccactggcctcagtgtttttaaatttctgagccggttgctgttcacttctggagttgggtatgggcagctccccagcggttagcatgcaggagccgcagcctggattgctcaagaaggacctctgcagagaggggctagcggcccccgcagcacctgcccttcctgccctgacagtggctctgcccagccacaaaccattgcaagtgacagcagcaaagtacctgcttcctttaggcaagcccaagtgatagccttgaacctatgagattatctttcacccttctccttggcctcgacaggatcttggttccggggaaagaacttgaaggtctttcaaatccttctttccaacatcagtgctggaattaacttctgctgtgaccgagccactccctggaattgcagctgttagtttaggccctttctgatcatgaacacttcctgctggattattctttctttctagtaggaaatcatggtgtttttagaatcctgtaatgatcagagctattgtacattcttcagatttaatatacccacattgagcagagcattttcttgttgcgaggaaatctgaaagcattgagctcatgggatgagtgtagcttccaggtgtcaggccggcgccagctcctcatgcacgctgggttctgggccgttggtggaaaggttagtgctgttcaaatagatcatgctttataagttctgggcattgcccatggacctgcccccacacacctggaatccagagctctgtgttgggaataaatcctatagctgcacagcagaggtgatgactttcaaatgggtcagagcatccgtttggctgccctttatgtgagactggaaaatacacacatgcaaatgttgattaacagagggaaggtgctcgtgtgggtgaatggtggtcgtatggtctctgtgccaacagaactgtctacgctgatgggaacgttctttatctgagctttgtcgagtgtggcagccactggccacatgtgaccgtgagcaccaaaatatggctggtgcaactgagtcactggcgtgtcaattttacgtaagtttaattaacttcgatctcagtatccgcacatggcaggcacgtgctggagagcgccagtgcccactcacaggagagttccactcagtgtggatcttggttttcctactgaggtttaacaaggcaaaaaaatcccccttctaaaactgtattaatacattagtttcccagatcaaaattgatgtcaaccttgattacctgaactatttgaggagttatactaacaaatttagttttcttgctaagtatttatcagtattgtctttctaaaatgtgttagcccaccactgaggctttgtaagtagtaatgagcatagggaaacttgccttgaaatatcatcactgagctctagttcttgcaccacaaagatgcagggagtggaagcaattcagacaaatctgcttggtccaccaagccatcccagagcagaggctgtccaactaggccaagtggcctcccagaatgccatggaagggttcaggagcaattatcctggaatccacgggatggtgccctgaatcccacagaatgctgcaggagcaggcatcctggaatcccacagatggtgcgggaacaggcatcctggaatcccatggacgctgcaggatcaggcatcctggaatcccttggacgctgcaggagcaggcatcctagaatcccacggatggtgtgggaacaggcatcctggaatcccacagacgttgtggaagcaggcatcctggaatcccacggacgctgcaggaacaggcatcctggaatcccgcggacgctgcggagcaggcatcgtggaatcccatggacagtgcgggagcaggcccctaaaggaaaacctaccccagcagccctcttttaatctctaacacatgttgggttaaatgaatttgcttcacctgcgttttctgtctcaggggaggtcaaacctcacagctctgtgctctgtgtggcttctttcattccctaaacgcaatgtgtgggtcagccctgagcactctgtagtggacactgtggtcgagaacgtaactacacgtgggccacgggccacagaaaaccagggtactttctgggcggagggtttctgagaccggaggagcaaagcactttcaataactgtgtccctgatgtcttctcgtttcctgtgcgatctcaagttctaaaaccttagtgttgaaaaattttcctggtcaatctgatggtctttttatggggatttgagttcataaaaaatgttattgtacatgcaaggaacagtgtgtcgattcagggttcaaacaggacactgctggcacacgccaaggataaaactgaaaagagcttaaacgcagagaatccttacagaggtctgggcagtcacggagccctgtgagaactgtgcagcctccactctccagccacgggaagccggaaccctggccagaggggcagggaagggacccgagacaccagggcttgacgtatttgagcagccacggagggccagagcctggg

SEQ ID NO: 2521 - DNA, 3905 bp, Homo sapiens
cgagaggtaaatagtcttaaatcggaagggagctgcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtcttttttttttttttcaaacaatgcttctttttgacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacactatttgattgcacttaattggcaaaatttaagatgatctctagaaagcatatgttaagtccatgaaaagaaaaaaaaggtgtgtaaggacatttactttctaaagctaagtcataacaagcatagacaaagcaccccaaatgtttctctgaatgtaatgtttaggatctctgcgctaggtcgtttaccgctatttatttttatg

SEQ ID NO: 2522 - DNA, 3585 bp, Homo sapiens
aaaccacttaggagtctataatatgatgtttgcttttaaagcgataagacactcaacgagaaatgacagaaaaacaaggtgtggatggagaggcaacatgaaagtggatcaaacaacttatacatgggtgctggctcagacgtgacacctgaggctccagaactggaagtttatgccgtcaagttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaacaaaccgaagctacatgccaatgataggtgcaaagaatattggcaaaaggtgctttaccttgagccattatttgtgtcagagaacaaaagaaacagaatcaatatataaaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagagttctttgctttcattaacttggattcatttaaaaattaatcttccctgttaggctgatttcagattctctaggaaatctgtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaattaaaaaaaaaaaaaggaatgtgttttcattgttttaagtttttcttctgagtaaaacaaaattatagaaaacaaatgcaacaatgtgcacatctgacttaagagtttcatttctgttattatatgtgttgcatgtagcttggcgatttactgtgtaatgaataatagactggaacatctaccaataactttcacataaatgttcaaaatagaagtgtattttttcaggtttctggaaataaatagtaaaataaatggcacaaatagtttcaataaatttaccaatttgagtgttttcagctctatttcaaaactcataactaatcttcagaattactgaatttccttttgaactgggtaaggcattatccaagcaacttcacatactatttaaacatgatttctcggtaattatatattctgggcaaataacataaacatgtcaggatttttacaggtgttagtgaatttttctaaaaagatgagacaaaagcaaaaatatcacacataggtttttatgactatgaatacaaagataatgctgattcacaattagctatgggtaagtccaaaacatcagaccttttactgatgggttaactaggtgaaagaaatgggcccttatttttttttttccctagaggcagaaagttacttctaatgatctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtttttcaagagtgattatttttagaaggaccatataaaacttgaaacgcttgaacctaaac

SEQ ID NO: 2523 - DNA, 4671 bp, Homo sapiens
acaacagctgcttcagtgtatccactgagcatcttctctgtgcagctttaagcttttggtggagaggcaggtggaaagaaagccccacctttagcaggcatggtgtggatagaaaaaatgcaaataatagtattattgatttttccactgttatgaatgaaatggagaaaggaatgctttgggtggatcagggagggctctgaggaggaggtaactcctgaactggttctgaatgatggtgcaatctgcagaaacaggctgatggtgaggaatgtctcttttaggcacttactactaataaagacgatgataatattctcttcagagattctgcaaatgcgacaagcctcccaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaata

SEQ ID NO: 2524 - DNA, 429 bp, Homo sapiens
tctctgcaaatctgagagctcagtctctcttctcacttcctcttataatggaaattgggaaatccaaagaagaagaaggacttttgtgaaatgagtctattctactttaccttctcgccaaatgattcttgaaggtggtgtagacatgaatctctacatacgataaaatttcatagacctaaagacctacgcacgtgagtacatgtaagacttgggaaatctgaataattagttagttatattaatgtcaatctcctagtttgtgattttacattacagttttgtaagatgtttctttgtggggaaattaagtaaagggtatgtgggatctctctgtattacttattatacctgtgtgagtgaatctactttttaatcaaaataaaacatttaattttaaaaaaagaaaaagctaaccaacatcaagag

SEQ ID NO: 2525 - DNA, 618 bp, Homo sapiens
gcattgtgttcttccaattacaggcatggccgaggagggctgggcgccgaatcacttgaaagatcagcaggctcagctgagaaattcatagaaaaaagagaactgactgctcaggtgacatggaggtagatcccaggaaggaaggaagggagagcaggaaagaaattgcctgggggttgaagagctaccgaagagaaactacccagccacgaaaccacatttattgagctcgaccataagagaacaggtggtagtgaaatgaaaattgtaacttttctcttgaacttgaaatcaatttgtagttatatatatttattgattaattcaaaggaatgactgaatgaacaaatgttttcccatccatttattcattgatgctatagcaatgtacaatttttggtctggaagatctgtggatcatccagcttaatctgtttccctagttctcttccctgccagacacccctgtccctgccccttccagagatgaggaaactgaagcccagagaggtcaggtgacttgcgcaaggtcctactaattagcagcagctttgggactggaacccaggtgtcctgacaccaagttccctgttgttctatatttacattgttggaaac

SEQ ID NO: 2526 - DNA, 7268 bp, Homo sapiens
gagttcaagaccagcctggccaggatggtgaaaccccgtctctactaaaaatacaaaaattagccaggcatggtggcgggcgcctgtaatcccagctattcgggaggctgaggcaaagaattgcctgaacccgggaggtggaggttgcagtgagccaagatcgtgccactgcactccagccttggcaatagactgagactctgtctcaaaaaaaaaaagttgttttatttaactaaagttcaaaactcactcaaaagaagcctagaaagattgacatcacatgttgcaaattgaattccttgtaatcaaaaggatgacaaattagtaaattcttaaaagcaaacagggcttctaactacttctttaccaggaactgagtaatgtatcaatctaataaccaatgcatttacttataggaatacaaaggaaaagattgccatttcagcattttagaacaggaagcagaactagcaacagttatttgaaaatatacaaaaaactggtttgaagtcaatgaatatgtatccaattaaattgctatagttcaacttctctctgatttatggtagtatgccaagtttctcctagtcacccttcgaaaataaagaattgaggttttaatacaaaagatatgagtttcatagggtgataacctatagaacctcctactactgagttaaattatccatctgctatagcaacatggcagatagtggatcatcatctcaggcacaaaatatagggagggtgcttgaaaacttcaaaaatgaaaaaaaaatacccgtcttttcaggatgttcaacatcatcaatagatgactttttgtagacttttgttttgtaattatgaatctatgagtgtggtatttaggtagggtgatgaggttgcgggatggatagagagactgacgttaggaatcaaattcataaagaacataaagcaacgtcaaaggtaaaatggcaggtaagagggattcagatggtggccttgccccctgaaggctctgtgacaggatccttcctaaacctcagcttcttcatcggtaaaacagagattccagtggagccagtaccacagtggtccagaggatgagatgactaaagtatgtcaagtcttagcacagtgcttagttctcaagtgcttgagaaacaaaaagaaagagataagtctttgttactaaaaagagggtgacttcgtacaagggatcattccttttcttcaaagaaaacattaaatccacaatagctgtagctcatctgtgcatacagaaatctgtgcccaagaaatacatactgaatatacacagtaaagagcaatggaggaagaaatctgcaaagaacttatatttaaacctctaaggatctatatgaaagataatgtgaataatagaatttggttttattaattccaggcaagttctaatgatcatgacaacatattttcaaatcataggaatgatactaaaacataaagcattaggctgaagttatgcagttaactgagggtggtaccactcctacctgggggcattgaaaaatgggggtgggaagaagagttggatgcaggcaatgaccagggatgtgaaatgttctgcaatacatgatagggtccccatgcaaaaaataatcccctcacccaaaacatggcaaacaggctcttctttaagatcatgaagttccacttaccatcactcttagcttaatcttcaggacattatatgagcgtgtgtgagtacatgtgtctaccaacattatcaaagcccagagtccatatgaaatgtacaaagagactctaatacgcactgattagtaagaataatctacaaagcagaaaatctggcagatatttaagagacacatgtacccaccctattacatagagtcaagtttctgctctaaatgaattagcatgttaaaaaaaactgcctgttgcaatttggtatgaaatataattgaaaacatcattgtatttccacccagggggtaagtgacttacgtattttaagggagtatagaaacaagtagagagacaagtgaaaaaagatgtaacaatagtagggacttttaaaaatatatatggataaaagtgggaaaaggagatcaaaagtagctgagagcaagaaaataaatgaacaaagtataaattgaattgtggaaattcacatacaaggggctagagttaaaagggacctcagtagccacagggactatctaattcatctctggaccatgagggcctgccacagcgcctagcatatcgtaagtactcaataaatgcttgtggaaaggatggatggatgggtggatggatggatggatggatggatggatggatggatagaaatgcaacttcaagatctggttctacagtattacatatgaagcaactgagactcagataaaattcagtgagttgctgaagactattcactcattgagcctcacattctgatgctatatatatcaggtgctatgcagatgattagggaagggcaggactgagattaaactgacaccccctacatcctaatccaggctttttccactgtatggcgatgcctcccaaaagaattatcacagcgacttaataaaggagggagaaagttagctgcaaatttcaagcttagaaattcacaggcaaaaatggctgaagggaaataatcacactaatagtgatgcaaggatgtaactggaaaggaaaaaatggagagaaattaaaaacacaaacagatttagtcagggtcctgataaagtgataatgtaatcaataaggcaaatcaaagataaatgattagagatttaaaacctcagcctatcagaaaaacctgagggaaaagattttgaattttttttatttcttccaaaagatcctatttgacatttttttttaaatctaaatgaccaaagatttcgaatttggaaaggcagacacatatctatttcccatataaacatctacatttcttgccacatagcaccgcaacactcatctggttccaaagcagacggcttggccctctgttatcaagagcactatcaccgttctggcccggagagctaagttttcttatacataggtcgtagccaaagctcagaggaaagaagtgacatttggtgagtgtacaggatatgttctccagccactttttaggtgctaagttacatcttgaaataatgtcagaaattggaagatgccgtatttaaacttcactagcccaagccctaattcacctcgacagtttaatatcttaatgtttcttaaaatttgaggactcttagaatgacccctttaaaaatctgctgaaaaactggatctttttgtgggaaaaactgtccatacctacatatctaaaatgtgtatgtggtttcagtctctcctgtgcacagtccctcctgctttgaagggatccccaacatgtttttttcctagaggtagttggtcacaaccatcggataacatgcttatcacctgggtgataaaatattctggacaccaaaccccgatgacatgcaatttacctatataaagaacctgcacatgtattcctgaacctaaaataaaaagttgtaaaaaataataatacaagtaaaagagctttctgcatgtgttataaatctgttcaggaggactttccactatgctttcaagagaagtgtcttgaagaatttagcatcactctgaattcccaaaaagctctgtgcttttcaaggtgcttttgaggaagaaggatgatgcttcaactgtcttctttgctgtgacttctaggaagttcattatcacatcatattctcaaccaaataattaacacttgacattggcattttcttctgtctttgtttttaaattttattgttgtttgctaattttattgtttttatctttgttgtatgtattgtcccggctctccatttcctccctctccctgccaataaaagagacccatagattttattcttttgttctactttttcatcagtttcttctacatatatctgacatatatggaaaaaagaattactgcctatatatgcagaacttgtaactcacaggatttctaaactaaaagacttttcttaataggtgtgaagtgaaattctgcaagtagctgcatctgggaacttcagagttaaaccgatatctcagtataatctgtcactgctatagtttcttttctttgacctccaaaccttatgttgaaatttgacccccaatgttgaaggtagagcctaatgggaggtgtctgggtctgggggcagatccctcaagaatagcttggtcatcaatgagtgagttctcactctattagtttctgggagagctggttgttaaaaagagtgtgtcatgtcccttctctctctttttgcttcctctctcaccagtgatctgcctaggccagctccccttcatcttctgccatgagtggaagcagcctgaggccctcaccagaagcagatgttggcactatgcttcttagacagcctgcaaaactctgggaaagcggaaatctggagaactaaaatatcttgctgaagatcacaatgcagtaaagcatagggcaagtttccaactcgaacatcaccccagaacacttccttttaaacataaattatgttgctaacttttttattgttacttagcaggcagatttcaaactgatacaaatgttgaaaatgatacaaaatgttttcccaccttaaaggcattctgaaacctagcacataacatctgtcactgaagtccatagtttccaatgccatgattggataaagaccctattgagactcatgtgtttgtctctcactgcttaaaacactcatgtgttttaagcaacatgacaagcacaaaagagaacaagtactgctcctgctctccaggaagttaccataaaataaaggggataaggtgccttccaaagaaaaaacaaatactaggagaggtcagaggagaagagagattattccagaaggagagactgaggcagatttcaggagggaagaatataagagtcccaaaagaagaaacaggaacccaggttagagagcaatgggcaaggggtaggaggtgagactaaactcacaaggaagttgcttcaaaacaatagtgccccaaatgccaagctgatgggttggacccatttaggaaaaacccacaaagtccacaggagagcagactgcacttccatgagcttcaagctgtaaacagtaacctcaaataaaacttttcccggatcggtaatttccatcctgaacaatggccaagtcaaggaagctgaggatcgagccccctaccgcatgccacaaagaacctcaagggaccccatgctctggggagctcgcaggaggaccagcacagaggtgtgactgcgttggggcagggtggccacatgtacaatgttgtaccttccaatgttcctccttaggctgtgcttatgaagtcccaacatgtcttctgggctgtgttttcaaccaagagagttaataaaaagtgggatgggcaccaactatgcctccagagacatcaggcagaatatgccacagcgtgccatgtcctcctgcaaacagtcagaaagaaaagatctctaaaagcagattggaagagactatatatacagagcgagtgccggtacagaagttttgctgcaaatacaccctctaatcccttgcaacccactgcaagctcgagagaccagtgcccttggtaaaacataggagagatcattaattaaagcctaggccctttctttgatcctgagggataaggcttgggaaaatgcacagtgataaaagtgaacattttaaaagagcagagtgagtgtgaattcccaaagagaccattcatatcaagacccaagccatgagaaaatgctacaatgcccttgatcaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttgtgaaggtcacagagtttcagagttctaagatcccatgcgagattgctgaacttgaacttgtttcttctgatctcatgtcaataagtgacttagtcaacacctgggtagaaatcatcactaaagtgagaaagcacatggtgagggggatgaatcctgtgcccacatggtccctttcacctgcccaatcctcaggcctctcacctggggtacccctcacacacatggcactttcctgaactcatggacatttcagtttgtaacgatcctcctaagattatctactttcacctatccacatttgaactatacttctttagtggaaaaaaagaaataaagccagt

SEQ ID NO: 2527 - DNA, 15160 bp, Homo sapiens
aatttttccatagacttgattgaggattgttgcaaactttacaaaaagatacactgcaacaacagattaaagaaattacaaaaaatatagctatacccctatttaaaaatacaacattatacatcacacagcattttctttgtgcaaaatgtttaagggaatgctgtgttaggcatgtcaagcatatttgcttagagggaagtaaactttaatacagttactttgcataatagtataggcatagctaaaataatggatttttccccctagaagttaatatatcttagagttcaacattttacttttattttgtaggattgaaagctaaacttagctttatacaaatatatgtgtgtgtgtgtgtgtgtgtgtgtgtgtatatatatatatgtatgaaaacaactatctgatttcacattgaacaaatccccaacgtatttacagtattttcagagaatgtgttctccaaatcagtctgtgtacattttctctattaaacaactctttagaaaattaaactaagccaacatctgttgattaatggacatcctctgttgagacttccagttttcgctgtgggacaaagagagttcctaaggaggttttattagcaccctcaaaatccatgcaggatgagctggttggcttggtgggtccacctggggtacggaagaaactttcggccactaattgtgaccctttgggtgtcacaggaacaggctgattggaaagagaagaatggacaaaagaagtcaaccacacacaggtacatagtcttaccagacttggaagattgggctggatgaatgtattgcacattgggaaactggcgtatcttgaaattggcgagggaagctttggagaaatggcttgagaaagacatgttgaagaggaaaaatacgttaaggcttgccaatcagctgactgcagcagcagcagcagcagcagcagcagcagtgatgcacagatctgatctgcgttggcaatatacttgtaattcggacatgcatctccaggacaccagccttagcaggaaggggagccaatcaaggggaaacaattatgcaaatttaaaatgtaaactctctggagcccctgccacaacctgatctctataagaatcatgatgtttccaaggcagcacatggtttggggaaattggagagaatactcccgatggaaagggataacatcacagctgccacaacaatgctatccagtgagcaaatgtcggatgttcagagggaccaagtcatcttgattagaatcgtggaggtatgagtttcaaagtggaataatctcatatttaataaatttgcaatctcttcacagtgcactggaaaagggaacatgcttaaaataattccagggacttggctcctgggcttattcagatatcggaatgattgtcagggactggtttattgtcttgctaggatgaagtagatgcttttaaatctcttttctattgtgcatgtctgtgggaacacatgtttgctcttctttttcacccaaaatattaaaaagctgttcaaattgccagatcattttttccaagatgacacttatttatttacaaaaatctttaaaatgttattacaaagaatgtgtttattgtagaaaaaccagaacacatagttattttaatacaagaaagcaaaaaaaaaaaaaaatcaaaccacctctctgtgataaccattgttaatattttgttataagccctcccatacttttccctatggactaaaataaaaaatacaaaggtatatatatccatgtatgtgtattagacatgcataatactataaatactattctctaatctgctttatttttcactgaatggcatattatggatttttatagtctactgaaatcagaataatgtggtggttgacatcacattctctgaagtctggttgtcttgtttgagatttgactctatcaattactagctgtatgatctcgggcaagttacataattgctatggtgcatcagtttcctcatctgtaaaatgaagatgataatgatggaatatactaactatatgataatgatggaatatactaactatatgataatgatggaatatactaactataagataatgatggaatatactaactataggttgttgtgagggttaaatatgttaatgccaaaaaaattccataatacagttcccagcataggagatgctcttgttaaatgttagctatgattatctttccatgttaactcatgtattgccacatcattattttattggctgcagatgatactaatgtatttatgtatgggaacattctttcctgcttttcatttggtgtatggttgtgtatatgtgatttaatgctggtcatgctttaatgctcttattttctttctaacttttattttaggttcaaggaagacatgtacaggtttgttatatgggcaaattatgtgtcccagggtttggtgtacagataattttggcctccaggtaatcagcataatacccaataggtagttttccaaccctcgcgtccatgtgtactcaatgtttagctcccacttataagtaagaacatgtggtatttggttttctgttctagtgttaatttacttaggataatggcctccagctccatccatgttgctgcaaaggacatgatttcattttttaatggctgcacagtattccatggtatacgtataccacattttctttatccagtctactgttgatgggcatctaggttgattccatgtctttgctgttgtgaatagtgctgtgataaatatatgcattcatttgtctttatagtagagaatatactcctttaggaatatacccaataatgggattgctgggtcgaatagtagttctattttaagttctttgagaaatctccagactgctttccacagtggctgaactaatttacattcccaccaacagtgtataagcattcccttttctctgcaacctcaccagtatctgttatttttgactttttaatgatagctattttgattggtgtgagatggtatctcattgtggttttgatttgcatttacctaattattagtgatattgagcattttttatatgcttgttggctgcatatatgtcttcttttgagaaggctctgttcatatcctttgcccattttttaatgggtttatttggttttttttttcttgtttatttgttttagtttttttttaaaatagattctggatagtagacctttgacaaatgcatagtttgtagatattttctcctattctgtaggttgacttgatagtttcttttagtgtacagaagctctttagtttaattaggtcccatttgtcaatttttgtttttgttgaaatagcttttgaagtctttgtcatgaagtctttgcctgggccaatgtcaagaatggtatttcctagattttcttcttgggtttttatagttttgggtttttatagttttaggttttacccttaaatctttaatctatcttgagttgatttttgtatatggtgaaagggaggggtccagttttaaatcttttgcatagcttgccagttatcccggcaccatttattgaatagggagttgttttagtccattttcacactgctataaagaactaccttagactaggtaatttataaaggaaagaggtttaattaactcacaattccacatggctggggaggcctcaggaaacttacaatcatggtggaaggcgaaggggaagcaaggcacgtcttcatggtggcaggagagagagagtgaaggaagccacagatttttaaactatcatatctcttgagaactcactatcaggagaacagcatgggggaaactgcctccatgatccaatcacctcccaacaggtccttccctcgacatgtggggattacaatatgagataagatttgggtggggacagagccaaaccatatcaggagtacgttccccattgcttgcttttgtcagctttgttaaagatcagatggttgagggtgtgcactttatttctgggttccctaagcctttccattggcctgtggtctgcttttataccagtaccatgctttttttagttacagtggccttgtagtatagtttgaagtcaggtagtataatgcctccagcttctttatttttttttttttttaccatagggttgctttggccatttgggctcttttttggtttcaaatgaattttagatttctttctttcttttttttaattaaaaaaatacagagagggtctcactctgtcacccaggctggagtgctgtggcatgatcttggctcactgcaacctctgccccctggctcaagcagtcctcccacttcagccttccaagtagctggaaccacaggcatgcagtaccacacctagctattttttttttttgtattgttagtagagatggggtcttgctatgtaactcaggctagtctggaactcctgagctcaagcagtctgcccacctcaacctcccaaagtgctgagattataggtgtgagccaccgtgcctggccagatttttttttctaattctgtgaaatgctgagttttgatgtacatgaaattggagctgtatggcgcatctgaagagacagcactgaggaatcttttagccctcttgctagagaggtcctgacgatattagtgggaagggagaggaaaggatggaagagtttgtagctatggatctcagcagataagaggtgatgcagtgactgtgcatgaactttacggggtctggtcttgactctactactttctgaggatcatatgcaacttagcctctctaagtcttaattttcacatctgtaaaattaagatttttttgctatctacctttttgggttcttataaattagatcattcatgtgaagagtttagcatttgtctggtacctggcaaagtctcagtaaatactagatattattatttgaaattgggggttatcattaaaacatgatgtattcatgcatgaatatacattcacatagtttagctatgaaacagtcagttgataagttgtacatttatacaggtatactctttttccttctctttccattggtttcttgctactgtgcctcaaattcacacctactgtttaatactcagctttgtgatgctgggatgggattctgcaaaccctttttccttttgccaaatggatccatatcagattccgctattagaaggtgctatgtggagactgcttcctggagaagagaaaagggatatgcctcttcctgtttgcttccagttcctgccagcatcactccaacaatgcttctttgctttggcagtggcagttcatttcagcggagcagctggctccagtcttcatttttttccacactctcagaaccagtcccattgtccctccttggtgatcccagccctggcctgttggcataccttcctcagaggcctgggctccatctctgtgaagggttccttcatgtctctaggtcctagttgccctagactcttctctttgttcctccagccatggtggcatagccactttgtagttatctctgtgaaacttcagcattatcctctctgccatctcagttctccaattcctggtgagcaatgatttacactaaatgatctctgttaaaatttctgatgttatttttgtttcctgagtggaaacttcaccttccctaaataaaccagttgagaatcagttgagaagggaagattcattttatgagtaaatgtgtcaatgttactctgaaggaagagtgctgggagtctagtctttatcctgattgtacttattgtataactctactcattgtagaagtaccggagccagcagaccacctgggccctgaagatgccctggaggcatggcctggggggactgtgctttgtgggctacggctgcttccaagaatgcaggcagggatgagacctcaatgtgagtgtccacatttgggaagcagaataatcctttaaggcagacaaagaggagaaggaggatggaaggagagaggcctggaagagaaaggactactgtgttatcagaggcagaatgcagggtaaaaaattggtcaccaaaagccggcagagggtggggtgtggagagggagagagtcacggaaactattagtcttggtaataggacagtttcagcctttcattatttactgataataaaaaaggcctgcacaatagattggtcaacaccactttcctgcttcattggtttccaaagggatttgatgcttccctactgagagattatttctaggagcccgtttcaggtcactcaccataatgtcctcactcagtgatcagctgtgtttgtctccctgtatgtctgtctgtctctctccgtttgtgtgtctgtttctttctttctctttctctgtttctctgtctttctctgtctctctctctctctctctctctcacacacacacacacacacacacactcaaacacacacacacatacacccatgcttctttatctatatctactgggagcactggaaatcctgccccagcagtggtcctgcccagaggggatctgaccagccaggcttcaagagagcagtggatgaggctgccattgccctctgaccctcagctgtctggatgcacaataaaggatgcctttattgagttcaaagagccaggtggtgctgctgatggggagaaggcagagtgactctggatgggaagaggtggatggctctcaccaccaggcaacctggtgtggggttttatgagccgaagcagagaagctcctgcccctggcttaaaaattgactatcctggctaaaaacaaaatattccctttgcttcttcagagaagattcaacaggaaggacaatagcatctagtgcctccattgagattttttaaaaataaactttttattttggaataatttcacttttacagaaaatttacaaattaatacgaagagttctcatgttcccctctcctagttttccctattgttaacatcttacatcaccacagtacgttcagaaaaactaaggaacaaacattgacaggttactattgttagttaaactctataatctttattcaggtttcactagcttttccatgaatgtccctttttcggttccaggatttcatccagcatatcagattacatttagttgttgtgtcttcttagttataattttccagtctttccttattttgatactttgataattttgagaagtattggtcaggtactttatataatgtccctccatttgggtttgcaaagtatttttttcatgattacactggggttatgggtttctgggaggaagaccaccaaggtaaagtgtcctctcatcacaacctgtgggatgtacccaggtgctgtccacatgatttacctgtggttccaccatgatttgaaggcagagggcaggctctgagaagcctcctacaggatgagggtcttgattcagagtccttccctctggatgcacaagaccatggattgctgatcaagaaggaccctgcaaagctggagatggggtggagtggggcagtgctgcacatgggaagagcaacagactagaagccaggtctgtctggcactagtcctgacttcaccgcttctgagctgcgtgatgttgagtgagagtctttaacctccctggcctcagtttcctcattcaccaatcagtatgtaaccccttcccctcccttccttctagggttggcaactggatcaaatgacattagatttgaaaagactttaaaaagtataaaagacagtacatagatgggaagtcagtctttaagcctgctttggattttccagcatttcagctccagcaggaggagaaagatttactttctatttacttatcactgttaacaagcaaacacatacaagtcatatgggtgtgtgtgtgtgtgtgtaatcttttaacttttttaaaagtctgatttattgaaatatatttacatatagtaaaattcatccttcttatgtgtacagttctgagttttgacaaaaaatacaatcatgtaatccttaccacaattaagatagagaacacgagacatagaatacttccatgacctcttcacccccaaattccctcacacttctgtcatcaacccattcccctactcttagcccctggcaatattgacctgttttttgttcctattttctacaatgtcatatgaattgaatcatgttgcctttattgtttttagttctaaaaacaacattattgaggtataactgatatacaataaaatgcacatacaaaagtatacaacacgtaagtcttggttatgtatacatttgtgatatcatccccacaatcaggacagtgaacatatacccatcaccctaaaagtgtcctcaacttctactgtcactgcttttcagcaaactgatggttctctgcatgtactctgaggcacagtgctcactcccactgttatgccctccttcaggtggctttctttcccttaagctaccacctggcccttttgatctctccaaatcctgcccatccttcaagtctacgctttagccctccccaccacccaatgtctaaagggtcctttaaagttatcctttgagaataattcagcccacacttgctacttccttctctactcctaatgtacttacagacaacctctcattgtggtctttctttatataacagtgtttgtatcttactgtcctaaggtgagtggcccagtgtttagcagcatggtctctggggttagatagttaggttcatatagttaaccttaggctcctgtttaacctctgtctctgtgtcatttttccttatctgtaaaattaggaagacaatacagtatctaccacaaagggtcttgtgaggattaattgggtttatctgcataaagcacttagaaaagaatcttgttatacagtaagcacttaataaatgtccactggcttcatcagtaccattaccgttgaaagccttttaacagcaaaaactacaactctcactgtgtccacagtagtgggcttgtggatggagctcagatatttgttgggcttttgatcaagggaccattccagtgaatcagaaagttcctgtgaccacttaacatattacacgcttgcttgtgtactgctcttagatgatataaaaacaaatcaaattcccaaaccaaaaagctgcactcttttgtctgggtaaatacagctatgacatgtctatttccatggtttagaatatcaccagtgggaatctactgtggaaaattgagtacaacactatcatcatatgatttgttttgctcatatttggctgtgccattggctgcggagccaggcagcgaactccacacaatgaggagcctgtgaaaacgcagagaaggcaagaaaggatgcaaacatttaggcagcatctgatggtagctggcttgtggtttacctggcctttggttagataactgtgcctgatccctatggccaggaaggaagacagtgctaatgaaaatgaagatctgtacaacaaaagtacaggcctacctcagagatattggagtgttcagttccagaccacgcaataaagtgaatatcacaatgaagagctgaagaattcacatttgggctgatgggcctggggtagggatgaccaacagaccacatgcttcttgtctcttctactccctgatcctctgatagacagggctaagtgatcatccactccttccaccctccagcctccgagtgggccacttttcaagcatggaattccaggtgggtgcttccaataagttggcacaatagataatacttacttgctgtcaggctcagacattgctccagaagcagatatgatccaagggaccattgcagatagaaacccatgtgcagaaagtaaggcttagccaatgaagtacctcaggcatcaggccaggcagagagcctgaggactgcagaatccaggagctatacacataggataaggccagctgaatctggattggcccaggacagagcctggtttccaggaggctattcatattggatgctggccctgcacaaagaggacatgtaagctggcttcaaggtgcttagtcaggcgggacatctggtactaactagatttgagctatgccctttctttctgagttgccctggctaagcatccagccaaggggcagccaaacaagcccctctgcccactcctcactcttcctactctcacctgagtgggtccagtctcatgacaacaaaggaatgatgctcacatgcataggatgctactgtgggtatgtccaggtctggagtgtgggggtgagtcagccagctgagactggtaaggcaacactggttgctaaaacagtaaagtgctgtaacttctgttggttaaagagccagtgccctgagcccctggaggtccccacccctcccactccacctattgccttggccacctgccctttcattccaagacttgctcttcaccatccagcaattgaaggggtcatgcctggcacagaggcatctccaggactcctctgttggttctgatttagagtatcggcactttccagtatggtgtgctgttcctaaagccctggctgtaacttctccttgtttctcctatccaggaaggcacatcagaatgcctgtgataaatattaagtatttcatgtttgtatatagagccatttttacatttgcccctttattagtagtagcaaataataatatgaactgacacatttgtaatgttttagacacttaacatgtgttaacttgtttaatcctcatagcagccctgtgagctaagtactattattatactcattttacagatgaggagactgagttatggagaacttatctaattatgtaattagcctaagctaacactgcaagttagcaataagtagaagtctcccagggccctcccatgccctcacaaagcacgaaaagcaatagaatgtggtcttgtggattaggaaacggagactcagcaggccatgggtcaaggtgactagagcagcccttcgtgtgaactaatgcctggagaccagacagtccaggacagctctgtgaatgacaaggggacaggtgatgatcaagaacagattccccctccctcctccatgccttggcaacctcaaacagaataaaacaaaatgaccaccacaagagaggagagatagtgaaacaccggactgaataatatcgtattaaattgtctgagattagatttctccctgctgttatacaaaaatacaggttacatttcttgcaaccatttctacttaactttcctttctctgctgggttctgggagggaaacttcagtcagacttgtcacatgcccaggctttacccaggaagtgagcctcagtctcatctgctctcaaatgcctaacttatcctgccccggggcctggctggaccaggggttgggggagtgaacagtgtgcaggcctcctcctcaggggcctccctgcattggagatcattgatttgcttgttcctcctcctctcgcaacagcacctgcagttcttatttcgtggggagtggtaaggagtggttcagactggtcacggtttcttccaggtctgttgtttacagcatcaacttcatccccaggctgcttgcaggactcaggcaactgaagctcaaaagcccaggtcttgtagctcaagagtctggaaaggtttgcaaccttaaattccaagggtttggctgtacagctctcctctgttctgctgtaatcacccaatcaggaggcaacaggtgcttcatggtccagtttagcagctttaagagatactggaggaaaatacatcacttaatatcatccaagtacgcacctatttgccattcctaggtgactcagcctgggcaatattcccgcctaccagcaatcttttcagctccctcagtaaaataccaacacaccctgtggctcagtgatgcattgaagtcccaatttagtgataccttatttacagattttctaaataaaattgctaatacagtcaacccttcatattcacaggttctgcaccctcggattcaaccaaccaaggattgaaactatttgaaggaaaagaacaataataatacaaataaaagccaataacaatataacaactatttatgtagcatttacattgtattagatattataaataatctagagatgatttaacgcacatgagagcatatgcataggttatatgcaaatagtatgtcattttatataagggagttgagcatccacagatttgggtttctgcagggagccctggaatcctgtggataccgagggacgattgtacattttgagaaccgaagcccggtgctaccctgttgcagcgatgaagtatccaggtcacctggagaaagctgacataagagcaggcacacagcaggaagctttgatcctcatcttctctctggctgcagccctcagctcttgtgcaccaactctgaccaatgactaggactggctgctcggagtacagctgtattgagaaagattctgaggctgggtctgcattcagcaggaaaaaaaatgaagaggtgtaacactatggacgagtgggcaactggctcttcaggcttggaaccaagagggggcagcagagagcagagaagaattggttggcttgggctgacccagacctaggaaaacttccaatcttcttcttcttccctcaaaaccgaatccttgtggactcactcttgagactattgtccacacaagtggtgtggtccaaggccacagcaagaaaggtctgagggagttctttggggttcaggtggagaaaagcctgtgctggatgccaggctgctctgagaacaggaaggaagataataatgttaacagcaacagttacaattacccagcccctgtagggtgccaggccctctgccaaggtgctttcttttcattctctcaaagactacttgaggtggggaaacccccagtttacagatgagaaaacagggtcccagagtggttaaataccttgcccatgatcacgtgactaagggagggccaagccacattttagactcttgcctgtcctgccctctgtgttatggtgcccttccaggaaggaggcagaaaggtgcacctggagttagaatatccttggggagtgtcccggacccaagggaaggcaaacggtccttctggtacagactgctgtctcctgatggccacgggtctcttgacagatttagccaattcactggctcacaggtccatgcaccatcctcagcagagccggggtaaggtagctgggctcgaacagccccagaaaaaggcaaaaagaaagataacagaaacttgtatggaactttcaagtactcactgtggaagtcattgatttatctgcctactgtgagagttatgtcacgttggaaggtcacattagaacgcccctcacctcctgcagcctcagctccaccctgggctcagagatcaatccttgccttatttagggaagcacatccaagcatatttgaaacttttgggatgggcttggggatactggcaccagggacatcttgctgtcagtactgtcctgattctgagaactccactaacgccacattcctcaatccaagcctggatctgggactcaggctgctgcctcactaaatgccttatcttttgggtcactgcagaccagggccctgccttctttagccaatgtctgtttccctcatctggcagtaggacatcagtctaccaaaagagtcacatgttcatatcccagcttaggtccaagttgtgaaccaacttcatttcttaatgtaatcacttttttggtattgctttttttctctaaaaagtatgtatattttctgatcctacatgtaatattttctgggccagttgcagtggcacacacctgagctactcaaggaagctgaggcgggaggatcccttgagcccaggagtttgaggttacagtgaactatgattgcgtcactgtactccagcctagacagctagcaagaccccatctcttaaaaaaaattgttagaaaatactttaaagcatcaaggagaaaaaaatttctcctatctttctggatacatttttctcaactgcgcttattactatctaacaccgtcctttacttaggttttcattgtttgtctccttctctagaatgggagcttgacaacatgagggatttcatgttttgttcactgcaagttccttaattcccagaacaatacctggcacatttacagaatgaatgaattaattcataatgccatgacatcagatataattttatttaatattatagagggaacatttttcaatgtcaataaaattttttcaaaagcatcattttaaatggctgataataatctagggtatggacatctaagcatgtgttaagtatgcctgcagttttggatactgaaagattacacagattaatttgattccccatttatcaagctacagcagggccaggctcactttgttgtttggtttcttagtttcttgttcctggtcgaatgaacagatgagactggtgaattatggagaatttctgtcactgccctctctagccttggcatagcactgtggctcctctctccaaatttctaggtgatccagccggctgggctctatgtactgaagcataggctgcccagcgtaagcagaattgctaacaggatactattatggtacccacctgtgtggccttgtgggggtgggggaacttacctttgttcctgtcctcctctagaaaatcagttacatttctcttgcctccctcccaaggatgatttccagggaagcaaattaaaaagcggtgaaaagcctttaacaattactcagaaatctatcatttcatcctctttcacctccagttcaagtttaagaacagtcctttcaaaaagaaaaaattaagcactaaagtcagaaacattttctttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccg

SEQ ID NO: 2528 - DNA, 4847 bp, Homo sapiens
ctctggtcctctcttgggctctttcagcgttattcggtgttttgtgtttgtgcaccttaactgcgtggaaaagtgctcggtccttgggaacaagggccacagggcattgcttccttccccagggcctggcacctaccgggcactagcaggcagtctggccatagtagctgagtgatgagtgaactgcttggaggctgtgcatgttgcccagactcttttaggtctatctcccctaaaggcatctgtgaaaacacataaagcaacaccctgaggcagcaacggctccagtctgggagtctgaggagcagaaagaagctgaggtggccataggagccccatgggcagtgaggtgaggccagggagatgggccacggccggtcagccagggccttgaagggcacggtaaagcgtatggattttgtcctgagaaacgagaagtcagctttgacaggggagggccatgctcctgtggcccgagtcatcaggccgtgctgcctgctatactgctggatgcccctttaagtcaggagccccacactgttcatggggtaactccagggcctggctctcagtggcgtgcagaggcatttattttattttacttttttgctgctttgcacctggcaatggaagaatgaaaggcaacccagagtgaaattaggattacaattttacaaacgtctgtttctgacgcaggaagcacatcatttgtccacatcacactctcttggaatttatgacaaagccaggtaaatgaaaacttggaaagataaacctcagataaggggggactactgtattcattccttcaccatggcatgtctgtgtctgagaatctacccttaaaaacaatctggatgcaaagaagccgtaagatagagcgcagtcccttcatttcataaaagaatgaaactaactcaaatacacaatgcaatgggtgagtaaagtattgcactacccttaatgtaatattgtggggccactgaaaacatgctcacatgtttatggaaatctgagaagtgtttctatctatggcatttcatcacatttaagacactgttgattagagaacacaccaccatttcacgtacctttaaggaagaaaaaaatacccagaatggttatttaataagggacgtctaagtaaagctgggatcctaaagggctatttctttggtgggaggagaatgataaacagcctcgtcaggcagaaagagccagtgtcccagccatggacccggatgcagggagggaacaaaactgcccctgaggacgtgcacaagccagtactcatgctggtttgagtctgaatttgcacaaacatatggtctggaaacacctcaagcaaatgctgtaactgaatttaagtttaaggttatgtcaagttggcagtgcccccaggtgactggcagaaacaaatacaaccacctctagaaagaactgaatgttaacaccagctgacagtgcctgtaaaacatcagccactgtacagtgcaagatccagagacgttaaaatgtgaagtgagttttagaattaaccataagtaaaaaagcagaatcaaatgggtatgtggaggatgacatctctttgccgagtagaccgactggaaggaaaaacacagtaaaatgttcacagtgatcttctgtaggtgctaagactacagcattttctttctttaaacgagtctgcgttttccagctttttctaaagtgaccatataaaaaaaggagaaataaggagacgcaagtgagagaatgactttgggtggggtagtcaaggaggtgaccctgaaggaggtgacacctgaactgagaagggaccagcacaggagaagccacctgaagagttcattgctacatgtgtatccaggacaaggacctggggcacagggaagatgcttgatatgtatttgttaaatgaatacacgggttaaggaaggaaaaagctgctaaaacaggagcctaagtctcaaggggtcccagccagagtctggctcttcagggagccattctcactggactgagctgataaacagggcagggacgcccacctggccaacagcagggccctgtggaaagtatgcagctgcagagttagcagagaaccatggttgtgggtcttgggcctgtttccccatctgtcaaatgaggttagtgctttgccacctctgtctctgaagtcagctccagatgatatcgtgctttgaaatattaagccacgtgcgagcgtgaggggctgtcacgctccaggaggtcctcatgcgagcccagcagcacctccctgtaacactgggaactgtcagcacctccctgtaacactgggacctgtgagcttcagacaagctgctttgtctcaggaaggttcccgtgctcgctgctcagcccacaggagatgtcacatcagctcctgtcttcctgcccgcatgcactttccagattcacttaccatgtacgagcctgtgctggaaactgctaacagagataagagatgggtccctgtccttgagaaagtcacagggagtccagagagtcagatgagcaaacaggatgataccctgtgggacccgagggaggggacacacaatctgctgctgagaggcagttaacagccaccactggggggaaataatggaggcattgtaggtttcctacattgtttccttttgctgtcacagttttgggaggttatctccatttcacagatcggggctggaaactaagtcatctgtcaagttcacagagtctggactcgcacctgggctggggtgactcaagtccatgcccacgggcatactactgcactggtatgtgtgtgctggcagtgggggggggcagggagatgggaggaggctattgtagaggtgacagcgtgctcttcatttagagactggggccaaggggtaatggtgggcaatgaggctggcacaagggccaggtgggctgtggattccttgtgaagaagttgatatgagcaaatccacaaatccggccaaaagggaaattttccctgggctttctgcgcaggtcatccccctgtcccaagccagcccctcagaggacattcagcaaaggcatcccatgtcctgcagccagagggctacagggaaaacttaactcccaccagcttccagctgctctgactgggaccatgcccaggtgtcactgtcaccctggtctgctgtggagggtgccaggcaagagttcgctctccctggaaacccagctcagctcttgctaagcagtggctgttgtggggcaggaagagccgagctgggcctgaccgctggtacggagcagaattctaaggaatttgcagatggaattggggttactaacaggctgaccttaaaatagagaggtgatcctgggttagctgagtaacccaaagtaatcacagaagccctcaaaacaaggaaggcagaagagagactccagacataaggacttaacccaccacgggtggctttgaaggaggccacaagtcaggaaatacaaggggctgagaatgaaccccgaggcccatggctggcaaggcaacaggaacctcagtcccacaactcgatggaactgcatcctgccaacacagaactcgaatgcaggttcactgccggagtgcccacaccgagatcttggccttgtgactcaagcggagcactggctgggcatatgatgctgacttctgactctcagttcatggcggacagtaactgactgctgctttaaactgatacacctgtggcaattggttaccgaggaagaaagatcacctgggctggagagtggagggaacagggcctaggatgctggtgatgaaaggacacaggtcccactatcggtgccacgctggccacaggagcatctcctctgggacaggagcatcgcagtcatgagtagtgttaaatgcattccttcactcattcagccaacgtctctcaaacatttgctacgatataagtgctagctgggtgtctggagctcaaatctcatgaaaggacagaaggccaaacagacaacacccagggaaatgagtcccaggataggaacaaggtccccgcctgcccctaccccacctctggcacccagatgctgtgggaggtgagagaagggtcactggtccaccaggggtcgaggtttctcagggcttgaagccctgtcgtgggtcttggtgcccaggaaggagacagaggccatgtcggggtgggccacactcagggggaagcagcagactggctgggctggtacatggaccataagggacctggccaccaggtgtgccgggatcagctcaggagagccttacagttcagacaggaaagttgggactgaggatgccaagcaggggaaagaggctggggttaggacacatcccaggacttccccaaccgttaggacagtgaccttcaaaccatgtcagcccctgccctctggggccatgtgcccccgcacaccctgactgggggatagcagcccgtgccggtggcctggaacaccacatccacacacaccacctgtaagtgaatgaattcacactttggtttgtgtaccagccttggggactgctatgccgccagcacctggcacatagcaaacaatccatgttagctttacaggtaaataaaagacaaaggcgggtgtctgagagactggccgcatcagggaaaacagtgaaggaggggtgtctgatgcccagggcatgatgggggaggggtcaaggcctgcaggccaaaggaagccagctggggacagatggcagacagcatccctcaccctgtggcacaagcctggaagctgggtctgccctccctcaggagctgtgcagcagagccactgttgcactgtgacaggac

SEQ ID NO: 2529 - DNA, 3798 bp, Homo sapiens
gttatgggttgaattgcatctccctaaaattcatatgtttaagtcctagcccccagtacctcagaatgtgaccctatttgggaatgagtttgttgcagacataattagttaagatgaggtcatagtggaatagggtgtgtcctacttcggtatgactggtgttcttataaaaaggggaagtttggacatagagacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaacatcttgtttggacttgtttgtgagcaccaaggagacacctctggggacttacagatctacttggacagcacttgaccatggacctgccccccagcagatggggcaagagccagtgaaatttgggtatttgactgcaaccctgtttgttcccacatgtagaggagatctggtgcaactccagttacttggagcagtataacagcacagccactgctgtcgtatcaacatttttcgctagtcctctctcatgtggggcttgtctatggggcatgttggcattgggaagtcctcatttcctgatttactgtctcatgatgagataccaatcaaagctaagatacaaagaactctttgaaaaatagccttttcaacttgtccacacacaatcagaaacatactgattttggattaactcattattaatgattttgtctattttgaaagaggctgccctgaacaaggagtcaggaattgtaggtcttagctccacttttgctattaagttatgctgcaaaccttagaatcttcgctgagcagttctctgggcctctcttaatctgtagacgaagaaacagaggcagatgaaacacatctcatctaattttgcagacacgctcaaccctctacactacaataaagggttaaaaaaggacataaacctataaagaggggagaagattggaagaagctaagagagacaaaatttaggagtctgaaaggcatatgaacaggtagtaatcaatttagcaaacttgagaggaaaatcctgagctaccactgggaaaagcaaagaaatatatagccaggcaaaaacctctccccattccaacagaagactggaggattttattttttttctccctgcggaaaacacagaacaggatgtgtggacccagggacaccagaagcaattgaggtaaaagaaagagaggaagtaaatatgtatatactagatgctaagacacctgttcctgccagatgtcccagaaggctgacagccaggcctttctcctccaagcaagaaactggaagcatctcctatagggagtctgaccagctcaatagcttgctggtcaacaagctctgctcaagtgcttaagtttccagtcagggatttttttttttttttttttttttttaagacagagtcttgctctgttgcccaggctggagtacaatggtgcaataacagctcactgcagcctcaaccacccaggctcaagccatctgagcctctgagtagctgggactacaggtgtgtcactgcacttggctaattttaattttttttgtagggatggggtctcactagtattgcccaggctggtctcgaactcctgggctccaacagtcctcctacctcggcctccaaatatgctgggattataggtgtgaaccaccacacctggcctctaatcagttttctagtctcccactcaagccttagttgagcagacaaatgaagatttccaaaaatctgaggaaaacctccagtatagaacatgtagactacaaagagaaaaaggcagcctggatgaaaaccgagactaaaaagggagaagaaacaaaattcagggcaaaacaaaaaacataatcctaatatcttcaggaaaaaagagaaattacaatcatgaaaaaaggaaagattgctaaaaaataaaatctcagcgaacaaaaaaagaattcttataaaacatggtaatggaaattaaaaactcagtggaaggattaggagatgaagttgaggaaatctctcagaaactaggacagaaacataaatagatgggactgaagacagaaaagtagagaaaattggaagacaaatccaggatattctgtatgcataaaaggaattacaaaaaggaaaaagaaaatagagaggaggaaataagaaaatagtttagaaaatttccccaaactcaaaacatgagtttgcaggttgaaaaggtcccctgagtgcttagcatgctggctgaaaatagacctgcaccaaggcctagcatcatgaaatactgagactctgagagaaaatcaaagagtttacaggtttctgcaataataataataataataggaagaaagaaagaaaggaaggaagaaaggaaggaaggaaggaaggcaggcaggcaggcaggcagacaggcagacaggcaggcaaagaaagcaagccatttacagaagatcagaaatcagaacagcactggatttctcaatggtaattggaaactagaagacaatggagccaagccttcaccatgttgaaaaaaaaaatccaaaatatttgcaatctagaattctatactagttaatctatcaatcaagtgttagggttagaataaagacttaagacatgcaagatctcaaatattttgcctgcaatgaatatttttcatactggaggattttcttctggaaaatgtgttccaccaaaatgagggagtaaaccaagaaagaggaagaagcaaagaggaagatgtaggagatgacaaacaacggaactgatacagacaagaggttactagaatccccagaatgatggagcagagaggccccaaagtaacatttgtacatcaggtcctagagggcaaccagttcagtccaggctggtcagaagtgtctggcggaaacttctgcaagacaataaaaggaacagaacctcatgcacttaaatggtttgagaagaaatgaagacactggtggaaagcttagggttctattaaggaaaaatacacagaaaactaagcaaaccgaagaacaaggcagtcatttattacaataaaaacaaaaagtcacacaggaaaggaaactgaaacatagtatatgacactattcacaaagccataataaaacactcaatatcgatcggactacagtcaagatgtaactatacagggaaactggaagggtgtaggaggagggggtgggaacagtacacatacgtggtatgtgtcgggtggagaaaagacagctaaatcttcgtcttctatagtgggcagttattagctaatgcctacacccaatagatcaagcaataacaatataagcatgttatttagaaaaaccaaagtaattgccaaaggaatcagctcaaagagttgaaggtgattgcacatgaagacgtagggggaggtggactacggcttgctctttttcttaacacatgttacacgactatttgttaaactctgggcatagagttttgttacaaaaataatttataaattttaaaatcaatc

SEQ ID NO: 2530 - DNA, 2212 bp, Homo sapiens
ccggggcacttttggtaaagaggctgggactctattccctggggtgatggaagactggctcttgagctgcatccttggtagcttttccttcttcatctcattgccagtgaggacactgaggaggagaaggaggtgaggaggaggaaaaagatgaggaaaaggagaaaaccaaccacgatccactgtcaccaaatgagcatgccaggttgccatgctgcacagctccaagaagcaccactgtccatgtggtcaacatggatggatccctgaggaggtgtccagcagcagcctgcatgccatgcgtggctctgaagtcaataatcctggaaaaagggtcattccttcccaataaacgacagtgggctatctcccgcagacacccacgaaatttccctccttttccttccatggaggactggtgaaaacgtcatcatggacctgacctgcatctggagaccatccctcagaggtgctgcagagctcctttctgcccaggcatttacggtgggtgagaacttggagaggcgagctcacgagggagttggggttttgacttggccatgactactcagctcaggatgaaagctgatactttctgagtgcattctttgattaacccttcaatcctcacaatcaccccatgtcaccaggaggaaactgaggcaaagtccacacaactggcaaatctggtatgactctctttctgtcacagcagtttgctggcaacagacctacagccagatgctcaggagccggcgcaggcgtaggagcctccagcggcgcaggagcagttggggtccattgcaagccgaggtgagaccggcgttcccaagcgagaagagaagaggcagtggaacacgtggagggcgtcgtggattgattcaaactttaaacaggaaggagattctgacacctgctacaacatggatggactttgaagacattatgctgagtgaaataggccagtcacaaaaaggcaaatacaggccaggcatggtggctcacacctgtaatcccagcactttgggaggccaaggcaggtgggtcacttgaggtcaggagttcgagaccagcctggccaacacggcgaaaccctgtctctactaaaaaatacaaaaattagctgggcgtggtggcacatacctgtagtcccagctactcgggaggctgaggcaggagaatcacttgaaccagggaggcagaggatgcagttagctgagattgcaacactgcactccagcctgggcaacagagcaagattccatctcaaaaaaaaaaaaaaaaaaaaaaaggacaaatacaattccgcttatgtgagtttcctcgaggagtcagattcatggagacaaaaaactggatggtgggggaagaggagattggggtgttattgttgaataggtacagcgtttcagtttgtgaagatgaaaaagtcctgaagacattgttaatgataaaacaacactgtcaatatacttaatgccatgaaactgtactctggttaaaatgataaaatttatgtcatgtataattttactatgataattaataatcttttaaaaagacccatccataaccacccatttgggctctatggttccactcatgcctttggctttgccttgaggtcctatttctggagaaatcttcaggtatgaatcttggcctgcctcgaggacttagctgtgttccttgactcaggtttgagtggcaccttctcgtgttccatttgttcatcatcttgaacctaaagcaaagaatccactcttaattgttgtcttggtttaagtcaggggccagcacgagagggttctttattacggttttcagttaaccattcagccttatgcaggtcccttggaggagaagttgaagagattaatggaagccgaaatggctgggaactatagattgtgattattgtactactaagatggtgttgcagctaggaaggaagtaaataattcaatacaatacatatgtatatacacacatcaacttctgagtccatatataaatgagtaggtgacttgggcacttgcttatttatgtattatcctagagcatatatgttatgaaaggagggattttttgttttgctcattattccattcccactgtgcctgttatgaattaggtggccaatcaacattagttaagtggatgaatgagtacattttacacacacacacacacacacacagacacacacacg

SEQ ID NO: 2531 - DNA, 34427 bp, Homo sapiens
gccgcaccgaaaaaggttggactcgggactccgcaggcccccccagccactccgcggggcgcctcggaggctgtgacctccagggaggtccggctgggtgcagcgtgacacgccggggcggttgccaaggacctgcccaatctgcgggtccagttgctagggcctccatcttgggggccagtggccgtggcgcccccggaaggggttgccgagtggggcattcacttccggtctggggcctgcggcggcggcggtgtcggcggcggcggcggcggcggcggcggcggcggcagcgggtcggtgtagaaaatggcgctggtgcagcggctcgggcctctccccgcggcgctgcggagggcttgaggctcgcgagcctccttcgccgcgccccacttgctcgtgcactttacacacatgagagaattggaagctaaagctaccaaagacgtagaaagaaatcttagcaggtaagatgggcgagctttccgtctcccgccccacgataatcgtatatttctactccgattcgccttttctgggttgagaagttcccccgtgacattttcttccgcacccggagagcagacattcgggagaagcggcctgggggaatactggagggattgcggggagatgcgtaattacgcgtgtgtttctttctttaaaaaaaaaaaaaaaaagcgcaaagcaattcttgtaaacttagttaaagcattctcacccttttagaatttaattaggggacttgtgcattaattactattgtaaatggttgcaggcattgtgtgactcatgattgaggcggcccttatggcgggctgtcaaactgttttggcttccccgttattactttgtagctcaaattgttgcttttataaaaagatactatgtgttcgcattcccccccgccccccccccccccccatacattgtagtcaggcggattctgttgcattggacacagttttgtccttgaactttaccaagcataagctgcgttttgttttccttcgaaactccatttctgtccatgttcggtgtgtgctctttttatcagctggtaaaataattaaaaatcttttctccagaagaggttatcgttcctgttgggccctgctgcttttgcatcaccgtgaagggagaatttttttttttttttaaacgatgtctttatggaatggaaatatttagcttcattgagctgtaattgcttaagcatcaaggaattgtactgtatttaactccttttcacattcattttctttcctaccgtcttttcctttcttattcccctttttcttttgcatcatattgggacactcagggaaacttagccaattaaccaaatccgtgaatagctttctttttttcttttttttcacttgttgaaaataaaatgaaatttctcctatctcaggttttaatgtagtttgctcttgatgattgcgggttttaggtttacattggggtttttaacactcacatttcaaatcgtctgaatattttgcaccgcgtagaattgttccaaattgctggcctattgagtttcataagatactaatctgttcaggtgatcgttaaagaatgtgttcagatggtgaaggataggcatcattggtttacccagtaagggattctctgttactcaaaataattatgggatcatttaaaggaaattaagtctgacatcactgactatttgtggtatatttacataaattttgtcaaaatctagtaaggaaatgttaagatatgaaaccattaaagaaaacaggttgagccattaaggtgtaatatcagcagaacagagcttagaggtctgtttctccttccatttttgttttatcaggtaactatatcagtataattcctatgaaggtgctctagtacttaattaaaaattgtctgtgccacaggtataattttaatattaggtagaactcgagtctgggttggctatttatcagagtttgaattccagctctgctacttgcaatatgaccttgactcttggcaagtcacttagcctctctgtccaatctataaaacgagcggcgtgggccagccagttgctgaggtctgttaggccctttgggttacataaaaggagtaaagtgctgtccgtgttcacagagggcatgtacagtctagtagaaagactatcataaatgcataaataacagtagtactaggtagatgacgtaggaatcaaaagataccatcccattcatgtgcttgagaatattcagtcggtcagaaggcatgaaaggaaaaacaaatatcaaagagattgtaaggcagtgtgtactaaggatccaatgagaggggagcatttcttgcaggttaaaagtgttctgaggaaggagagaggtgattaggtgggcagatgcttccttcatctccatctctagctgtgtttcctttttcacaaaaaagaatgtatctgtctttacccatagtgctctctccaggaaatcaaggcattgtattcattgagtaaccattttttgagcattttcgatatttcaactgtgggactgggcactaagccagggaagaatgtaagtagttaaatttattgattgcttactatgtgcctggcacacttttcctaagattttacatggactcatctgatccttgaaaaaccctgtgaggtaggtagtattgttatctccgttttacagatggagaatttgatgtataaagaggttaagtaacttggaggagaccatatcactggtaattggagtaactttttaggcttcgaacttgcaaaatttgaaaatttcttttggtaggcgggacccacagatgcatgcaatacttctagatcagttttttcatctgggcacttgacattttggaccagataatttattattttgagggttgttctgtgcatcacaggatgttcagcatccgcagtagcactccccgtccagttgtgacaatcaccaatgcttccagatattgctagatgtccctgggagtggcgcagaatcgaccctggctgagaaccactgctctagatcttcattaggaattgtaacgtgaaagcctccaaacttttagatgttgagttaatttaaacatcttttggtcgagtgctgtggctcacacctataatcccagcactttgggaggccaaggcaggtggattgcttgaggtcaggagttcgagaccagcctggccaacatagtgaaacctcatttttactaaaaatacaaaaattagttgggcgtggtggcatgcgcctgtattcccagctacccgggaggctgagtcaggagaattacttgaaccctgggagcggagagccgagattgtgccactgcactccagcctacttgacagagtgaaactctgtctgaaaaaagaaaaaaaaatcttttaataacatggaagcctagaccctattatgtagatcctcaatttggaagccctggtttctgaatgtcaaagatgtgttgccattctccttttcctctgctaagctgcaaatcctcaagacagtgtgcctggtagccagtgccagttaaacaacattggcacaaataataaatttagtttactatcataggtaaactgtcttttaaaattcacagttggccattaaaattgtcacattatgttagtatcatgggagccataatatctacatgagggcgattaccattagaactgaactttgaagaatggaatcagttttgaaaggcagataaaagggcattgtaagaacaacaacagaagtaaggacacaaaaatccagaaagtacaggagattttgatattgcagtgggtagttcaggttatataaggtatttgtagcaaactggttaaggccagatatagaggttcttgaatgtcaggttgaggaacttgtgcataaatttttaggtatgggagctattgcatgctttttgttgcgtactgatgtgatagaataatcttctggtctgggattactaaccaggtgtatttatgggagaaaactagcgatctaggcaagaagcgatggaggcctgaattgaagtggtggcaaaaagaggtgagtgaggctggacccagtggctaacgcctgtaatcccagcactttgggaggccaaggcaggaggattgagcccaggagtttgagaccagcctgtgcaacatgataagactctgcctctacaaaagaattttaaaaaattagctgggtgtggtggtgtgcacctgtagtcccagctacttgggaggctgaggtgggaggtttgcttgagcccagcagtttgaggcttcagtgagctgagtttgtgccactgcattccagcctgggaaacagagtgcaaccctgtctcaaagcaaaaagagagagaaaggaaaaaaaagatgagtgtataagatactgaggaagttaagaatctgggatttgacagctgattaggtgtcagaggagtcaaaaatacataggaatcttcatcatgggtgaatgagagtttgacccaacctctgaacagaacaagtcagagcagaaataggagtttggggagagaagatgctaagttacattttgcagttgtaaaaaaaaaatctaccagtactggtctagaccagtagaactcagctggtctagtctgaaaaaatattttggaggccagaatcatagaatcattgaatatttagagctggactatgactttagatagagatcagccagcattctgacttcttcatttctcaagtgagaaagctgtggttgaaacagattcagtaacttacgcaagtttatattctctgtcaagtgacccagctgggatttaaacaggccttttgactctaattctagtattcctcccatgtgcagtattttattttatattgcacaatagataaaatataattttggtttctccttttttattctaaaagagtaaaagcagttatctcaatatgttatgttcattctagtgatgactttactatcatgtactaaatgtgttttgtttaaagtagaagttaacttcacgttatactgatttgtccccccataaaccaactgtatgtcatcatataacaaaagttgttaaaagtgctatataccatataatgttgcatctaaactgggacacttatctgagatgcttttgcgtgggacaaatgctatattagaaatgactaggactggccaggtgcagtggctcacacgggtaatcccagcactttgggagactgaggcacgtggatcatttgaggtcaggaattcaagaccagcttggccaacatggtgagaccccgtctctactaaaagtacaaaaattagctgggtgtgatggcatgtgcctgtaatcccagctacttgggaggctgaggcaggagaatctgaacctgggaggtggaggttgcagtgagccgagattgtgccactgcgctccagcctgggcaacagagtgaaactctgtttcgaaagaaagaaaagaaatgactaggacagcaggagtaaaaccccaaggcattaggtctccgtagctaaggtggatcccactcatgcaattcatcaacctttgtctgaaaaaaaagaaagaaaatctgattttgttaagcttttcttttgctttgctgtgatacggtttgcaggccaacacatgcatattgctataggttggtgcgaaagttaattgtggtttttgctcatttttaatgtaccaacccaatatgctttttttccagcttaatttggcaattaggtggtaaatcacttgataggataaattaatcacaatctgtaaacttaatttaaaaatgtgtaacaaccctctgtggaaaatttgaatataaacatcaaaagaataccattctgtaagctcttttgatttttggcatctgaaatgtctgaaagtataaattgcaaaacatatttacaattttaatgacaactgcaaaagtattgcccatgattggaaagactaaaatggtatgcgttatatgtattctgttcaggctgatgcatgataaatctctcactgaaaaaacagaaatccctatctcattttaaaattttaaaaaattggccgggcacagtggctcatgcctgtaatcccagcactttgggaggccgaggtgggcagatcactggaggtcaggagttcaacaccagcctgaccaacatggtgaaaccccatctttactaaaaataccaaaattagcctggtgtggtggcacatgcctgtaatcccagctacttgtgagggtgagggaggagaatcgcttgaacctgggaggcgagggttgcagtgagccgaaattgcgccattgcactccagcctagcctgggcacaaaagcaaaactctgtctcaaataaataatcaatcattctaaccttaagcaaaattggaaaaatgttgcaactaatacctgtatctctttacctagttttagtgattattaatattttgccacatttgttctatcgtgacattgcacaccaaagtatggcagtaggtatctcacagaataagggcattctacctgacagcaatcaaatgatcacccacaggaagtttaactttacaattctgtctggtccctattcagattttcccaattttctcaaaattttttttaaagttgtatttgttctttcactcaattgctgtatcctgggttgcatttagttgtgtctgaagtttctcttacattaggagcattttcctgcccttttctgcttctctcttgacaatgacattttgaaatagtccagtctagttgtttttgcagactgaaatttgcattttttgggtcttgtctgtatgattaggttcaggttgaccctttttggcaggagtatcccataggtgatgatgtgtttgtcttcagtattccctccccacagcattttgaagtaaattaaccgaaaggttatccaatattcttacttctacactgacttggtgtttctttcattttaggaaatgccaaacaattggtttaaaccgagatgtaattttaaatatttgaggttacagtaattacaggtctttgtatttaaatcgatcagccataatgattactgcttttatgaagatttatgccaaaggtagctcccttactgtgggacataaaagttgcttgttttcagctttgaccagtgatgaactgataaccctggtaggaaaatgaaacattggggctgggcttgtaatacgctttcttaaaagaatgccccattgaaattagagtggcacggtgccaccagaccaagggttctcatcccgatgccacagagggaccacaggtgttatgaagtggtttgcaaaattgaatgtatgccaaaataaaataataaaaataaaaataaaaccccacaacaaaagcagatatggtctttagtgctcattagatctcaaagggtcattactcctcaaagattaagaaactgcttctttatgaggaggttgtcagaggagctgaatagtatcaataagaggaagatgtttgagattcaaaaggaagtaatattcgactaaggcatagcttctttccatcttaaaaaaaagccacccatgaaaataaatatagtttaaatttcctatttaagatgtcttattttaaaaatgatttgcatactctgtgtgtttgagttggctatgaaggagaaatcctagcatttccactcttgtaactagggaaaagcattttgaatttttagcagtagtatattatgtgatgatgactcagctgacttcccgtttcaaatggaatgttcaaaacagattgaaacctggttgaagaattttatactttgaaccttacaagatattttctgcaaacagtgactgattggattttgtataataacaaacaagattaagccaactcagttgttttgctgttcttattagtggttttcagtcagggagcacttattgagcagtttgctgcaataatattgaatatttttagagttatgacgtctgtgttttgttgactttggtcccttctttctcccattcttttgaagtttccctaaaacatgtgtgcacagacgggagagaatggtagttaagtgtgtgctgattttaaatgtccttttaaatatcatttattccttgataattgactgtataactgatgtaagagaaatatgttttatatgttattccacttgtgaatctctttgcaatgtgaggcatatagtgaaaatcttacaaagatagggtcataaaatgtgcattctctacactgctgcaggttaatcgtcctcgagccacgtttctgaggcctgtcagtcactatttcttagaaacctttgttggctccttcccagtgactctggaattaaagcccagactcttgttttttgctcagcttatcaatttagcactgtcccttccaccttttgccctgtccctaactcttccttctctgaatgtacctttcagtttctctcaacttttaaataacagctttattcagataaaattcccatatgataaaattcacccttttaaagtccacaaagtgtatgatttaatggtttttagtatattcacagagttgtgcaatcagcaccactgtctaattctagaattttcaccccttcacccaaaaaccccataatagcagccactccccatttgtcccttccacccagcctctggcaaccactaatctactttctattataactctatggacttacctattttcgtttaagtggaatcatactatatgatacttttgtacgtgacttgtcttatttagtgtagtgttttcaaggttcgtccatcatgtcgcatatatcctttattcctttttatgggcaaataaatttcattgtatggctattgcccattttgtttgtccgttcatcagttaatgggcatttgggctgttctaactttggggctattatgaataatattgctatgaacattcatgtacaaatgtttgtgtggacatatattttcaattctattggttatatacctaggggtggaattgctgggttatatggtaactttgtttaacttttgtttgtgttgttttgttttgtttttgagacggactccctctgttgcccaggctgacgttcagtggtgcaatctcagctcactgcaacctcccaccttccaggctcaagccatcctctcaccactgcctcccaggtagctgggactgcaggtgcatgccaccacgcctggctaattttttctatattttgtagagatggggtttcactgtgttgctcaggctctgtttaactttttgaggaactgcccgactgtttgcaaagcagctgcacagttctacattctcatcagcaatgtatggaggcactaggttctccacatcctttccattgccagcatttgttagggttcttgtttctgattttagccatcctaatagatgtaaagtggtatctcattatggttttgatttacattttcctaatggctaatgatgattagcatcttttcatgtccttattggccattcgtatatctgatctgagaagtggccattcagattcttctcccatctttaaattaggtgatattttttgtcattgaaaaaggtctttatatagcttagatacaagtcccttattagatatatgatttacaggtattttttcctattttgtggcttttcctttcacttttttttttttttttttgagacagagtcttgctctgtcgcccaggctggagtgcagtggcatgatctcagctcactgcaaactccacctgccaggttcaagcgtttctcctccctcagcctcctgagtagctgggattacaggcacccactactatgcccaactaatttttgtatttttaatagagacagaatttcaccatgttggccaggccagccttgaactcctgacctcaaatgatccacccgcctctgcctcccaaagtgctaggattacaggcatgagccaccgcatgcagcctcttttcactttcttgatgaagtcccttgagcacaaaaatttaaaattttgtaaatctagtttaccagtatttttttctgttacttgtgttgttggcaacaaatccaaggtcacaaagatttacttgtattctaataattttatagttttagttcttaatgtttagttctgtaattcattttgagttaagttttgcatatggcatgagggctccaatgtcattcttgttatgtaactatccagtaattccagcttcatttgttgaaaagactttcatcttggcaccctgttgaaggtcacttgatcataaaatgaagaattatttctggactctcaattctattctgttgatactatgtgttcatcattatgccacttccacactgtcttgattacttcagctttgttgtaataagtttggaatcagtatgagccttccttcaagattgcattggctggataaccagagactaattattaaaaaaaaatttttttaaagattgcattgactattctggttgcatttctatgtgaatttttggatcagcttgtcaatttcagcaaaaaggcagctgagattttgataggaacagtgttgaatatgtaggccagtgtggacagtattgcattttataatattaagtcttccagttcacgaacatggaatctttttctatttatttaggtctttaattgttttcaaagatgttgtgtagttttcagtgtgtaatcatgcttcttttgtggaatttattcctaaaactttttgatgctattgtaggtggaattgttttcttgatttactttttgggttgtccactgctactgtatagaaatacagtagattttttttaaagttttttaaaaattgtgaaacacgtaaaatttaccatcttatccattttaaatgatgtagtttggtggcattgtccattcacattgttgtgcagccatcaccaccatccacctctgcaactcttcatcttgtaaaatggaaactctgtacccgttaaatcataactccctattgccttcagctcttggcagccacaattccaccttctgtctgtatgcatttgattattctagatacctcattagtggagtcatagagtgtttgtccttttgtgactggcttatttcacttagcatagtgtcctcaagatttgtccatattgtagcgtgtgtcagccaattgatttttgtatgttgatactgtgttctgcggctgtgctgaacatgttcattagttccagtagtctttatgtatctggattcattaggactttctgtgtacaagagcctgtcatctgtgaatagagacagttttacatcttcttttccaattttcgtgcatgcttactcacacacgcactctcttttttctgactggaacctcgagctcagtgtcgaataggaagtggcaagatcagacatccttgtcttgttcctaatcttgaggaaaagtatgcagtctttatcattatgtatgttgtgagctgtgggcctttatcaggttaaggaagttttcttttattcctgttttgagtgtttttgtcttgtaaaaggatactggattttgtcagatgctttttctgtgtctcttgaaatcatcatgtagctttgtccttcattctattaacatggtgtatttcgttgattttcatgttaaaccacccttgcatatctgggataaatccactttgtgtagtcctgtttgttgctagatttggtttgttagtcttttgttgaggagttttatgtttgtattcataagggttattggcctatagatttatcttttgataccttggttctcttttggtacctggtacctgatttgctctggtttgcaatctgggacctttagctgttggttttgcgtccacctaattctgcattgtacaataataattgtttttatgtattcagttttattttctactgtatgcacttcctcctttggttgcaaccttctttgcatcctaaccttagcttagtgcagtgctttgtgcctagtctctcatggctagcaattagtgtacactttttacattttatttatttattttttgggggacatggtcttgctctgttgcctaggctggaatacagtggcgtgatcgtggctcactgtagcattgaattcttgggctcaggtgatcctcgtgcttcagcctcctgaggagctgggactacaggcatgtgccactgtacctggctaattttttaatttttgtagagacagggtcttgctgtgttgcccaggtttgtctcaaactcctggcctcaagtgatcctaccaccttggccttccaaagcactgggattacaggtatgagccaccacacctagtcccactgtacactttttacatgcatctgttaagtacttcatctgcattacccaattaaatcttcacaaccacccattgagggaggtacagtttgagacgtctcataaattagatgatgaaggcttcagagaaataaaataaattgcttaaggttacacacgtagatggtggaattgaggtttaagaccacttctatttgacatttggacccaggggtcttcactgcatgctatgctgcctaggaaatgcttgtttgaatagattggaattgaactggtccttaaaggaaaagtaacatatggataagagtaagaattaaaagagtgcatttttggcagtggtgttggtgttacagtgttagtaaaggcaaggaagcaggaattggaatctaattagagtgcccagtgacagggagtattgtacaagtaggactgttttttgtctccagagcagtaattagtcctatttggaagagtgagattaacatctaaaataattagaaaatgtctgggcgcagtggctcacgcctgtaatcccagcactttaggaggccgagacaggtgaatcacctgacgtcaggagtttgagaccagcctgtccaacatggtgaaatcttgtctctactaaaaatttcaaaaattacctgggtgtggtggcaggtacctgtagtcccagctgctcaggagtattgtacaagtaggcaggagaatcacttgaaccagggaggcggaggtggcagtgagccgagatcgagccattgcactccagcctgggtgacagagcgagatgctgtctcaaataaaataaaataattagaaaatgagtattgtttaattagaggtcaaggatgaggtttgtttggattggaaagaatcatgaagggactagtaattaagccttaaaagaagagtaggatttgggtgggtagatgtagcaaactgagttttgggtcagccttaccacagccttgtaccatctgacaagtcattaggactttctgatcctcaatctctttaactgtcaaaggggaataataccagtgctatgtttcagggttgtgagttcaaaatggataatatctcagagtactttgtaaattgtaggtgtttctgtccttatggtggagtatctattgttttctaagtttctaaactcactaactttcctcaatctgagcttttaattaattttttattattatttttgagaaagggctttactctgtcacccaggctggagtgcagtgtggaatgatcttagctcactgtgcgacctctgcttccctggctcaagtgatcttcccgcctcatcctctcgagtagttgggactacaggcatgcaccaccacacccagttaatttttatatatttgtagagacagggttttgccatgttgcccaggctggtctcgaactcctgggcccaagcaatctgccttggcctcccaaagtgctagaattgcaggcatgagccacctgcagagctttttattttgagttaatttccgatgtagagaaatgcaagaatagaacaaagaacttctgaatatccttaacccttaatcctcaaacattaacatttaatcacatttactttattccctctttttatacatactgttttttaccatttaagagtaacttacagacatgatacccctttactcctaaacacttagtcaaagatcttttcttggtaactacagtaccattatgaaaatgggcacagtaacattggcacagtcttaatagcagatctacagatcttactcagattttgccagttgtctcaataattccctttagagccaaacgaaatctattttttcttggtcaggtcttcaatcgaagatcacaagtagcatttagttttcatgtttgtttagttgcctgcattctggaagtttcttagtttctgctcttcaggaccttgatatttttaaagaatacaggctagttactttgtagaatgtccctcagtctgtatttgtccgttatttccttatgacctgatcaggttatgcagttttggcaggaatagtacagaattgatgtggtgttctcagtacatcatgtcaggagatgcctgatatccttttatcccattattggtgatggttaacttcaactgcttgggtgaggtggtctctgtcgggtttcatcactgcaaagttagtatttttccctttgtaattaataacactattgttgggagatactttgagagtacgtaaatgtcttgttttctcatcaatgtgcttgccttaaccagtagggccaagtagtgatttttaaagtcaaccattcttcttacattagttgatattttactgtaagatttggtacttctctccattcactcactcaatcattcattcatatcagtatggacccatgggttcttattttattcagttgtttgtaattttttattagcataatttatcgctcaaattatggtgctagtggaagcccctttcaagctcaacttcccactttttgagatccatactgtcatctggatccttactgctacctgtttgtatgctattctccttccttcctaaggggaagacatgccagctaaagctaagctaagaaatatacagcattgctgccactctgtctgttgtcctcttttgtgctcatactctgtcacaaatatatattttttattaatttgtatatgtacacgtctccagaatttctttatgcacgtacaaggacatgtaaatatatatatattcatatccctcccaacacaaaaagatagcacactgagccttagattttgttttgtttttccagttaactttaagccttcctgatcctttcacatcagggtgtagaggagacctttgttttgcagctgcataatattccattttatggatatatccattttatttaactactgtatttgcagataattgtcagttattgtaaatagcatgttccccacccttcaatacgatgacccctttccacttccagataactattagttgtccttactttaaaaaatatgcaaaacttcattttatcctattctcttcattttacagctgaagcttttgaaaaaccgatccaaatctccaacttccttacctatttttgctccagttcagttttcatctctactgtctggtgaattctatagttttgaaggttgctagtgacttcctgttgtgtagtgctagacaggttttggtgattaatttaggtaggaggataaaaatgagaaaaggaatggggggtggcaatcaaatgggaaaagaggaagactggaaggaaatagaagaaggtgggatctgcatgggagaaagtaggagaacagaatgttttttggcagaagatgtaaagtgtatttttatttctagcttgtaacatacagctggcttctatgtgaggatgagctagcttgtggtgtgttgctgactgataggctagttgggccctcaggaaagttgcttcctgttttctgtctcctaaagcaaaatagagacacctaaccccttgtcccattattgtcatttctccctctgttgcccagggtggcatgcagtggcacaatcatagctcactgcagcctccaactcctaggctcagttgattcttgggcctcagcctcccatgtagctgagactacaggtatgtaccatcccccccccccccagctaattgttaggatattttgagttatctcagatttattctttgcttgcttttttcactgccaccatgctagtttggggaactacacattcacttagattttcgcaacagtcttctcacccttgtttttgccaatttattgcctattcttacccaacattttccctccctttttcaattccagtcagtgctggtccctgcaattgtcatgctgacaagtctccatacttcgcttgtgcccacacctttctgtgctcctaaaaaatcttgcctcttttgcaagagccagatcaacttcttactgctccataaagccttccacagttgaaacagctcttatacctgtcttacttcactaatcttgtttacaacctgtaccaaatgtttgcttgttttcttatttcagatgtgttcagttgtttctacaaaattgtaggaatttttttcctataaaaaaaatcatgtttcctagctgagtgcagtggctcacccctgtaatcccagtactttggtaggccgaggtaggaggattgcttgagcccaggagtttgacaccagcaccacctcattccagctcggggcaactgagtgagacttcgtctctaaataaataaataagaagtttagtgcttgaggtttctattgggagctggttctgtacactatggaaatctactccccgccccactttaaaattactgtgtagtattccttggtgtgattacaggatgatttaacttttccctattgattggtttttggttatgattttatgctgcggtgtctatctttgtacggttcctttttcagaggcttagatttgaattgatggatcataagatagtgacatttaaaaattcattgtgaatagatacttccaaattgctcaccagaagcttagtgctagtccatacatacttctgatagcaagtacaagagtacccttcagaagggattaattttaatgatattcagggctgggaatgtaggaaaaattgaccatcaagtgtcaggaggcgcaagagtaggaaggggcattctacctccaaggtgtaccctgctcccttgataggcccttgaaatagagacagactctcactatgttgcccattctgttctcaaactcctggcctcccagactcctgggattacaggcctgagccaccatacccggccagaaacgcattcttgaacggtacaagtaaatcatttgtagtggctactggaagatacgggcaaaatttgaagcttagcttgatttgttgtgtggaatcctaatcttgatctatttgttttttcagatcgagatattgcatttcccctagtcaatgtatgaaaccaactttaaaatacaatttacatacagtaaaattcaaacattgagtgtgtaggtgaatgatttgacaaatgtatacacccttgtaattatcactccaatcaagttagaaaacatttccattttcctagaaagttccctcagtggcattgacttttacaggccacctcaaagcctttatacatgagatgcaggacataagtcaagttctgataaaaggggagtctggtttttacagacaacgaggtagattcatagaacttacagatgtgaggtatcctgcaaagtagccttcagggcatggatgattgctaactggagtgttgtcttggtggcaggtgcatcaaacagggtggcccacttaggcctttcaaatccatcagtccttgctcctcttgatagttgtggtaaatgatatagtcagatgtcttaagtgagtctctatgaacatttaactcctggaagctgacgtgtttgggcacaggtgttgttgttgtttttccagttggctttctctgaaggaggagatatgggaaaaagcatgactggttggctgtgatgatagtgttgaagaacaaaacttactcccctctgtgcttacagtatcggctgatactgtgatatttccttgagaagaaatgtctggtacatcttttaagtactaaaggggatatttttggccaggaaaacacttgctagtaacctcatcagaaagtcttgaaaatgaagtttgagaaaggagaaaatactccagatagagaccattacatggagtaaaattatagtgacatagaagatcagaaaaggacatgtctgtaattcacagcagaacatgaagaacaaatgctgaaggtgctagatgtttctgaataagtacctgtgctattttgacacaagaagggtaaagacagccttttgggtgccactgaggactggtgagttggattcatggctaggcaattgagtgcttactagataagctttgtgctaagtaagcagtcctaattcttataaaaatattaagacattgacatgtatggtcatttgcccccagttttttcatgaagaaacagaggctgaagaagattaagtatttttaactagtaatcagcttttaatcttgacttctgcatgtctcagggtaggtaacatgacagtggtgtaacctagttgccgttgtttactgattttactctgctgctctcatatgctgtggctttcttgctccttgacttccctgggattgtagtgtgagtgagcttgttcagtcttactacctcctgcacacagaattcaaaagagagtgagtcatggccacagttggcaggaatctgttatgttactccattagccacatgacacttctgcttgtaacaaaatgacagcgaagtatagcaacagttatcatactcttcttccagttatccttttagctgattttagtagtcctatactttactaagtttttatcaattgtgcataatgtcattcatttcatttttcggtgtctgcatctcctctcagtctgttccatcagcaaagccaacttaaattttgtttaatctcattgcagcgcacctatagcaacaaccccttccagtttcttaggcacttgtctttctccttttatcttcttcaacatccctactgccatatgcattccagccttgataaataatgtgcagcttccaaaatgtctagttcatatctccaaatctctctttttctgcctgatattccttttttttgaaacagagtcttgctctgtcgcccaggctggaatgcagtggtgccatctcagctcactgcaagctccacctcccagtttcacgccattctcctgcctcagcctcccgagtagctgggactacaggtgcccgccaccacgcccctgcctgatattcttagtgtcccctctggaaagcttcctcagggcagagttaggtattttcattttgtgtgatgcttttctttgggtaactggttattttggttgttggtattatgaatgaaggtttagggtctagactttagggtgatgactacaggtagccggagtgagtttcttccgcctttgcaaaggttttttttgcccagtagactccttccctgaatgggaaggctgatctgtgtgaagggtgttgattggcaagctttactttacagtgtgatggagggagtggcagcagcctccagtaagatgggctttgttctgggacaaccaaacccattcaagcacctatcagactcctgtggaaggttttgtttctttagagagtatttctttggcttgaggctgcatttagaagcagctactatctgtggctgtgtaggcatctggatgggaagtgggtggggttgagtagctatggcttttctattccttaggcagtctttttgcttcatgctctcttgctctggtcttctggaaccctctctagagctccaccagaaaggatggtgcctaaaacatctatttcagactgctcttatgtttattcttgggtggggtggcttttgcttttgcttattcatttgctttgaatagaataaaaaagtaataaccctttttcctgaaaggtaataacctgtttcctgaaacacatttgcgcagtctgtcactttgaaatcctgaaccagaggttctgttgacaactttaaccatttgagatttttaaaatttaaacaaactaatatgaagaatacattattagaccaggcgtggtggctcacacctgtaatcccaacactttgggaggtcaaggtgggcagatcacttgaggtcaggagtttgagaccagcctggccaacttggtgaaaccccgtctgtactaaaaatacaaaaattagccaggcatggtggcaggtacttgtaaacccggctactcgggaggctgaggcaggagaatcacttgaactcgggaggtggaggctgcagtgagcagagatcatgccactgcattccagcctgggtgacagagcaagactctgtctcagaacaaacaagagtacgttattgtttcccaagaattgatagaataccttggaatgttgatagaatatgaaattgttgtaatgctgaaatacaaatcacctatttattaataagttatattctaaaaatatttacaaagctttttagagcaaggaaaactaaaggtagcttccagaaacctaggtgagagaggattgtggggaggtctcaggcattgccattagctactaattgatacttggggccagtagcaaggtaactccagcttaaatgatgaagtttacattctaggattggaggaaattgcttgtttcccaatgtaaaatttgctaattttaggttgtcttccttgatatgatattgagataaaagctgtgctacttgtggcttattaaagtgaattgtaccatatagtggctatatagttagggttaggttgcaggttgtgttttatttcaatgaatgataaaataataatttgccatgtcttctaataagagtgaaaaagtgaaaatgaatctgtatgcaacattatttttatttcttaatacattttgggaaacttaattgcaactgtgtggttcagggatttagtgcaagaagaagaacagttgatggaagaaaagaaaaagaaaaaagacgacaagaaaaagaaggaagctgctcaaaagaaggtagtatgtgtgtaaactatttatattaagcagtttaaacatagaattaaaaaaaaattactcttacagattttgaaggcatttatttgatttaatgttttagctttaatggagattcattttaatatttaatgtctttgaatatgcatataaagtaacttgctgagtttgtacaatttaatgcatatttaatcttgtcaatagtttttcaaaggtaagtacattttatggatctttatctttcaaatagctgttcctaggtgtttcataatatatcattttataagtgggaagagcatggaatttgcagccaagttgagagtatttgaaatctcactctcccacatagcacatagaatggtgtgactttagattttatttagcctctctgggccttagtttccttgtgttttgttaaatgagggttgaattgagatgatgttattatatgtaatacagaaatagagtattaaaggaaaatgtaatagacataataggaagtaaagtgtcagtttctttttccctctttatttagtacctgggctgatttttaaagtgtgcagtgtacattagccttaaaataaacctcggacattgtttactgcaagggaattctaaactagctaatttagtataggaaactataattcaatgcaaagtaagttaaaaaaatctgtaattattaaaaattttccatttaattgttacataccaaacaattgtattagtattgttaatactaaaaactgataatagttagctaaatgggcactcatctcctactatgtcaaggtttcaagacattaaaatgctctaaaaacctagtgaaattactgtttcaattatctgttgtaatgaaaaattattttaatttctaatatatgccttttttgagccaggcattgtgctaggaactggatgtagactatagcaagatacttatgtccacattatttaataggggaaaacacaggctgtaaaaatggcaggtgaggcatttatggggaactgttgcagtacagagagagaggtgcataactcaggctgaaatggggcagagggacagagaaatttcgttagagtagaaattaggtgaataaggagcagaatagaaaaggattccaaacagtgaaaactcagaaatacttggtagcctgtatgcattaaaggatgggttttgcttgggggaaagggagggaaccaagggtagaactctgaagagttgaactaggaaaggctaggaggttttctcaaggctttggggaaaatgctgaaaatgttttagtagagtgacataaaagtttgtattttagtatgtttaccttggaaaattgtggaattggtttagagggggtagataccagagtgtgaaatactggtgaagggactattaaagtaatccacagaatttgtttaaaggatatagagggagagtcagcttagattgactcgcaggttccagatgagtgactacatttgagaggagttaatcaggctaggggatacaaagaaaggagaaatgataaataattcagttctgcatgtcctgagcctaggggtgtcatcagcaagtattaggggaggagaattaagtatgagatgagaggagatgatgtggccctagccacctgccttttgcttgctcttaggggtgcctgggaagggatgcataggtatatgccatggttagggttttggtaggcttctcgtggtttggtattgatggatgtcttgggcctctgtcagaggctgtttatgtaggacagtctttgcagtctggtcggtcattgctcgagatttcttatgagaaagttgtgtcctctgtaagtctgaggttggggtaaaggcttatcagactcttgttccatggtgtgaaaggccatttgcccaatgaaaagagcttctaagaaacttaagaggtttattgaaaaggatggttggatatactttatgtagattcagtagtttggcaagcatctgagtgttgaattaggctctgttggtccctgtgtctaaggagttcaagaattagctgataagtcagaatgtatgtgaaatggctagagaagaggcctaagacaatatataagcgtatttgtttggaatttattctatttactgagaaattttaagaaagggaggggtcacttgaatgatgtctttaaatattgtatttttgtgaatataattttaaagttgtaacatatacagcaatggctctaattgttacaagtaaatctttacattcttgtataatcaaatctctaaatcaccaagtcagtataagtggtcacttatgtgtaggcagcttataaataagcctgtaacacatgagtggtgattattgtgccatttgacttctcaccaaatctgaagtgacagcttttcatactgttgcccacttcattcctgtctcaccccatggttccagtctctcacctcaaccatgtccttactagaaccatcatcagaagcttagggatataagaagtttttccttcttttgccagatcttcagcactgatagggtattcctgtgtgtctcatagacacatcatagtatctacccactgaacacaatataaaggaaggtttaatacctctaataaatgttaagtttagcaggctaggccgctactgtaaattagactgttctccaaatttcaaataatcagcttacaactgaatttgaatacaacctgtcggtgaagtgaggacagctggtatttccatagagtgttaccagatagctcttgaaaagaaaagaaaacccccaaatgacacacttatagcccatatgaggaattgtgagtcacagggtttttaagacaggtttcctggaacttgtcttttgtcgctagtaggagccagcaggtgtatccaggcagatatctacatgagccaggtgggcaggcccatttatataaatgttggcacataaactcactacagtaaaaagtattttatgtaatttatattttcttatttttgaaaaaggccagatattatctgttctaatacatttgttcatttttaatataaggaacctaagcatcagaatgaattaagtgattgaccttggttttatcatggtgacagaaccaggaatataattgaaatctctctcctccagctggtgctttgccaaaaccctgtgccatgactttatccttttcatgcagaacattatcttatactttgctttattttttgtcatttaaaggtgaactttaaaattggaaaataatatattgtgataatttttataatagggtataaaataggttcttataccatgaatacagaaaatgcatacatttaatggtccccagtagccactgtggtttttttaaaattaacaccatgggttattttctattttaaataaaaagccagataacacaacttcctataaaaacaattagacaccgacgagccttacaacgatattttcgttttgatagtttttattatcctatcatttaaatattaatttacatatttagattctttaaagagctttttcacattaaaaacagggtgatttgtattgtatttcagccccaatacatttctaattaatatggagaccgatgacttttgttcttaaaattttttgaaaagccttttcatcaaagattatgtataacactcttttctgtttcatatctaagaaccagggctattattttctgattcttgggcttagaaaataatttgacagagcatggaaatgtagtttccatactttaaaaaaaggaggggggtgacagtagtagcagtaggttaccatggatttctctccaggttctgtttttagaagaaatttctccaagggatcttaagggaaatgtaatgaggaggaaaatagaggttgagaaataggttaattatagaggggtagtttagtgtaacctttacttgaagcatgcaattgtagttcctagaaagcatataatcgttgaaggccgaggggaagcaacaatacaagttgggatctcttggtgttgagaatgtttcaacatccatgggctttttgctgttactgtgttaagagctgaagggatttttataggtgttattgacttaaatataccaaattcaagtttaaatgagacctaggttttagagagcttccagctttattgccatttttgaggatcatattcagcagcttaattagtaaattttctcagtaaccttggtggtaacatgaccaggcctgagttgtgctctcatagagggcagttaggtgttctcttacagtcttgcccctcattgcaccttacacttctcttttcctcttttataaaactcattttattcaacagatctggattctagactgagtgctgattgctaagtcataggaaagctctctgagcactaggtgtctcatttaaaatcagtgaattgagctagattaattctttattcttaatgttaggttgtaatacttggcactgttaagacattgtagatgatcagaaaaaaagaaaagcaagacctggaagggatgaatgtagagtcagcttatttccaacagtgagagccaatactgagccaaagcatgggcagataggctgaagatagcagccgccagcgccacagcagcagctgatgtctgctgaatgctttctatatgtcaggctttgtcctaagtgcttttatatgagttaaatccctttaaccttacaactctgaggtgggtgtttttgccacagttctatagatgaggaaactaagctttagagaagttaacacatttgaccatggtcacacagtgtaagtggcagagccaggtaggcagtcaggctttagatcctgaggtcttaacgaagtgtgcttcaggaccatgttgttgggacaagcagtgcagagcctgacaggcaaagcaagtggagtgctgtgctctgccactgcactgctgtcttcagtaatgaaggaggcagttgtgatcattgctggtggaaccatagctcagattttttttttaaagaataatgtattaaaaatggaaatcattttgcttctagattggccagaatcttttaattatctgtatgagaggatttacagtgatacttcacatttgaagtagtgttgtatagtttttcaaaaaaaatctttcacattttattatttgaccctcataataaccctgaaaggtaagcaggacagttattttgtccatttgagagattaggaaactgagacccagagggtttaaatgatcagagcatttcaaagtaaaaataaccagattaattttaatatattttatataacctaatatagctaaaatgttactattttgacatgtcagtataaagtatttttaataaggcatcttgtgttcttttaaaaataccaaatattagaaatttggtgtgtattttgctcatctcagttcagactagccacatttcagtcagtggtcggtagccacatgtggcaagtggctgttgttttggatagtgcagacaattactcttaaaatgactgatcccacctggaaaattctttttaataatttgaataatatactaggtctccagaccagcccgcaaaaacctgttttaaaaaagtggaactcttagttccgtttcttcccattccatgaggagctcttggtttctatactactactttcattccttgtatacattaaatccgattcttaggggcagacacaccttaggtgtctccatggggccattctctgttgatgacagaatactgaatgaggttgaccgttgttttaaagcatctttttccaaaggagttgtatagcatatatcctttatgttgtaaggcctaaaagagcaacatggtatactttgttttgttttgcttttttgtagagatggggtttcgccatattggccaggctggtctcaaactcctggcctcaagcatctgcctgtcttctgcctcccaaagtgctgggataacaggcgtgagctgcacctggcctactttgggtttttatgtggtcattgtttctatgttctgaaacttagtttccattggaagtaaattgtgaaagagaccaggagagtgttttttgtctgtttgttttgtttttttttaagcctttcaacgtgtaaaagaaattttctgctaattctttggcttcagaagattatgcatcttattgtttgacatgacatttctgatacctaaaagtgttcatatactaacttctctctaataagacttgtttttctactctcagattttaaaaatgattttcccagaaacaaatgaagtgttgttagctagttgactggttgtttggcattgtctttccatcaaaattttttttttcatttaaattttgatccatagagtaaaagatgagcctccattattttgtatttcactagtgctctaaaacttagcaaagcacttacgtggtggagcaagactccctggctttctggggaaagattaatgtttggtgtggcttcaatattagggagttactatagcttttacccatatatctataatagtataatttaaaatggtatttttgataacagtaatttcatataactaagcaaaatgaattatgccccatggcagctaagaaaagctttattgctatttagaaacaacaactggttattcagttactaattattcagtcttttctcacctcctttcctgttcttgtatctgttattttcaggattcccataatattgatcttgatcaacagattgatgttttgcttgggtttttctgtctgtggttctttttgaagcccttgggagtttgagctagtcacctcgagttaaccctgctgtcctcaagcccctctcctcagttgtggtgtcagaaaataaaggaagagcagacattggaaggcagtgaaagcagagttcatgtcagttcagcttctgatcacagtaattttaacagattgtcagatgtgtcagaagtgataaatcagtttgaaatttttttccactcaaaaatacttagatacttaaaagttgactaagtttaattgcaatagcagcctaacctccaggagttaaatttattactaatttggctaaagtgattatatgtacagcttttcttacagaaaacctaattcgtctttttatcacttgtaacaatttttgaagccatttaaacatgcaaaatatattaaatccattaaatgtaaaggtgacagtttgtataaaaatcatttttaaaggacatgagaaaagtgcagctcccatttaaaaaattatatactgtcatacagtgatgtcttctatgcttagtgtcacaaaaattaggtattttaaattaataaacatagtatcagggataatggggcacatctgtgggaaaagcatgctttccttgcatatcttttcctgtgcagttcatctatttgagaaattccttgtttaataaaggtgtatatgtcttatattaatatatgaacattttatcataacagtccatttctttcagtttcatatttacattgttttttgtttgtttgtttttattttaggccactgaacaaaaaatcaaaggtacgttgtttaaagctattttttatcccttttttcattaaagcaaggttgtttatgtgcatttttgttcacctcaaggatgggagagagaagagcatgaaagaagcggttgggattagccttcttcagtaacataccctggggtcgtcctttggaatttcatggttattgtggtgtatgtgaccacatttagagtgcactgcctcagacctgccttaaagctgtgtcataggataagagtaagcactgcttcctaatgtactcccttgttttgactcttggggcacaggcacctttccttcagtcttccttctaaaagtcttcttgtgtggggtaacctctaggaccccactgtatcccttaagagttctgcctcctttatttcttgttctctgaagaatgtcccccattccttcttatagacagatagtgacatccatctctgtattatcacttagaatagtagattgcaaaccttacacattgtgtcaggtttgaacagcacccattagaccccaagcaaaagacatcggagtgataaggaaacaggacactaattcctctcagatcctgaatcaggagttcttcaccctcccaggagctacttggtaataaaggtgtaaagctctcaggtgctgaacttattaagcctcaagattctgaatttttattttaagctctatcaaaagtataatcttacccctcaaaaaaaagatgaataaaggaatgaaatggttcaaagaaggaatgaaatggttcaagcatgattcaagacacagagataagaaataacatgatgtggcttgcagtggtggaattccataacatgatgtagtatgcagtggtggtattcctagagcgttaaatattcagtgataagtgggcagggttgaggctgaaaagatagataggggccaggtcaaagtgggttaatttatgtgctgtttgtaccaacaagcttggactttgtatgtgacaggcagttaggaggcattcaagacttaagcagagtgacatggtgctttgttttacgttgttttccattttttaaagctatcaactactgtacatggaaagtattggttggaagacaggtagggatttgaaaggtagagctaagagaagaaaggcattgtgagcagaggaggcaggtagacagcatggggaatacgacgtgcatcttttgtctctagagttggggggaagtgactgaatataggcctggagatagagggagccacagggcttcatgctggttaagccagcaaaggtgtttggatttggaatgtcatggtcataagctgtggaaatttaactttgccagtagtgcctaaagtcaccaatagaagcaagattagagagggtcatgagggtttgaactgaggtcttggcagtagaggtagaaggtgggtgacagatgtgtgagggataattgacaggactggcaactgatgagatcagaagaggagttgaaggcgcatttgtggctttgaacttggaatgtctaagacagttacaaggatgcggaatgtagggaggaacattgccaaattagtaggaatgttaccaaattaattttcctaaaactctattttccccacccctctcccccacatagcaatggtaagttgtccctatttgttcttgcttcaagaccaaactcctttgcttagctttcaaggccctcattaatctaacctcccttgacctaaccagcctgtttcccatcagtccttatactttttagagcattcttagctctttcatgttcattcttgtttcttttttattcaatttatcagccaaagatgtctttatcaggcctttcagctttcctaaacctctcagagttcatccttgaatgggtctctccaagtaccattgatctctccctttccagtttcttaggatgttataatctcaaatttgggcacttggttatattcttacatttttgactgatccttggatatttgtttcttcaacatctttgagtacctagtgtttatatcatttctaaatgtaaataattttcttctagccttacataaaatatgaacatatttagtcttcttgtttttagatttttccacgactctgtagatgataggctgagtatatgaaggtcacttcagaatacattttgttgttttgccagtgatttcactcatgtcatccttcttttcacgctgtctctcttcataattgttcccattttttctgattcatgaaaatgtattgttttatttctgtgctatgtatttgtctaggtagtatttatagtttggggttcacatagtggttagagattacaaactggagacttgaggggcagatgtggcctacttggtggtggtggtgtttactaaactttgtattttggaataattttagatttacaaaaaagttggaaagatagtacagagacttctcatatacgcttcattcagtttccccgattattagcatcttacattaccatggtacatttgtcaaaactaaaaaaccaaccatgatactaacctcaccagtttttccattaacggctttccattctaggatccgatgcgaaatgctgccttgcatttagttgtcaggcctccccagtttctggtttctgcagtgtttttattgttatcctgtacattttaaaatgactgccaacatttaaaaatcagaagagtctgcctattccagaattcctgcttctcttacagttcataatgtcagtatgatttttttctctttctgtgttgtagagtctgtgtaaagaccaagtttagccacatgtggctgtcaagtaccagaaatgggactgtgactgaggaactaaatttttaatcttacgggacaacatagctctaaagtgtaatgggcaacgtaatgacgttcttgaaagttttattcttgtgacttcaactttgaaaaactgtaaagaacacaaatatttgaatatttaaaaaatcttttaaaatatgtctcttacgagtatgtccttgaaacagcaggagagtgaagtgctaaaaaacttcaggtgaggtatagggatagatggataaattttaagatgccctgtggtatatgtaatgtaaaggcaaggaaagagctaatgttccttcttcagagtgtccttgggaacttggttgagaataagaaaattttttaaaaacagttttacaactctggcattgacttttttttttctttttttttaaggagacagggtctcgctctggagtgtagtgcacaatcatagctcactgcggccttgaacttttgggctcaagcaatcctcctgcctcctgagtagctgggactgtaggggcaggctatttttttttctttttctttttttaaacgtgatcatgctacattacccaggctggtctcaaactcctagactcacacgatcttcctgcctcaggctcctgagtagttgggactgtaggcgtgagccaccgcagctggctgacattgggttttttgggaagcatgttgattgtacattcatttcaaaagaataagtaagcactgttgatttttgacagctaattttctctctctctcctgacctctttttcctctgtctcttccccttcttgtctcactccttcatatcagtgccagtgccttttttgagtgatttcatgagcaaggtatcttccaaagagtaataaacccctgagctcctaagggagttatgggaagcccggggagatcctagtgggaaacagcaatggagaaaaaaggattgagattttattttttgggtgataaaatagcgaagtttagtttattactgccgctctgtttctgggttaattaaaaactcatgaaattaagtcaacatttatacattttttcctgccacaattggcacagttattttttatcaattctagccttaatatttgtttttctgtcaaacacaatgttactacatctgggtgataaaaatattcactatctattaagtcagctgcatgtcaaatcatattgtagacattattatagctgacttagagcaccttctatgtgccaggcactgtgctttatttcatttaatcaaggaaaatattctaaatatttaaccactaataatgaatgggtatcagcagttcagaacagggtcctgaaagcttcttaatgtgctaagagttactttagttactgaattttggaaatctttgggatccagagcaggggctgggtattctgggactcacgtagtctatatttaaaaattgatgtgagagtaggccttcagtgtatactagcacaaggtaagtttacgtttaatcctctcagcagccctttgaaagtagatattagcaccacttacaggtgaaattaggctaggaaaaattaactaacttgcccaggttatgcagctaacgaatgcctgagccagaatttgactacgaacttgactgggctctaccgcttctgtttctttaaaaacagcccctgcagttacatggaagacaagatgtgaaggacacaccattgctcatgctgcaacagtagtcactgaataaactaaaacaactcatcttttaaaaggaatccagaaagatcttggaacagattttacagtatttctctattgattaagcgtgtagattttttttttttaaattgtagcaccagtataattttgtgaatcagagaatttgacagctttgtgatgggtgaggcattggctcttaaattgtttattacatctttggttgttgatgaaaatgaacaagagttttgagagccaagcaagcagctgattctaaaatctcctgcatgctttgatctctatgcagtaaacactgatccttctgtggagcaaaaccagagtactaaattacgttcaaagtgtttttttgctacacctgtaagggaaatgtaatgacaattttgctaaaaaagaacccttcatttcatcattcttcaaagggtggaggaccctttctgaagggcttgaataacagttaaatccttttccagtatgcctgttgaccagtacatttgttaaaatcatagcacacagtttagcctctagaatgtgactgagatggctaagtttgtgttgaaggaagaagtttttagtttgtccccttctcattaataaacagagcacctctttactttttctttcagtcatcactgccagtatcatccatgtttcactatctcatgaggtcatcttgagaaacgaaggaaatgaaaaatacttacgtaataatccattattctaaactcaggtttcataaagtgacattatttccttcattcatcattcatgaaatacttactgtttgcctaccctgttttatgcaatgttatggtcactggtaataagcatgaacaaaacaacccccaggttcctgttcccactgcacttccattctcatctttattttggtaaaggtaaatatgtgattaaaggcctttgtcatttacctgtgatctgaacttatcactccattttctccataagatcttgtttattatatatatttaaggtgtacaacataatgttttggtatgcatatgcacagtgaaatgaataccacagtcaagcaaattaatatacttatcacctcacagttaaccctgtttttttggtagaagcacctaaaacctactctcagcgaatttccagtatacaatacaatattattaactatatatcagatccctagacttacccacatacgtgcaactttgtaccctttgacctatatctaccctccctaaccactattctgttctctgtttctatgtatttgactgttttttttttttaagattccacttgtaagtgagatcttggcagtatttttatttctgtgtctggcttacatcactcaatgtcttccaggttcatccatgttgtggcaaatggc

SEQ ID NO: 2532 - DNA, 2243 bp, Homo sapiens
cagaggtccagttaacccaagaagttattctgccccgccctgactcatcttgccgcagaggctcttgaaatgactgccttccacccccttttctcctgtctcctccaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacg

SEQ ID NO: 2533 - DNA, 1311 bp, Homo sapiens
gctgggactacaggcgtgtgccaccacgcccagctaatttttgtatttttagtagagacaggatttcaccatgttggccatgttggtctcgatctctcgacctcgcaattcgcccgcctcaggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatgtatatgagagtatgtgtgtgcacatgttgaacaaattcatgagacaaaatacaactttaggttgcttttggactttgacatctgctcttgactttttatgttgagaaagggatgttgagagtatgaagcactatagcaagggagaagaaaagaaagagagaccagaaaagggctgattattgaatatcaagaaaggaacacatagaaaacaagtaagaggctttgaactgacaatttggatggacaactacattccatttctgatcatcgatcctgtctttgcactattgcttgcacttatcttagcaggggcacttaaaaagcctgaaacgcgtatcttgcctgcaatgtacaaacttatcagaacatctcatatagtaacataattttcagtataagtatagataggaattacgtttaaatttgagtaagtattggactaagattatctctccttttttaaaagttggtaagttatgttaaacaaaaacaaaacaatttctaaaatgatgactaaaagtaagggttgtttaaatccattttataagatttacttccagaagatgaaagtgggaagctgaagtggcatatcatttctaagctatttttgtaggttgaattgcatccttcaaaaagaaatgttgaagtcttaaccccaggtaactatgaatgtgaccttatttgcaaatagggtctttgcaaatataattaagttaaggtgatgtcatactggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgac

SEQ ID NO: 2534 - DNA, 297 bp, Homo sapiens
ctgccctcacctaatggccgataagtctaggtgtgtctagatactcacatatgcatacataatcaaggccagatcttacaaccaagcatgactgaaattctggaggaagggacagggaacagttgatatagatgtggtagggactggtcaccccatagtagagcatttgctactctttgtagtcttttattttcagtttctacatcacgacagaacaaatagaactgtggcttttgggttgggtgtgagccaccacacccagcccctcattttagttcttttacctcaaaaaaattg

SEQ ID NO: 2535 - DNA, 5671 bp, Homo sapiens
cttgtcggttgcttgacctggatgaggtcttcctcacctgagtccaacacatgaacgttggttggcaacagtggcctcctcagttaagtgagagggaactccacctgttgtaaaactattcttagtagtctggattgtgttttttcattttaatagccatataaaattattcagatgattcagaataagcaggatctattttaaggtcccacatgataggttcttacttcagatcaaggaggtgaaaggttttaaagttgggaatttgggataaattctgtattggtggtgtgtaagtttttcttcaccattgttttaattacttacaaaggtaaaacttcaccgtctcctaatgccaaagcctactggggatgggtatttcacttgagattacttcccaatttttattctgtcttccagaggattaaagatggaactctaataccagttatgacaagattcttagtagagagttctccacaaccaggtaaaaatgcaaccaaaaactagtaagttaatttaatgatcgacagttacgaagccaacctccagtgtggcagtgggctagcctttgtgatgggcgggcaccaggagaacgaggatctgtgcctgccccgtaagggtatgtggtctaggagtgatctgtctactccacctggagggataaagggccagctgcttactctcctgcttcagcttcttgtttaaaagaggaagagtttggactagttaatctcaaacatatgagggatttgattttgcagtttattcaataatgagggcaaagctttaggccggcagatgttactttgatgtgtatcagccaagtcacccataccacagctgggatataggggtcccaggcagagaattcatagccaccattctgccagacactggcacacacacacccacagcacccacaaccccaaccctgagacatgggaagtagacggctgtgggttggtggtggggtgcagtctgcggtgccctgagctgcttgcagccctgtggtgggagccagcaggggagagtatttgaggggtggaagtgagagagaggcactcagaaaaggggcccactccagctctgctttcctctccatcaaagaaaagcagtggcgctgggcccagaggaacagacacatttggagcaggaggaagagtcctttcccccggattttcctaattcaaaagccgaaagaggaagactgtcagcaatgtttaagactggaagaaaattagattatgtgtgtgcacgcatgtgtgtgtgtagttctgcctaccaaccatcacatagtaatggctcagaactgttggggtttgcctaccttctctgaggacttgctagaaacacatgacaaacatctccactcacactttgggaggagaaatcccaatgccctgctagtattggcacaggatctcttctgtgcatcctatgatcattcctccaccagcactcgtgtgtgccaggcgctgtgcttgtgttggtgagatgagttgaaggggctgagctgaagtgtgtaggcctgttggcatgaacttgagcacctgagtcccttgaatgctgctaaggataggatggagggacagaggaagttaacatttgagctaaaaggcagaaatgaatcaggctttctggctgaagtgatgaattccaaagacaggaaggattggaacatgctcaggaaactgagaggtgagcttgtttgggatttaaagagctcaaagaaggcgagaagtcaggcaagaaaagaaggctgcccggaaactcgagaccaaggagcttggagtttgcgattgagcatgggaaactagcagggtggtggcctagtcagagctggcctttgggaagggccccagggcacactgtaggaatggattctagaaggaagatgaagaaatgagaaagcatggtaattctagaactgttctctcaaccaggcacccacagagagatgtttatgtgccccactggaaaggcggagaaaactgcttcaggtttcaggtgaccaactcagctctcccagccacaggccctggagatcgccctaagggctaagggagccatagctcacacccctgcaactttccaaccaagttgggaagctctgatctggaagaaatgataaatttggtaatgggttaagtctagaggagggaggcaagggcgtttggatttcaactcttcacctggtgtaccattttatcaaagtgggagtgtattatacttagataaatatagcttctaaaaacctattgggagaggctggctttgactcagactggagggagtaaggagtaagatgggagaagggtattggggagtagaagtagaagtgatgaggtgactatactgttgaaggaatctcactgacgaatagtattgttacaaatttgtatctccatcaccttgggtttccttaacttcctcctatcaacatcttggatatcatagtataggaagtacctaatcagaagaaaggaatattatgcatctatcaaaacaataattatgaaaactatgcatatatgtaaaaaaacactcattttggacacatgcttagaagggtaattattgcttttatattgtaaccttgtatgttgatatataagaataaaagcaaaatacaagtaatacgtagtagtataaaactggctgggagaagtgctaaaaggtaaaatgtaaaaataattcttgtgtcctggactctgtggtcctcactactggactcaggcccttggtattgccaccagagttggatagtgtatgagctacacctgagccccagcagtgagggatcaggaagacatggccccctcagtaggggaggagggagggactcttcctcccactaaggtgcacccagtggataactccaagtaggaagggagttctcatgctgggacatgccctcaaaatgacacatgtccattgtaggaggacaattgagtcatggcattttgtcacaaaattgttttcattttgttgcactttgttttaaaattaatatcttgaaaggtagtgcattcacacgattcaaaagccagaaagcatgaaaagacacacactgggaatgttttcctcccatctttgtcctcttatctgcttagttcctcccaccccagaattccttacgtttccttccagaatgtcttatgtacctacaagtaataaaaacacagattcttattttcccctcttattacacaaaatgtacatcatacacgctgtatatacacaggcatcttgctttttaaatgattttccccaagatggaggagattttaatacatagaaagcttcctcattctttttatagttacatagtattccattgtattaatttgtcataattgatttaaccagtagtcccctgttgatagatactggacattggattgtttgcagatgtttgctattaccggccacactacaactagtaaccttatacatttgttatttcatacatgtgcaagaatctttgtagaattaatgcccaaacatggaattgctgggtcaaagggtatatacatttttaaaactttatttcagtcgtttttggggaacaggtggtttttggttacatgaagttctttagtggtgatttctgagattttggtgcatctgtcacaaagggtatatacatttgatcaaggttgaccaaattgtcctccagtgtgccagttcaccactcacaccaatcatgtaggaaaatctcatatttttgatattttaaaaatgcagttgtagcacagtggctcacctttgtaatcccagctctttgggaggcccagtgggaggatagcttgaggccaggacttacagtgagctatgatcacgctgctgcactccagcctggacaacagagcaagacccggtgtctaaaaaaaatttttttttaatgaagagcccaggcttaggaatcagaccaggctttttccttgcaaatgaaataaaattgcaaatctgtttttcctctctccctccaaacttttttgttttaagcctgttcctaaggtaaggagggcctgaactgctgagaaggaggggtggaggatgggagggaggctcaggaggtttggggaggcagaaggcctcaggtgatttccacacacagaagagtcatgccaacaacttgtccatccagtctggccacagactccacccctcacaccaccagcttggaccgcccagcttcagggtcagaagcctgacctcacagctgcgctccttcacctcccacaattccagaggggagctgtcaccccgaaggaaacaagtctggtcttcttggccccaaaccacacacccagacctattcatagcgagattgcacaacctgctggaggacagcccagccgggcatgggagagcagccctcctcctgtgccaggccctggccctcgggtgcccctgggtgagcctgtgccagctttcagagcagagctgttcctatagtggggggcctcaagggtctgattggctcctcctcccaagtgggagaacttgcttctccaaaggagaagcgctcacgccacccgcccactgccccactgtgcaggttgacacctggttggagggctcactctcattagtgcacacagaagccagaaggcagactgttacagaagaggaagctatgtcacagaagacactctttacgtctctgtggggagcagtgccatggagcggggaaaggagactcaacttgggaatgggacagacctcaatttgaacccagccctgcagtgcattagtagaatggtgacatgtgagtcagttgccttctctgggcctctgtcttctcgtttatgaaatggaaacagggctgcctgtcttgcagggttgggaggctcccatgagaacacgccccggaagtatctgtagcatacttcaagcaggtcaggagcaagcccttcatcaacgtcctcttctctttaaacacatctcattggcccacactccatgggttgtttttttttttagtcttgtaaaacatacaaaattaatctgacattaatgaacctcatcagtataattagattgcaaagtaattaaaaaaatgaaaggtaaccaacttgtaaggtttttctgctcttactattttccttgatgttcttcaggacctgttgacagcaaccgtgctcatggtcagctgcttccattctatgtcctgtagaatcactgtcatgaacaccaagaactcaaacggcaagagagggtgggaagacttgtttctagtcctgactctgccactgaaagctgtgtgtccttgagtgagtcatttccctctccctggtccacttcatgaacattccatactttttaaggggtcatgatgcatgagcccagaaagggagcacacactttacgaactacaaagcaagaaacagaaacagaaccacagacactgctttgagtcagtaagttggcaaatgtgaatatattcattttccagaggggaaactcggatccaaagtggactcaaaggttcattgttacttgctgtaacctgcccttcagcctgccccaggcctccaaagctgacacttatggccatggaaccctgttgggagagttagggtagaggatgcatctgataggatagggaaagaaatggagaaaggggaaaggatggaaaagaggaagaggacttggagatgga

SEQ ID NO: 2536 - DNA, 1414 bp, Homo sapiens
ctagagagctggcgcacctcctgggcctgacgcgggcttcctggattgcataaaggctccttctccttacatagccagggcaaaggtgcatgacaactctgagcaagtcaaaacaaccgtcagcagcgggaaacctcgatgaacaaacaccgggagagtgtttctgcagatcctgctttgtgacttcgagtgaagtgtggaagcgctggaagcacttagaccctgcctgtgccgcagacccctgggaggcaccaacaccccggatcgagaagcccgatgggaaagaatgtctgggaaggacgtcatgcccgaggcttgcgtgacagtttccactcacagtgcgctcactctgaacctctgtgcacacgatgggcctgcatctcttcccactatctgctaggaaacacgaggaatcatgggatttgccgcagtttgcacccaggcctgtgcggatgccccccgactgcccgagatgctgcacctgccactgctgggggtgtacctgcctatgcccactcacaggggcacctccagggtagctgcctggtgcaggcattggctctaagcagagcagcactatgggcccatctggggctggctcttgcctgggcctgtgagcaccatcacagccagccgatctgggagtatccagggtgttcttgtcattgcggacactgaatagccattggtgggtggcgatgggggcttggaagccgagcatcagtggcaatgagaagcaggccctgtggtttaattccgaagcacatgaacccacagagccgccaacagtcgttattcggcaggagggggtacagagacagcagcctgcggagcgttctaggcaggacagggcagcaaacctgacatgcggagctgggggcaggggtaatggggccagggggtaatggcaggtgaggccatggcctagagggttgccatgcttggtgcaggggaggagaggcccaggtgtggctgcagtggcagcaggagtcagtgtggctgtgcccagtgggatgttgtcagagaatggacctggctgctgggaaaggtgattgtgtttgtctgagccacactggactcttctctgaccagcaagcacattctggagatgcggggcagagacgaggcctccgtgagaacctttgaggtgtgagggccttgatctggggtgcagcctccagctttctgcttacagagcaggacctgcaggagctcgctgactgcctgcacagtggaaggaagacctgtttcttttactttccttgaggagaaaaaattaaagttctgagcaaacgcatggcaagggagctcttgctttcctctcttggagttctaggcggctggcgctagtggcacgtggaactggtcacgcacactgggtctcgaggccgtctcctcttctgtaagttgaaag

SEQ ID NO: 2537 - DNA, 6453 bp, Homo sapiens
cgggcgcgggggcggggggcgccgcgcggccggaactgcgggcggggggcttcccgggggcggggggcgctgagcggctgcggcgcggctgcaggagcgcgaggaggaggtggcggcggcggcggaactggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggcctccaccatggacagaggccaggccctgcccctcccaggcagcctggctccttctgctgggccctgaaggcagacgggataatgtggttggccaaggcctgttggtccatccagagtgggctccctgagaccaccaggaagagcccccaaccaatcttgggattctcccttcgtgcggttgtctgggacctttttccagggtcaaagcagatcgtgaggaggaagctggtgagtcttgggacagggacattgaggaatgggagctgggctgtttggattttttcccattgtgactgtcatgccaaaccctttggccttgggctgcggggaggaagcaagggtggccgacaactggaggcatgagtgtgcagcttgaccacagctggatgacggtagttggacttgtgaacgctgtgactgagaactaggagaggtgtacagagacagctaatgcagtctagctcctttctcagagcttccccacagggtgtccgtcctcctctcctctccaccccgcctggatgaggcactggtcactgcggcgagtttggtgtccattggggtatctcaggattggcttctgagtggggcccctgagcccccactagttgggactgagtggctgggccaggggcttggcgttctgctgagccctcagtccctggcctgccccgcttgccgggcccttgcccggcctcccagctgctttgggtgcctgagaagcagagctggagagaggtctggcaagtccgccaaccagcttgccacaaacacgctccgggacctgggccagggactctggcccggcatggaacaggcagcagctccttacgtgggaggctcctgtgctctccttcccagttctcaaaaaaaaattttcccctttctgaacgtgagtctctaaacgaatccagagcctgtgactaaaaatactttaacaataggaaagtgcatcagtctttccggctgggactcgttatcagagagtttttattttggaatttgaaattttgcccacgtaggctgggtggagaccttgggcagaggcaagggaatttggtgggtgctgatgttctgcaaggtggtgggagaccctccaaggcgagaggagaagagagctggccaggagctgaagagactgagagggaaactgagggaggttcaaggcgtggggcaacctttcccaaaggaactccgtgatcttgtctgtgttttccagccccgtctggtggttcttcctgaagtctgatcttattcttttatgctgtatgttaatttcttctggcctgagagggagggagggaggggtagagaaatcactggactgaagatagcctctgtggccatagcctgacctccttaattaactagctctctccagagtattaattgaccactcgctgcatacacagtctagaattctcccagtgctgggtagagccacatctctgggcacactctcttttcctctcactcagcccaggagtgggagaagtagagatggggttactgtttgtctgtagttcctggagcaggagggctgccggctcccccgtccagctgaggaccctgctatctcctgcccctgccaccctccctgccagccccaggattctgctgcaggctgctgtggttgtcccgttgcagacatgagttccacagggccgagtgtgggacttgagtatgcatggattttggtatatgtcggggtcctggaacccatccccctgtagcacttccctgtgccctggaggtactgcctgcctcccgacttccaccctcacttgccattacaggtttcccatgacagtgggggagcccaggccccaggcagtgctacatttggatgtggagcctctcctttccattgtgaactgaattctaccagcactgggcctggtgatgtctgcattaggcagatgaggaagcagtcttggagaggacaagggactggcctcaggtcacacatcaggcttgctagctcctggacaaagatgcctctgatagctcttccatatttcgcccctgctgagagctgaggggaggagtgcggccactagctgacctgcctgggtccctgggaggctggttttggggaggtagtgatacatgtgctcatggtagggcttgggcaagggccaggagagcagagcctgggcctgacctttcacccctggttcccagagctgcccacgggaagcccccagggcagtaggcagtgcttccctgcccacagtgcaaatccccctgcctactgccaaagcaggaagaggaagtggccgggtcagggctggcaataggccctggggccgaggaggggaagctcccagggccacttctgagctggagaaggcaaagctcactccttctgcccaccccaggggaagggtgtggaggcccatgggtggggacagtctcagtgaaagtagggcaagttcctgacctctactcagtaggggtggggcccagcccaaggtggaggggcagcgtgggaaaagggctgtgtaattccacttccttcatcccctgtttacccatctccacccctaccctctgggctggggaatggtggtggacattggctgctcacttggggcctgccctgggctacttactactgaggatgcacaaaggatcttcccaccacggactaggagacagtgcccttgtcctcatgttgttcacatactggtcggtgagggatgggtctgagtacatgataaatccctgggccccataagatttgactaggaggggtaagggcctggtgaactgctcagaaaataaactgtgttgtcagcaggaggacccctttctactatgagatattgcattccctgctaatcatacttgtgctctatctgttgatagaacaaatacataatgagaaacagccactgtgctttcagaagaacacacttgaaagaatttgttctcaataaattacatctgcatctggatccatatgaagaaatacgttcctctcattcaggcgtggctattttaaaataaaatttgggccgggcacggtgactcacgcctgtaatcccagcactttgggagtccgaggcaggcggatcacgaggtcaggagatcgagaccatcctggctaacacagtgaaaccccatctctactaaaaatacaaaaaattagccgggcgtggtggcgggcgcttgtagtcccagctactcaggaggctactaggaggaagggaaacagtatgcacagtgggtgaaacagtatgtgcaaagtgggtggtgggaaggtttagctcaaggtccttatatggggtcggtggggaactgcggtgatgagggcagatggataggctgggccgtggtgtgggggcctgactaggtggggctgtctcgtctccatcgtgacatctctccccgcccttccatgttgtcatggccttgccttacctccaggtccctgtctctagttttggatacctctctcattattacctgttccctcctaccccatctccccgacaattagctgttcactctgaccttgttcttgaaggttagacttggaggggtgtgtgctgggagtctgtggccagtctgggaccagcatttgttttaggcctcccaaagtccacgtcaattgtgcctttctccaaagttccactagctggaccccactctctcagaggcccaggccattctcccttgagggcccacaaggcctgggatccccaagcccctttcacctctctcgcctttatcttaggctaggtgctccacacgggaacctgcattggtggccccagctgtgtttccacagagggactttgcctttttctccttatttacttattttcagaatgtggtgtgttgagcacccccaccatctcccacccctgcaagcatgaccaggtggcagctgtagttccttatcctcctccaggctttggggcagcaggactgcagcctccataacctgcagcagcttggggaggtggggcctgggctgcaggcccagatctggaggctagatgctgagattcagaccagggacctggacagctcctcaccacactcagttttccttgggcttatgggtgggcctaccccacaggatggtctgtgccactttttacaaatgccaagttgtgaggaggagaggagggtgcctgagcttgaggctggttcaactctcaaagagctagcaaggctgggccgagggcggtggctcacgcctgtaatcccagcactttgggaggccaaggcgggtggatcacgaggtcaggagatcgagactatcctggttaacacggtgaaaccccgtctctactaaaaatacaaaaaattagctgggtgtggtggcaggcacctgtcgtcccagctactcaggaggctgaggcaggagaatggcatgaacctgggaggcggagcttgcagtgagccgagatcgcaccacttcactctagcctgggcgacagcaccatctcaaaaacaaaacaaaacaaaaacaaaaaacaaaaaaagagctagcaaggctgagattgagcacagactggtcaagccacagataacgcacttgttcttgctggttggcaggaagaacaatggcttggctgatcatcttttgctacctattaaaattggttttattttggccgggtacagtggctcatgcctgtaatcccagcactttgggaggccaaggcgggcagatcacaaggtcaggagatcaagaccatcctggctaacacagtgaaaccccgtctctgctaaaaatacaaaaaaattagctggcgtggtggcaggcacctgtagtcccagtgactcgggaggctgaggcaggagaatggcgtgaacccgggaggcggagcttgcagtgagccgagatagtgccactgcactccagcctgggtgacagagcgagactccgtcttaaaaaaaaaagttagttttattttctagggaaggccctgctggggtggagggagacatcctggggcaaagtgggtgctaggtgaggaagtcagcctgtgacacagctgggatcagttccacccagcaagacttgctgtgtgctcctgagcaaagtgtagctcctcttggaacccttgactcctaatctgcaaaatgggaggacttgaattctatatgtggttttaaaccttttttttttttaagctgtggagtcattttccacaaaaggattccacaaaatctaagcaaaatcttacggaaaagcctaagagaaagaaaagcaaaactttgcctgaaatgaggtagggatcctggatgggtccaattggcatcatcctgcccacacttcacattcaaccagtggccttgaaggaagatggtttggagcaacccagagctctctgcagatgcattcacgttgagactgtatgctgggatggagggttctggcaggttctgaccagatgactgaatgccatcagcattacagtcaccccttggtttatgaagggggttggctccaggaccccaacttgtactgcgaatactcaagtcccactgttggccctgtggaacctgtagatactaaaagtcggccctctgtatatgtgggtttttggatccatgttggattgaaaaaaaatccccaaatccccatatgagtggacctacacagttcaaacgtgttgttcaagggtcaactgtgtatgaagactgctccatctgtggtggacagtgaggctttagaaagaggagacaggcaggctaatggatggtcttcatgggtgtgggaaaggaggagtggtcactgggcgcaggcagttggtctgtgggaccagtgaggcatgggctgtggctggcagtaggaaagcgggagaggctgagtgcagtggctcatgcctataatcccagcactttgggaagccaaggcaagaggcttgagcctgggaggtccaggctgcagtaagccataatcatgccactgcattctaggctgggcaacagaacaagaccttgtctcaaagacaacaaaacaaaacaaaaacggggagaggaaaggacccaagagatgttccaaaaaagaatttcaggaaacagtgaaaagttgcaaatggggcatcaggagccaggagcagagattaggtggcaggcagggggtgcagaaatgacaagttctgtctggaacagatgaaatttgaggtgcttgtgggacctttgagtgggcagaagcggg

SEQ ID NO: 2538 - DNA, 7673 bp, Homo sapiens
ctttcctttgctgtggttatggccctgagtccttaaattataggctctcctgcagtttcaaaaagctaattcacactactgtgtgcattagaaaggtggtatatatgatattccactaagggaaaccctaggaacattaaactcctactagtaactggtcacgagtcagggctagaactgacactagtcatttttcttcactgacaagttttcattatgtggctttcccagaacaatttagaaattgatctgcaactgatggaagctgggatgaattgggcgcataagtgaacccaaagcatcagagcaaagtcaaagcgaacatctggctccagctttgagtacaagattaataaaggagtctctccatatcctctctgtccacgttcgttgtggacggggtcaccaggaagatggttcctgggtgatgagagtgtccaggacattgtcttcggtggactactggcacagggacctgaataagacactgggatttacaaagtggaaaagaaatcactgagggatccctcaagccactgaaaacatgtaccatttgccataaaacagcattaaacattaagtcaacagattgcacatgaatatcaacaatcctgcaaaaaaagccagtcccttaagaaacatcaagattgacagttgtcatcagagaaatgatgaggaccaggatcttcagggtaccatctggtgctgtgtttgaagaaaatgagaatgagagatatttcctcaatagatgaaactattggccccagctccaaattcacacttgttgcagcagttaattctgcaaaatcacagaaggaaaaaaagtcaggccaaggttctgccttgctctttcttgaatcacctgctctggaggaagccagttgcatgggaagacatccaagcagccatgggttgtgtagagagaaactgaggcctgccatcagtagccagcatcagcctgccagccatgcaaggagccagtgtggaagccaatattccagagccagtcaagctgacttcttgactgaaactccaggagagaccctgaaacagaaggacaaaaccactcctgagttcctgactgatagaaactgtgagatgataaatgtttttgtcatttaaactagtaaggtttggagtaatgttttgcagcaataattaattaaatagtaaagaaaaaaatgcactaagaaaaatccaaagtgatataggggttatgaggaaaggtttcatggaagacatagcatttgagtgaagccttgaaaaataacaggatttagaaatgcagggatgagaaagaagcccattccaggtagatggaacaatgtgtgcaaagctacagaggtgacgatttgccagggattaggcaaacatcaaataatcttgtttgattgcaacattagtccctctcatttgctccaaggttgtcacttttgtggtgctgaggctagatgtaggacgatctcttgtttgaagccaaaaaagagataaacacataaagctgagcctaaaatttagcaaagtaagctcagtaagtcagagaaagagtccaaatagatcgccttctatctctcttatccaagaaataagcaagccttgtatgccactcttttaagagatctatttggactccttaagaagggtccatggggcagcccgagaaaaagggagcaaggaactcagaaatggcatctattcagaatgcaaatcttatggatgagtttctctctaaatctacatgtgacttgatatatttggcagactaactccattgaaagataactcattttataatatggcatttacacaaacatcagagaggaatagtaaaagaaagtaaaattatagtataggacagtattaattatgaatatagatacaaaaatcacaaaaaccaaattcagcattataggtaaaacaaatagggtttatttgagaaatattggggtagtttaaccatggaaaatctgtatatgcaattacattagctgctacagaaagaaaaaccttttggaaaagttcaacatgcatttatattaagaattcttagaaaatcaggaacagaaagaaacttctttaacctaaagaacaatagctatacaaactttagaaaacatactttttgtaaaataatagaattatttatggaataagacagtgtattagctaggggcaatgcttgctgttagcagataaatctcacattatcagaattttaatgcaaccagcaaagttgtttctggtcaacaggtaacactgccacgcctaactaaaagaggttgagaaatttagactatttgaaaatgtagactgaaatttggaccagaaagaagagaaaatgagttggctattcacctagcagttactgattgagtctttattttgtagttaccaaatacctatttcattaaaacatattaaattaaattaaactcttaaattaaattgttcattaaaacatcatgcataaagcatatccactcttgctcagagaaacatccaaagtcctatcttgtgggaaattcagttcaaagtcagcgttccaggtgacatgcattcctctgcattaggtctgaatggggctttttgtcatccagtgatttatgaatcaaaaggaaaatcatatactccctcccgtccccacctccactatcatcatggatagtataactccaaaaaacatatccattcacaaaagtgacaatgggagcacataccaggaagaaagccatctaattctgttgggtgggtattatgagttccctctgcctgacattggaatcattttttggttatatctcaattctgctctttgggaggaattatcttgtcctcagcacccctagagattccttttgcccatcattctttctaaaatgtctgaaatgggttaggaagtgtataatccttgggggctatatagaaactggatcttgcttcctgcttatataactttggggactcaagaattgtattagagctcaaatggtcagagatattttttatgccagtcttgcaatatctttcaatttagttatctcaaaaaaatagcagggggaaaatatggcagtcccttacaaatttgaacatgtgtttaccatatgacttagccattatactctacagcactaatgccagggaagtgaaaatatatgttcattcaaaaacctgaaggaaaatgtacgtagtgggtttatttgtaacagcccaaaactagaaatgacccaaatatccttcaacagaagaataattaaactctgtggtacctccacaccatggaatactactcagcaatcaaaatagaaaaactagggacacgtgcacagaatagattgattttgtattagcttcctattgcttctgtaatgaccacaaatacagtggcttaaaacagcacaaatttcttctctgacagttctggaggttgaaattataaaatcaacattttagctaggctaactcccttccagaggcttcagggaagaagctgtttccttcccccttttcagcttctagaagctgcctgcaatcattggctcatgaccctttccttatatcactctaatttcttgcttccattgtcacatctcctacttttctttaacctttttttttttttttttttgagacagagtcgtgctctgtaccaggctggagtgcagtggcataatctcggctcactgcaacctctgccttccaggttcaagcgattcccctgcctcagcctccctactagctgggagtacaggcactcgccatcacactcagctaattatttatattttagtagagacggggtttcaccatgttggtcaggatggccttgatctcctgacctcgtgatctgcccacctcggcctcccaaagtgctgggattacaggcggaagccactgcgctgggcctatctccctcttaaaagggccgttgggattattttaagtccacctggagagcccaggatgctcttctcatctcaaagtccttaatcacagcaatgatatctcttttgctgtattttctatattcatagtttcagagaataaaaacgtggacatcttttgaggtggggaagcattatgctgtctaccatagatcaaagcaattaggctgaatgaaaaaaagccatcctcaaatgttatctagtcatgactccatttatacagcaaaatacctgtttgttaacaaaaaagacaaaactcaaaaatgtagctcagatctgctaaatggattttaggtttaggcaaattcaaccaccttgccacaggtaatcccagcaagaagttgcagatacaaacttgagctttctgcagtcagattcattccccagagaaaggcaggagaaactgagctccacattccaaggttttccaatctgctaattactccacctctcaagatacattagtgcgttatgccaactgggtgccccttgcatgaaaagaaataaaagatatagggaagaactattccttttaacaattgtattgtttaattttgtttaggcttagcagtgcatgagactcttatactttttgaaggttgtacatatttcacaataaaattaaaattcgaaataatcaagagaaggccctaagactgtaagaagtacgttcattgtggagggctttcatgacaattctaaatttgggacttttgagggtataaaatggaaagcaattgagactttgtaatcgaggaagtaacaagttcagagctgcattgggagatgactgcaatgactgtataagataaggatgaataccgagggtgtataacaagatcagcgagaagaggattgccattgttccacctggaccaggttagtgaccacagggaggggaagcagggagacttaggagtatattgtgatatactagggaagagtatctcagtgttaggaaatgtcagctttgtaagtttttatcaagcagctcctggtatagtgtatgggttcagtaagacatggaaacagattagttgtatgaagaagggggcattaaagatgaggttaagatttaatggtatggggaatgttgggatcattaatatgaagaaattaggaggaggggtgttagtgaataggagcaccaatggtgagtttttgacagtctttgccagcttaagtttgtatctagccacatagcgagatgaggcattaacttataataaagataaatcaaaagctccccatgttccatgaatatctattctcatatcccggctgtttaagactttcaccaaaatttcttgtttatccttcatatagatctcgcatatttttcaggattaattttactcctacatatggtaatagtttctattgagatgataaatgaaatcttcgtatccattataaaatgataagtagttattacaagtctttaggaaagctctcattttttgtgtgtttcacatgaatcagtgttctgctctattgctctgagtatggctggcacagaaagagttaagttggggaggaaagctcttggtttctatgttttttgtaaaatggcattctgttctattgctgtaagagcctagcgggagaaaaacaagcagggccagggtgcaacagcggctggacagggagaaagcagcagtcaaggagcattcagggcacaaggactgtccgtaagtggaagcatctactgaggcttagacgaatataaccatgaatatcaataagatccttgatccttctcagcataggtgagtgtgctggggccatttcccagctctttgagagatgaggggctattacgcccttgcactttttaacctcctattctgtagagacagcaatcacacactgccataattccattagttaatgaatactctgagaacttgtccatcataaagatacacttaaaagttaatcaattatctcttttcttaatgttttctcccgtttcttataccttctcatttaatgaaaccatactggaaatatttgattaattcttgaatttaagattttcatgtgcttgtacagataggttgagaaaggaaaaaagtatttctgatttttcccctgtttttgctccatattcccatttcaaattcttgggtagtgtggtctagtggggaaattgcaaatttgagatgagcagttcacctctgccccatggcaagctgatgattttttttttttttttttttttttttgagatggagtctcactctgtcacccagtctgaaggcagtgggacaggatctccactcactgtaaccttcacctgctgggttcaagcagttcgcctgtctcagccttcctagtagctaggataacaggggtgcaccaccatgcccagctagtttttttgtatttttagtaaagacgaggtttcgccatattggccagtctggtctagaactcctgaacctcgagtgatccgcccgcctgggcctcccaaagtgctgggattacagacgtgagccaccacacctggccaggctgatgacttttgtgctcttctttgctgagcctagactcggcttcagaaccctaatcaattcaggaaaccaggcaaacattagcaatcaatcagttcccaaaggtagatgtaattagccaatttccatctaataggaggaaaccctaaattaggactgggatatcaaactcatttctttcagtagctagctgtgactttaggcaaattacttaacttccctttgcctgtatccctcctgatctttacctggagagacttcagtagcattatgtcatatgagcatttgactttgcaaattcaactatacatattcagcaaataacagcagcactgatagttttcctaccacaaagccccaaatgcatataaactacatcttctggtacgcaaccaaaaaaaaaaaaagtaatctttttcaatgcagtaggaaaactggttacattgccctcataaggaagacaaaataaacacaaaatcatttgtgctacattttatgagcttttaaagagatttttgaagggcaattttaattctacacaatttttgcctgatgtgctgattttagatttaatctcatttaagtaatgaatgcactctagtaaatgtcagagctaatgagtggctgtgaggttaagtgaacaagaggggtgatagcacttttgaaagttaaaaaaaaaagtgctacccaaatatatggcgatagtgtgatgatggaggtggtgataataagaaagacaccctgggcaccctgagtgtcaagagaacattaacattttgctaatgagacattatcatctgtggtcaccagcttatatagtttggatatttgtcccactcaaatctcatattgaattgtaatccctaatattggaggtggggcctggtgggaggtgactggatcatggtggtggatatctcataagtaaatttcactatccacatggtgctctcttcacgatagtgagttctcactagatctggctgtttaaaagtgtgtggcaccggccaggcacggtggctcacgcctgtaatcccaacactttgggaggcccaggtcgggggatcacaaggtcaggagatcgagaccatcctggctaacacggtgaaaccctgtctctactaaaaaatacaaaaaattagccgggcgtggtgtcatgcgcctgtagtcccagctactcgggaggctgaggcagtcaaatcacttgaaccctgga

SEQ ID NO: 2539 - DNA, 5114 bp, Homo sapiens
cggagtgatccggctgcgggccagggtctgggaagggggtggtgggtcgccgtttcatcagaagccggaggacgggcgccagggggcaacttcctacaggagggcgtcccgttagaatgacagggcttttgcaaaagtctgacacccgtggcacagagcgccccagatatggagggtttcacaggctcatgtgtggcttcttcagtcctctcttcattcactcatgtattcatttattcaacgacatattactaaggaacctccttaagccgggatgctgaacgtggaaaaataggtgaaatataattttacccctgagaagctcataggctaaaaaaaatattgatttgggataaatgtatgttaagttgactcttgaacaatgtgggggcttggggcaccaaccccctgtgcagttgaaaatcgacatataactttgactcgccaaaaacttcactacaatagcctgctgccaacctgaagtcttaccaataacatcaacagtcaattaaacatattactaggctgaaaaggagaaggaagtgaaggggttggtcttgccgtctcacgagtggcagaggcaggagaaaatccaaatagtatagatgttcttcaggctggatgcatattgccagatttgaatactaaccttttaggaaggttagtattgacctttcattcttgctactggggaaaattaagttaaataatctcaataaggtcttggtttgtggacttggggaaaattatagctcatcttgcaaaatagccatatgagaatttttacgaatgaatcatttactgtatgcctgggtaaaaatagcggcacaccttatctagtgctttagctttgaatctcaaagtacacagccaatttgtattatgaataaggacttcataacccatattgtcgacttaaatggtattaagtggtggctggtcagggagaaggtggagaggctagaaaccagggaataccaccttgccaaaggcttaaataccattaggcagaaccagtatatatttatattctttgcttattcatcctctgttcatgactagtgtggtcataaattatatttaaacctgtaactttatatacatataatgcaaggcatagcaacattgcatgcagaatttcatgacaagtggcctgcatttttgtgaggaaaaaaaaatatgtcaagctgcttttaggactgtaactaaccacttggctattgcatgccttgtgccttaggtctgggatgtttctcttgcatgcctctggaatcaaatgactctgatactgcaagcacttcagagtatgtataagcaatttcagctggttccgtcctgatatttacaaaactgcctggatcatacttacaaccatgcaatgatatatatttctattaagaaagcaacgatttgcttgaaagatgaaggaaaacaaactaagtatttatgtacaatgagtcctaagtgtacaccactatgttttccatcagcttttgattttctgtcactcctctttttctttgaaatttagagtcagaagtgaactgacttcatggttttcctcatgattatttgatatcctctagggaatcatgacttaaagactgcattcttccttctcaaaactcatgttaaagatttctccatgcagagccacaggctattttggagtttgaaatggagcagttaaaactaggaggtcacacacgttgagattattccttcactgcatctcgcccggcttgtgtgcctgaggagacacgcatctcagagggcagaggggcagccgttgtctagtgaggttatttcacctactatataataaaatgtacaggacaatagcgcatttgttataaaggctactcgagtttgttatacaattattcttcaccaaaaacaacaacctgataactcactattagtatgagtcttacttggtagatagccaggactataaaatatacaaagccaaactttgccattatttccatctaaaccttagagattgctataaccatatattcagacttaacaaagatatttggcaccattcccattttctttctgttaattctttcgtcattttcaaatgcaaaatcctcccaagttgggggtcgtttgtctcttattttagttgtggccctttgttccaaaaagagaattaacttatcctttcttccctgagtttaacccttattcttttttcttccttcctcctttttaaaagtattcctcctgagtttataaaatctagaaatttctctcttctaattttgtaagattagtaaataagcaattctgtcattctcccctcttataaatcagcactgtttatcaatttttaagaacagtcccaagacatggtttatgaaaagaaggaaccgattgcaaaataagcgaggaagtttctgatttaacttcctgctgaaattcctaggaagaaagacaaaaagctgaagactcacataaccctcatgccctagagataatgaagtgtagggtaagatctcagtcacctggtggtcttggatgagtatgctgactctgccacaatgagctgtgggcgtgggggaaatcacctgcccactttgtgcctctgtttccagatctgcaaaatgggaatagtaatgcctgcttggtagggttattctgaggatttcctggaacaatatttatgtataatcaggatgacttgctccacaaaacccaagtgcaaaaaagtcacatttcttgatgattctaaatacagtgaaatctggatcttaaccctccacctactaaggccagcaagaagcttaatgtcaattggcttatgtggctcatgcaactgggaacaggtcctttgttcctcgactctgtggttacagcccttagcactgctccttctgcagcccagcctctgtgcaggtcaggtcctcactacccactggagctactgctcaaggcaggctttggtgatgcccacttggcaggcctgacaggaagctcatgcacccccagagagaagcctcttccagaatgttggactcagatggggtgtcctaccgcctgcagaaacttcagtcccgcagctcgcagactttggggattcaccccctttctggggtggatctttctgtaaatccacagaagtaccaggctggagctcctcccactcttggacagttctggccccttcttgggagggcccagaattcccaaacactttatggaagcagtttctccagaggctcctggaacatgaaggagctgttagcaccactttgcggctaaaagagccaagaccttggaaaacaaagacttgcctttccctccattataagatgttggggtatatgaaaatgaaacacaaatttacatgctgacacatttgtaaactatcaagtgtatggtgactattccaagggcatcaccagtttgccaaatttccccgtgaaatagttttactacaggaaacaaaagaaaattttaaaaacatcttggattgcaggaagacatggtctatgaattacagaaaaccacacacagagataagatgaaaagttaggaagacaagatacaaagagagatgcgataagaatggatgtcaaaaaaaaatgcaatccaagaattaaaatccctcatggaggtggaaagaagcaaaattgacagtgtagaaaatggaaacgttgatttggaggtgaaccttaagaggtcttttacaggaaaagagcatagagttagacatgataagtgaaaataaatagttaactaagaaaagtgatagattctgataaatataaacaatgggaattcagtttaagacttaacagtattactaatcaagaaaccagaacaacagaaataagtgataatgactttattgaagaaaacattttcaggctggaaaaagactggagtatatagattgactgggctcacaaattccaggtaaaatcaattttaaaacacccacacctagacacatattgaccacattttttagttacaaagaccaaaaaaaaaaaagaagaagaggaagtgctgcaagttatccacacaggaaataccacccccaatcccaaacaagttgttgatggaagaacaaataccagactgacttctgacctctttgtactactacagtcagaaaacaatggagaagcatctaaaagcattttatattcagccaagtcaactttcatgtgtaaatgaccttgcttcctaataccccctagttttattaccataatacagcaaggagactgattagtactcaaaagagtagttattgtatcttatccactatggtaatttagtttcttgatgagattctaaagttgtatgaaaatgccaattttatgcctccccatctctctgtgtgttttaactttggttttaacgttcctctaatctggcagtggtagtgttatttgctgctgagaaaagaggtctctctcccaatgacttctttaacctcatctctcccactccaagggtggtccttttgtttgccttgccactgggaatttctactttgtgggcgtagtgtttgctcaggtggaagagctccacatagcaagcctttgtcccttaattttactccaaatgccaagactttgatttatgaattatattgaaaaactggcgattattagagttaaaaggcctcttacatcttctaggctagcatccttggtttacaggtgaaaaaaacagaccgagaaaagagccatcacttgtctagagtcaaggattcagataccgttcgtgttaggaccagctaggctcctggtttttctgcatcccgcaccagactgacactgatggacaagatctattggcaggcccaagtgatcccatcttcaccatgatgaagaagttcgtgagtggcagggcccaaagcctgtggaatggccaaaggcaagctaatgcccggtaatcaaaaagtcagtgaatttccaacaataagcagaggcacaccttcaacatagcacctcagagccattgaaaactcaaggtattcattctagaaaagtccaaggatacagaagacatgctttagccagtttttcaaagttcttagaaattttgactttgggcaggggcacagtaactcacccctgtaatcccac

SEQ ID NO: 2540 - DNA, 7083 bp, Homo sapiens
aaaaagtggggagtgcttggagctcccaatttcagcccgcgaaagtctcccgactcattgctattcttgggctcaggaaattgcttaaacgcgatctgattgccagcaacgtgcaggagaagtggggggtccgggtgtcagtttctttacgtgcagcgctcgccctcgcgcgcgctcgctcgctccggctccctccctccctctctgttccagcagaggctgggagttgccgctcgatccagctccccttctctccctttttagcatttattgccttctttttgtcctttccaacttggagagggtccgggtgtggagcgcgcgtggatcggacgccttggtctgcgcggccctattcattcgctccccgggcagccgcgtcgcggagagggcggcccctttttcccccattttttcaataccccattaagtctgattgacagttaaagttgttgggaggcttcactaccgttcctctgagtggctgctgcggcctcccctccccctgcgccgtcgcggggagcgcgcataaggcgcgcactcgggctcgccgggactcgcgctctcccgggactggctcccctctctgcaagccgggacttgccgccggtgtccctgagggctcgcagctgtaactcgaacacgctggaaccgactccggcgagccggctgccttctcgagacgttcctccttgcccgggccgcccgcgggccaggtgatcaccccgagtgtggagcaggcccgggggagcttgcgtatgccttgatccaaccaggtcacccagggttttatttcaggtcatttggtcatcctcggcctccaggtaggatcaggaagccactcctcacctttgctcggacctcttctgtgttcacgtagagtggacttttaaaagcctgacccaagtgcctcacgatgcttagggggaagccgctggggagcaggactttgctttgaggggagggagtagtcaaggtaaaggaacctctgctccgagtgccaataaaatccccacaagattagctgggagcatatttattgctcatctgagctagaattaccttgactgacaccaatttccttaataacaaaagcctgtaaacaaaacgtcctattcgtgcgcccctgtgctgtgcagccagcgtctcctgtccttgggtctccctggactgccctggcggggcacccaccttctaacctcctgcccttcccgaccggaatgtctcccctgctggagggtgggaccgagctatttagagttgtctgttgcaggaagtctgggaggtgagtcactaaaaagcagccccagttcaaagtgctgatgggacttgcctcccgcccccctgcacgttcccggggccggaggagcgagagcgaagcagggagctgccctgtaatctggggcagccgtttccagcccgcgacttgttcagacggcgattcctgggcctcacccccagagattctgattcagcagggctgggtgcgctgggatcggtactttcaatgctccgcctggtgagaaagtcacttcgaaaaacgctgatctgcggggaggggaggctgggattacctcgtcacctgcaaagacctagttctggggagaggttctgcaggggaggatcttccttctgggtgaaaagccactggaagagcaaaaggcaggagaggcttaggatgagcaactgtcctgcactgagggcctatattctgacacagtccttcccctgaccttgcaatcgggggactgttatcccatcgtccaggttacccagccaggaagtgcaggaggggggatcccaatccaaacctcttcccactctgaccagacgggaggagagaagtggaggatggggttcagctaagggttgcagagcagagacccccccacccccctaacgcccccaagagtctgaccgaagggcggaccaatgtctccatcagaccccagggccggaatccattgtggtgacggcctcctctcatcttcgaggtctgtaaaaatgggaaagcgattccagcctgggagtgacaggcctttcccacccagcagcggctggtgtccgccaggcctgcgaagaagcctggaaagatctgaagacagaaccaggctgcaaaagcgggctttgctcatctgttgtcctcggagccgcctggtggcccagataggatactgcgcctccgagctgcccggcctccaacccagcggcgttcctgctaactagccatgcttttcttccaggcatttctctcatgtaaggttaacaccccaagtctaaaagggcttgtgaaggtcatagtcctcctcccccaccccaaacacacttttatggctggggaaactaaagccaaaagatatgaagcaactcatatacagagatgcattttcaccccggtcagatgccagaccggctgggtaaccgttaggtccctcttacatctctctggttgtgtgcctgggatggagggcagacggtgggaaggaggtcgggaacccaaattggcctttagtgcctcagggcctttacacagtttctgattgaatttccttaacagcccagggaggctcgtgcccatttattgcaggaggaaacaggctcagtaaatctaagtaacttgtgcaatgccacgcaacctgcttctcaaaaggtttgggatgaaatcagagggaaaaagaacatgtcagacattccccaaaggaactgacagttccagaagctggcctgaggtggatggtggcctttttttctacttggtccatctttcaggatgtggtttttgtgggactggcagctctgcaagccacacgtttctcccagcatcaactgctcagagagaaacttgtcacctcctctgttgccctcccccgaggtccctgggaagatggggccaaggagaccttgtgtgggggtgatgtgtgtgtgcacagttcagcaggctggccctgagggtcgtgtggcctggcttcagtgagaacagcagggacacgtcctctctgcctttccctccctcccccagcctttatcctttgctcttgtaccctctcctggaatttaactcagggcagagtttgaaatttcacatcccaggtctgtccctgaaaatgtgaaaggaggctttctgggcttgaagggaagaggcgagctgcagttgggagaactaactttttccgtggctcagctcccccggtgcagcgaggatccacactcaccctgtggttcctggaccagaagcctgttagaaatgcagaatccaggccgggtgcggtggctcatgcctgtaattccagcactttgggaggccgaggtaggcggatcacctgaggccaggagtttgagaccagcctgggcaacatggggaaacccagtttctataaaaaatacaaaaatgagcctggtacagtgggatgcacctgtaatctcagctatttgggaggctgaggcaggagaatcgcttgaacccggtaggtggaggttgcagtgagctgagattgtgccactgtactccagcctgggccacagagcaagactctgtctcaaaaaaacaaaaagaaatgcagaatcccaggccccaccctggccctcctgaatcaggctctgctttttactgaacgagatccccaggtgctcctttgctcactgaggtttgaaaagcgctgaggctgggtcccgcaggcaggaggaggactttgggtttcatctgcagtgcgatgagggcctttgggagggggctgtggagcaaaggcagatgtgatggaatctctgttttcggagtctgctcaggctgctgggtccaggatagctctgggtactgagtggttgtcgggagaacagtgaggaggccattggtactcaggccagggatggccacgggccaccagctcatgatgggtgaacagtgacacctggagctctgctgccatgagtgcccagctcagggactttggggtggggatggggggccccttccttcctctcccctcccctcccaagagactgcagtcaccggagccaaatcccagcaggtctgtgctcactgctgagctgttctgcctccttcctgacccttcctccagctcttgagcaggattttaataccaatgacttggtgtgattgacacacacaaatgcatgtgcacacagacacacgtggactcacacacgtacatggctttgcgggacaattggctactttcccctgagcagaacaagctggcagtgtttagccagggagatttggaaaactgcctggtctagtggaaaaaagtgttccacgaagtttaacatcagctgccctggagggtctcttcgtggagacaggctcctgggaaaacatgagttgtatgcgatggccgactgggcagtttgcctggccagaggcaacagagaggagaaaacaggcatcaggtgagtggaaaatccctgtagggagaggacccatggggaccatggtccaggaaagcaaatctgcaaaggccagagacgatttaaaaccctcataaaacacgtccccttcctaatacagaacatttgccaagagggcccctttcctcctcggtgaggcctggtgggtaaaactggacatataaaagcaggttagacggctcccctcagtccaaggaatgcctcccccatgccccgccacaggtgagtattttccatggaactgcgtctgtctcttctgggcatgggcttaggttttttttcattattgtttggaatcccaggccgaggcagcagggaagtaagttcttttggctccataggaggggtgctggggcagccgtgtttattctggctgccagggtcgggtggaaatgcaggcgggagccaaggctgaaacatggcaggaacacggaggagtgggagggatgtgcttagcaagggaacaggccccagggtgtcaccgtgtcacctgagaaagtttgggccgaggccagagggcacccaccggtcctcacctgtgtcctgcctctgggccggtcatgtcattctaaaccagggcgtggagtatgggtttgagattagcatggctggggtaagatccaagctctgccgcttattatctgtgtaaatccgggcagatgatttgcctctctgagcctcagtttcctcatccctaaagtgggaatgttgtcactactgaaatgacatctctgcagggcctggggtggggcctggcagggagatgctagtggtcatttgtgtccttctcctggcttcatgtcctcaaggaacacactctctggggtggggctggggctgaggggggagcctgggaggcagggacagagagtcatgggggtgacagagagagatggtgggagacagagctggggccatgggaatgctaaatccttaccctaaaccaagagtcagcggaccttttccataaaggggccacatgaatctctcaaaacaactcacctctgctgttctagcatgaaagcagtgaccaactggaaatgaatgagttgtgggcgtgttccaataaatccttatttatgaacacaggcatttgaatttcatgcaactttcacacgtcatgaaatatcattcttgttttgattattttccaaccatttaaaactgaaaaccactcagacttgcaaactgcataaaaaaaggcagtggtccagatttggtctgtggactgttttcagtttgtcaacgtctctcctctaccactagcaagctagcaaacttcagtctgtcaagtcctaagaaataaatgaagcagtctcaggaaggcaaaatctactttccaggctgggcacggtggctcatgcctgtcatcccagcactttgagaagccgaggcaggaggatcacttgagtccagtagctcaagaccagcaacttagtgagttcaaggacaacacagtaaaaccccatctctaaaaatatagaaaaattagccaggtgcagtggtgcatacctatagtcccaattactcaggaggctgaggcagggggattgcttgaatccaggaggtggaggctgcagtgagctgtgattgtaccactgcactctagcttggatgacagagtgagaccttgtctcaaaaaaaaaaaaaaaaatctgcttttctgtctatactctttctggaaatacattcacaaagacccaggtttttgtttttttgtttgtttttaaataaagtgttactgtcacccaggctggaatgcagtggtgcagtcatggctcactgcagcctccacttctggggctcagtcgatcttcctgcctcagcctcctgagcagctgagactacaggcacgcactgccacagctggctgatttttgtatttttttttttttttgtagttatggggcctcaccatgttgcccatgctgcctcgaactcctaggctcaagcaatccgcccatcttggcctcccaaagtgctggaactacaggcgtgagacaccatgcccggcctaacccaggttttaatatccactgtaagaagaagttgttaaagaggtcacgcaggagactgatttcattgagaggttaaaacaaaacaaaacaaaacaaaacaaaagcccgtgactctagtgatggatttgtcatcacaaggagctaccatttattgagtgcttcccataccctggtacttctttcgctccttaaaggtaatatctcatctggtcctaactgaactgatgaggacagagacctccaaagattcaataacttgcccaaggccactgcttctaactgcctctgacaatgggcctctctcaggatttatgatgtcgctgccattttttagaagggctctctaagatggcaagcatagcccagtccctgccttcaggtggggaggcagacaggaggctccctggctttgcatgaatatcctgggtcctcagccacctgtgtccacgttacggttagggttagagttagagttagggctagggttagcttgcctgtcatccggcttgtctctctccgtgggcagagtgcataaaggtgcttcctgccagccatggctcccttcaatgactactctatcattgaaaagctctgtttggccaattatttcaatatcttttttcttttttttgagttagaa

SEQ ID NO: 2541 - DNA, 3019 bp, Homo sapiens
gacaggttgaagatgctgccaaaccatgtggaaatacattggtatagactggaactttgtgtcaaggctcaattggaataatctggagaagcttttctacaatgtctacactccagggcccacacctgccaatgaaatctgtaccttaaacctgaagaggaccaggtatcaatattctttgaaaagcagcccagatgatgcagctaggtaggtgtgggattaacagcacagccgggaagtttcaaattggaagcacttcagaaactgtcatatgcgagaaagatggtatctcattcagaccgaccaccatttcccaaagatttctcccagatcactacttcctcaagatgcccagagaacataattctgtgaccaaatgcgtatgagaaatgctgccaactgctgactcctatctttgagacttatctacgtagtgcttttagtgcttttttgttatgaccttggctcactgcagcttcaccctcctgggctcaagcgatccttccacctcagcccttcaagtatctgggactacagacacctgccaccatgtctagctaatttttgtattgtttgtagagatggagtttcaccatgttgcccaggctggtcctggtctgaaactcctgaactcgagtgattctccagcctcagcctcccaaagtgctgagatgacaggtgtgagccactgtgtctggtctgtagtgcatcttaatgtctctgagaaaacctgtgaccaagaaaactattacctcggcttaatccagtaattttccaggaaagctgcttttttatttcatagcacctaacaccctgtggacctccagaaatggtgattcacgatgaggaggaagagtactgagccctgtcaagggcagcattgggtgaggagcctctcaattacatgttaggaagtgaagacacccagacctcggattccaattttgatgcttcagttttaaaatggtggggggtgaggggctgatggagaagagtctttatggacacaaatggaccagggtgctttgaccttttgttctgtggtctcctcacttattaggtcacataaccttcagtgggctacataaacctcttttctcatctttagcagaacaaaaatctgtggtctgggcttaggggccagttggactgggctttggtcattgattcgcgctggtctttgaaatgtgagtggaagggacagacaggtgttgagtccaagcagaagccttcgatgttcttgtgtggcttggctctgcctctgtgcttctccctcctccttgagaacaatatgccccacatgggagctgctcctttagccaggcctccaggaccagaggacaaatggggctgagcacaaccaagcccagctgagccaggtcagggttcaatgtagcctgaacatgaaataaatgtttataattttaaaccaggaaaattttggtatagtttattataacaaactgcaatctataaacctgatttgggtctgatttaaagaaaccaaacaacctctaaaaattaggaggtaaacaggaaaacttgtacactgacgttaagaaattgatgtcatttttttttacaagatgttataggactgtttcacttgtgtttaggtaaagaatccttatcttcagtgatccacgctgaaatacttatgcatgaaacggtataatggaaggacaggaaagtgggcagagtcataaatgaagtaagaatgtccaggtgttgataattattgaagctgggtaacggataattgggggtttaccatattattcaacttttgtttatgttcaaaattttctctgattaaaaagctagaaaatcaacattcacacaaactcttctccataggttgaaaataggtggagtatcttgttaggattattataatcttttaattttatagcactgccaatgagccatccctgccataaaagagtcagccagagataactggtgacttccaccacgtaattattatcaccgtttatttcagtggaaactgctgcctgtttggatttggagaacactaagaaagagaaatgaagatctggagaattcaaaggataattatcccttttgaatattgacacacttacatgtttttccagacgtagattttgtgtaggcgaaagctatttgattataaaagatccggtttcttcaaatttttacaggtaaaaacttcattaattaacatcaaggaaaatggagcatctgctacttttttgtcaacagattttaataatattgagcactgctaattggatagaactgaaatatagctctttgtatgttaaattaagatgatttcttctgctatttttcccctaaattttatttaaactatggcaactcttcagagttttcttctaccatttaagttaaagtgattctgaatgactaaagggggtcctgtggagctccaacggttattccacctcagccctggaaagatggtacatcattcagaccaactatcacctaaagggtgtcctttagtgattcaggtaaaggggatccatgttcaaaaatgctgtcatcattgccattgtgatagttactgtgacctggaagggaaagaaaggcaatcagacctgctaacattttggctcaaggattttcttgaatgcttctgaagtcgggctatgaaacagggacatttaacaggcttgaggagaaactccaaatacaatgctcattaaagaccaaatgaaatatttgctgaaatggaagtgataggaatggcagacagtggattcttttgcttctctttaaacactgaccattcttcccagcagatggtggattaaccatggagaactggaggcaaactttgggcccaacttaacctcagctctgattaatctactgaaatcagaggcaccgttaaactaatcagaatgtattttgatgtataaggggaagaagagtggtgcaatgggaagaaagatgaaaatggagtcaagtagcttggggggcaaattggacttcactatttttttgttgtgtg

SEQ ID NO: 2542 - DNA, 1170 bp, Homo sapiens
cgcccggacgcaaggcacagggggacgccccgccgagccgctgcccactgcaccgagtttttcggaggctgggagaggaaatgccacttggattttaaaaccgtcaccgatacgctatagccctgctttctctacctccagtcgttttctgaggaccggcttggtgggtgctgatgcctgcctggaagacctcacacccacagtgtcttagaagattctgaaagcagtgtgagaccagaatgaccagcaaaggagaaaagaacaaggacacattgcagccaaaatggagctagaatcttgcctctgtccatccttcactggagttatcctggatggagaaggaaccatatcacctgcaaagcctggaaggggagccctgctgtgagcgatccagtgttcaagctggtcatcaggagaaagctacttatgatttcctaacaagccaccacagaacatcacattcccaaacatgctcttcaccgtccctgctgtccccacgtgcctagccctggtgtgggcaggaatgagtgggattgggatgttttctcacaggtctttctcaggtgaggccccaggctgtgaccaggcccctgccctgcatgtgactcaggcctagcccctgctggggcaggaatgccacccagcacagcatcctactggtgcctgaataaagaatggactggaggttcacctgaaaggggctgccaggtttctgcgggggccagccaacggctcacaatgaccctgtgttcgactcatcttacgatgaaatttttcagcttgacgaacttttactcatctttcaaggctcggctcaaatgttatttccctgggaaaactgcgctactttcagcaaaatgcatttccttttgatgggcatctgtttttttctttctttctttctttcttttttttttttttttttttttttttgagacagggtcttgctctcttgtccaggctggagtgcagtggtgcaatcttggctcactgaaccttcacaatgggcatctgtttctgttctatggagtgacctaaaagtcaagaatcatggagaaattgggagcaatggctcacgcctgtaaatcccagcactttgggaggctgaggcaggcggatcacttgaggccaggagttcgagaccagcctggccaacatggtgaaaccccg

SEQ ID NO: 2543 - DNA, 2510 bp, Homo sapiens
cggcccttccctgccctgccctctccgcgcccgctccattaaagttctccatccagtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccgtaagtttagctctaggttttttgctgtttaggttcaaatgatgggacttcttgtccccttggggaataattttgatctcctgactctcccttctcttagtcgactcttcaactaacctctgtctgtccttctcccatctcaccttcatccctcactgatcaccccgatctgatcccccttgctccacctgtagcccccaactcactcccactgccccctgcctctctcctcctaacccagccagttcaggcttctaacccagttcaggctcctaacccagacagttctccggcaaggtttctgcaactaagaaaagtaaaccccagagacagaatgaaagagccgggagttggaaggaccaagagcagagacagagagcaaggaccgaaactgcttcttcatgacaccaaaatacaaagtaaaacatgcagtcagccattcacgtgatcgagagctgagtcggagatgtgcagcccaaataccacaacgactcgctgcatttttcactttccgtctaatgtttcgaaatcaaggcactgacgtgaagatcaaagacggtataagaaagaaagcaagagacagatgacagagtcctcccccccaaaaaataaataaaaaacaggtgcatgattagagagatgtagagaagttagaacactagggagcgggagcagagtcgctgtcaaatggagagaacttagaggatcaaggaggagagaaagggaaccaaccagccgttggccttgcacatacttcagtctgcttgatcaacaagactcttaaagtagaaatgtttgttgcattcttacaaagaagacaatgccttcagcagtgtttcccatggtgaatggtgtgtactgggggtaaagggagagtagagctaggaattggtattgagtatctctcctcggagctacaggtgccagctcttgtggggatgtcctcagccatgtgtagagccagagctgatttattccatctgtccttgcccagccagaggttggacatctggctataggcaaagccctcccagaaactagggaatgaggcaagcacttagcttggggagcccaggagacctatgaagagaaggaggcagatgtcagcaagcaggctgtctgtgtacttagtgaggtggctttgagctggagcctgggccaagccagggtggggatcaggtgtgtggatggggccaagcctaggaatagtgctagagcagggacagggattgggcagagccagggactaacacatctgagagctcattgccaacttgcttagccctcggcccctgccttcttccctggtaggcatcagactcagcttggctcttctcagcccccactgcagcttctgatcacagagagcacagggcagtgatttagggagacacactagctctagaatcagacacatgtggattcatgtgcccactctgccccttacgggctccgctggcctcgggcgagtcatagcctctctgaacctccctttcttctttggtaaaattggggtcatcaatgcctgccccccctcccagctgtggtactgacactcttctccccagggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtgtgagtcagctgggctgctctcagcatggggagggagactgggagggcctggtgcaat

SEQ ID NO: 2544 - DNA, 9806 bp, Homo sapiens
actgcctctgaagcatgcctgtggaaagcactcttttcaaaaaaaggtgtttggggaggagagagatgcagaggatgtttttactcctttgggctcacatacagaccaaccaatactttttccagttcagcatctccagagcttacgccttggtgcctaaagcacctccaccactgcctccaaaaaatgtaccagctaccccaccccgaacaggatcccccttaacaattggaccaggtgcatcatcccctgctcgaccagccactcctttggttccttgcagaagtaccactccacctccacctcctccccggcctccatcccggccaaagctacctccaggaaaacctggagttggagatgtggtatgttcccttctgccctggcttgctcagaaacagtgagaatgacaaacagaagctccaaatgccttcaggtctaagcgtttagagaactcgtacaaacaaccctgacaggtggcatctgaaagacagtcactgcggtatgagtgtacatttcaaccctcctcaaatttctaccatctttcaagccaaggtctaaaatgacaggaatggtacgcttggacccttacctctgctacagtgggttagatacaaatgacgatagtaacattcatagaaagagaggtgtttcacagtatttgtctgatattagaaaactccaagagagggcaaatcctggtttctgatcccagaatacagatgacatattgattgtaggcacatgatgtgaatatacagtgaaggagtggtggcttgaggaatttgttgcagaagtttcttgccttgtgttttaaggctgaggagtggaaaacattctgtgtgaacaattaagagagacttgtggcagaagtagatttctttggcatttgcacacaggagtcagaaacaaatgatgtccatagcatttggctgggctaacgtctaaagtcgttagctttagacgagtatgagttctcactctgtgttacctgctgagtccctgagggcatgtgagttcagtcctgaaacagacccactgaccgtgtcacagatcccagcttcgctaagctcagctttagcatgttatggtttatcgtttctccagctccattccacaaactctcatatagatagaattaatttcagtgtaaaaatggtgtcatctattcttcagatacctaagttgtcatatctggggctgggagacattaaaaatatggagcaaaaatactgcaacctgtgtatctaacttttcatctcttttcttctccttacagtccagaccttttagccctcccattcattcttccagccctcctccaatagcacccttagcgcgggctgaaagcacttcttcaatatcgtcaaccaattccttgagcgcagccaccactcccacagttgagaatgaacagccttccctcgtttggtttgacagaggaaagttttatttgacttttgaaggtaagtagtgcatagcataccagattctaatttatactcctcctcatccttatttccccatttgcatttccaaatcccagttctcttcaaaagttctggtctcactttctatatgaaaatgctatggctacttagaaaatattaaacactaaaggaaatattacatgaatttggtttgtatatgatcttcaattttttcacattaaaaaaagttcaagctaatttgcagttaatattggttatttaattaactatggtcaattgaaaataaaacaaaacaaaacacaccttttttggccaaggaacttaactctgtcaaccagggctctttcctaactcttttgcaaatgcagtgcaacaaatataaggacatttttggttggtattggtatttaacttgttttgggtaattaatattttagatgcaacatgcattattgtaaaatctaaatatgtaaatacattcttatgacaaggaatgctgtataagagatcagaaaaatcgggaaaagaaaaaaaggagtttattagtaagtttgttctgcgtctcctgaaattgcaattgagatgactgcagtaaaatggagaactattgctggacttgccatttagaagattaaggaaaatatacataaatataatgtcaaatatctaacctcattctttgatcatttgttatattctgcataaagggtaagcattcttctgttttatatttaagttttaatcatcttaacaggccagtcatttgattaaatggtacatttgaactaatgatgggggaagaagttaagtaatttaacttaatttatggaccatcttacacataaagatttatcacataaaatcctgctttctaggattttaaatagctacatttatcccaggatcaaaagttggccaaaacacattccactctagatttgaatctaaatattgaacttgtttttgtgtttcatggcaacaaaatagaattttcataacttgagtgtgtgttttaatgcaactttaaaaatcagaatggctgatatacataaatagtttgtatagttgtggcttttttctctcaacaataaattttgcttgcaagatagtcatagagatagaagttcttagctagaacttatccagaaatagcttgggtagtattaggaaagatggtctgatttcaaatttctcaaacatcctgatttcctgaactagcctggtcagaaggcaggtgaataagcagtcttcaggagaggatgtatcttctgcacatgaagtcaaagccttcattgccttgggtcattaattttgtgataaccaagatgcaaagtccacaacttgtgacctcctaaactttctctttgaattagatgaaattagtaagtgcccaggtattttttactaatcagcatgttgccaaagaagaaactacagttgcataagttggtaatcctgaagtaaagcaatacctgcatacttaaaggcactttggttccatctggtcacaccagatgatgcagtttaccttcttttaaccaggaaagtaaacaaggcactttgccaaccctcaaatcattgtctgggctcaacaacaaaaaaacaactctgacagttttttgttgtttgttttggctagtgtatgtgtcagcttatttgtttatgctttattgtggacctcttttgagagagagagagagatcttttttgaagaaaccaatctaaagacatctttggttgtctgttttgaaaatacatattatcaatcaaatataaatatttaataaatgtgtggaataacatatcacattttatgaaaatatatttgtcagtagatgtctgggtatttaaagttggtaacattgccattctaattagtgagacccaaattccttaaacatctcaatttgggccaagagaagtcatgcaagaagcgttttaatagaaattaattggaatctctagtactgtattatcttaatcttggactttgttcaagtttaagtataaagaaggcttcttgaaaggatgtgtgaatagccatatcatgaatgttggtgtcactgtttctctcgctaaaaaatgtttatgcagatacaagtatattcaaatgcacttcaagggaagccttagaagaaactaaaaatgatgtcttgctatctgagcaaaaacggctatattttttaaatggagatttgttttcatcatgtatgtacgctagactcgggtatttttagctagtaaaacctagaagaatttttttaatttttctgctgtgatgataaaatgacatagaaatggtgacattttaatttacctcgagagtagtgcccccacctaaatttttatactgcaaaaacattttccttcaacatgctttattaaataggatttctaacatattcttgtagggcactctggttttacccacatttgttattattaatattaattaacattatctttaattcttcattcagggaatgtagaagaagaaagattcccacttcaaaatagtcatcagttccaaatagcttttcaatttttatttattgacttctaaatagtatttttacagtgttcaaaacactattctgtcttgttcatcattttgttcttacaatgctttagatatcattgtcagtcaatgtttgagctactgatcaaccaatcaactaagtggcgtatgactttatttgaggataacatgggtgcttcacacttccaaatttaagttaataatagagatagaaaagtgttagtggttctaattctcgagtcccagtgcttttctgaatgttttacttttagaaacagcttcactgaaatattaatttatgataaaaattctatttattttaagttgggaaaaaaacagtaaagattgcaaatggtgatgactttttttttttttttttgagacggagtctcgctctgtcgcccaggctggagtgcaatggctcgatctcggctcactgcaagctccgcctcccgagttcaccccattttcctaccacagcctcccgagtagctgggaccacaggcgcccgccaccacgcccggctaattttttgtatttttagtagggatggggtttcaccgtgttagccaggatggtctcgatctcctgatcttgtgatccacccgcctcggcctcccaaagtactgggattacaggcgtgagccacggcgcccggcccaaatggtgatgactttttaaattcatcaaagactgtatcctattgaagctatcaagtattctgaggtgggagggcaagatattttcatgacaaatattaaatagaagatatgactgttagctatttgagcaattccctagagtatttgaacatcaagatgtttccagaaatgtactgcacttctccttggttagcttttttaactacaaaatcatctcgtatgtggtggtgaaaaacaaacaaacaaaaaatctgctaccttaagtacttaagtggcctcgtgtaggaatataagctctgtcatctactcatatagcctcttacatctcacacactctcatctctagactctctgcgctcctgtttactcgtcttttcccatcattcccaccaggaatgccacatccctagcagtacccttttctacatttcagtctctcagctgaacttgcccacgtgtttcctgacgaaatcctgactcttaggagccatcacttccatagcactctctatggagacctctcttcagtcttctgtggatcgttcatcatgggactaggaggcagtgtttggattctcttagctccctattgctgcttccaaagccttcctgattgtgagagcagccgtctgataattccaccctcttccactccttattgctgttaacagttgactgcagagcagtcctctgcatttatcttagaggtgctggcagcttgcgtgtcatcctctgtgccacctcacttcccagcatcatcctgtgacatagagtgtacgtgtgtgacctgtctcacatgctggctccagggcctcttgatttttgctccaagaagctttctctccactttactcggtactccacacctctggccacatcctggaagtcattcccctggcaagtctcatttcagctgtttcatcattaagaatttgtcaccctttttgtacaccagggactttatgaagcaatattctttcattcaacaaatattaagtgactgcctgctgtgtactagcactgtcctgggcactccttactagtgaacaaaacagaaaaaatacctgtccccacagaggttatgttctactgtggaaagttaaaaagataaataagtaaaatatatatagtatgaatattgtaatgagttctataggaaaaataaaataggaaaggagaatggagcatagtgagggttgcagttttaaattggggaatttgaggttgaaaaatgaaaaataaaataaaaataataatgaatatgagtaactaacatctgagtatttaccatgtgtaaagcagcctccatctattatcttatttcacctgcacaactcactgatgcagaaactgagattcagataatgtaagtaactttcacagggtcacacagtcaaaagagacagagtggtggagcgcagtggctcacgcctgtaattccagcactttgggaggccgaggcgagtggatcacctgtggtcaggagttcaagaccagcacagccaacatgccgaaaccccgcctctactaacaatacaaaaattagcagggcatggtggcacgtgcctgtaatcccagctacttgggaggctgaggcaggagaactgtttgaacctgggaggtggaggttgcagtgagccaagattgcaccactgcactccagcctgggtgacagggtgagactccatctcaaaaaaaaaaaaaaaaaaacagagtaatgattcaaactctggccacctagccagaggtcactacctcaccctactgtacatacctaatctcattcagtccttgcaacaaaggttttgccctaatcttctagccttccagctctctaatttcctgatactacaccttatttttcccttttatttttagatgacagctaataattgtcctatttataggataccaaataatatttcaatacatgtgtactatgtataataatcaaatcagagtaattagcatatccatcatctcaaatatttatcatttttttgggttgtgaacattcaaaatcctctttttggaaatatacaataaattattgttttccctatttaccatacagtgctatagaatactaacatttagtcctcctatctagttgtaattttgtacctattaaccagcctttgaccccactgagacctctgtcctcacgttcttcctgttctcagtccactaatccaggtggagatattcaagttcttttcattatccagatgagaccccagagaggaaaaatacgtttctgaaaggaccttaatcatttacataataggagctacattttttctttttggagttatattatctctgtgaaaaaaataaacgcttgggcattttaaatgtctgaccttcttaagcaggttattaaatacccctacttagtcattggcaagtcacaattatagtcatagagcattcgactttccttaccctgacatagcaataaagtaagaaatgaactggtcaaatttctcacatgcagccacaaagatactaattcattcatttgagagacactaaaggaaggaaaattggaagatatgaccaattttctggggagcaatggctatgctaaattcacattattcttaagtgggaggtgtttgctaatagcacttaccccactgaaggcccctttcaatcaataacaggaaaattattaagtacccactctgcaaatcacagcattaagtaccaggttggggaaacaatacagaaacattaaaagcagttttacaagactgtcttcattagaaatattaaaaccacgctccttagctattctgagtttttatatatggactgtattgtctatctaaaatgaaaaattcattctattaaaataactgaaggtcacagagagttttttttaatagcctcaacctgttaagaagattaaagtggagctgaacctgcaaaatcttctatcaggcagttctgccgaggatttcagtagtacactttacctcttcataataaattagttccctggttctgaaaattttgacattgaccagcatgatgatcatacttggtttcctgctctttgagacagttgtcctgtctcattcatgattagtgtacaactgtcatgctgatgttagaacagaaagccagcaaagtgtcccctgtttctggcctgaggtctaggccaaaatggaaggaataggcttctagagaggacataaatgtacagaattcatgttagaattctactgatgggaaagctggagagcaggtgtgttaccttctattccaagcatgtcaccatgcaaggagtacctagttggtgaaaatatcattttgcttggattcagcatatctggggtgctgctgtttttaccagtaatgctgatgcagtgtatcgctgatgagcccttaatacgggctacattctgagctagctactccacatgcacaagctcatgtcattcacacaacagtcctaggaagtgggtactattgttaatcacattttacagatgagtaaacaaaggctctgagcatttaggtaacttttctgagattacacagctagttggtggttaaatcagttagaggggagttattgataacacagctagtcaatggttaaatacgttgaaagggagttactattatgtcacaaaactgatgttcctaaccactatgctactcaagtcttggttgtgccactcaataaccacgtgatcttgagcatttaatgtctctgggtctctgttctatcatttttaaaatggaaagcataatacccacctggcaggataattaggaaaattgataagatgcattgtttttgtttaataaagtactatacatatgaaaggttttaaattatccatgctttgaagttgcattcaaattaaagaagaatgaaaggaagagaccaagaaggtattgcatccaagatgcatttgtttctcatttctggtaacttcctggtctctaaagtggcctcttgggtgtctggtggtgactatacttagaagcttcttgtatctctatcagactcactgataatgtagtttcttcctcttatggccataatggtccaaaacacacagttgtttctgaatatgtctgtcatacaaaggccaataggtttaaaatagataaacattgggcaacatttgctttgctcaagattgaagcctttcactccccagagaggaatggaaccctgagtgtcagctgcacttccctgggtgcaaaagtagattctagaacaggacttctcatctgactggagtaaccaaatggggaactaacaagaacagcggaaagtcttgagccccacaaaaagaagggttgctatgcgtggacaattttaaaacctgaagcataagttaaatagttccctggagcaggaaaatgagtaacagaatagaaaagttaaagaatattcactcatttatttttgcattcagtgcttcacaaccagtccatgagctcttctagctacaagcccttgtgctggaattatggaggtgaaataataaaactcctgccttccagtaattcacaagaaatagaagaatagaagaaagagaagagttcggcacttcctatgcaaagcatcctgtagcaaaggcaatggtagaattgcaaaaatgttctagtagggtgatggaagaaacgggagcaacatttatacctacatagactctaccctgaagcaatataacatgttgctatgttagagtctaatagaaaatcttaggtgatatgtaaatgttaacctaaggtatgcttggtattatcctagtattagaaagattcctcaattaatgcatatccatttgctctcagtacacatatacatacatatgcacacacacacacacacacatatagagataatagagaaaaagatatggaatatatatatcatatatatgatatgatatgtatcacacatatattctatatcatatgtgtgatatgttgacatactgatatagcatacatactatatattgtatatcagctatatcacatttatatatgatctatatcatatatattatatatgatcataacctacagtatgatatatatcataggttttcatatatgatatataatgtttttgtatatgatatatatgaaatatggaatatgaatgatatatggcatatc

SEQ ID NO: 2545 - DNA, 9489 bp, Homo sapiens
cttaagttttgaaagaaggaaagaaagaaagagagacagaaaaagaaagaaagaaaagaaagagagaaagaaaggttgctgtagttagagtcagaagaagagtttgttgaagaagtagaatttgttgaagttgttaattctggtaataactgctaaccagctgctagatagaaaatatgaagagagaaaaatcgagccctaggtcaccattacttcactgtgcctctgacattagctcttcccccaggatatacatagtacgtattattatacagaagttattgaagtgtctaacaggctctttatgaaaacatactcagaatattcacatgtggtcttcacacatttggagatatgcttcctgagagaaaggaccacgcttctcctgtttaccatgctgtctcccactctagcacatccttcagcgatgctgaccggtggaaaccagagcagtacctcgtgtatactacgctatcgtaagctattataagcattgttctttttcttctcccacccagaaacctgaaggttttcttttccttactctgttcctctgtgagttttgagaatttctgtacctctcttatgatacacgatattactggcatagtgcgttcataacacttcctagatgctactcatatgtggcatgagccttcttaatcaacactaaactccttctaaactaaaaagcataatccctgttacttatatctgtatttaaagtggagttttccctgagttgtttctttttcttttttttttttttgagacggagtctcgcattgttgcccaggctggagtgcagtggcgcgatttcggctcactgcaagcctagcgggttcacgccattctcctgcctcagcctcccaagtagctgggactgcaggcgtgtgccatcatgcctggtaaatttttttgtatctttagtagagagcgggtcttaccgtgttagccaggatggtctcgatcccctgaccttgtgatccacctgcctcggcctcccaaagtgctgggattacaggcgtgagccaccgcgcccggctcctgagttgtttcttgtagatgaaacagtaatttcttggtctgcttatattattttgcaaacttgtcttttactttcacctaaattgttaggataaagtaaagatttagactgattattggtacagttgcatctcactactattgtactgttcactatttcacatatacaataagaaactatatatccctatattatatttgcctaaaggcagaaggaagattaaaggtaccatctaactcagtgtttgctcattatgctcattttcatgttgacaaacttctttatgaatataacaattattccttgatttctgcaactcatggcagcactaaaatagattacagctccaggtttatgttctgcttacattcaggacaagggctctgaacaattgcacatttccaggagaggagtttccatggaaacttggacaaaggcaaaacaaaataattcttcaaggcctatgagaaaaaaatttcaccttgctttttatttgcagttctgtgtcccctgagcagttcagccagcttgcagctgcccttgctctctaggaatccccgtttgaaaattatatatagcattatgcatctctgaaatctgcaaaataggatttgatgagtgtaaatgaagagttatttctctggaaggctcaaacccagaggtttattacaatacaatttttaaaagttaaagcatacatttaagtagccactgaatttatgaatatggaggtgtttttcaaattataaaatccttaaaataggcctcaagaagagagttttaggataaataaatggaatcagtgattagagacaattaggcatttcaaggcaatttgctagctgaaaataaagaccaggtcaaatgattttcggtaaatgtatggatcatatatcttgggtaaaaggaagtcagggggttcatataaagtccttcggagaatgatgtgtctcctgttggtttgcaaaatcctgtacagcacgctgtcttatttattcttgtatcttctatggcactaagcacagtatttttaaggcactttgggggctggatgggtgtagtgaagagcattcaccatctccctcaagagtccagcatcacagtcagaaacagagtactctctgcttcctaggcaaaactattgacactatttaataacttcatcatacagttcatattttatcgaggaacctgccccgatagtcacataggttcttttctattttccctaagcatcggccggtttgagaaataaagggacagagtacaaaagagagaaattttaaggctgggcatccgggggagacatcacatgtcagtaggttccgtgatgccccacaagccacaaaaccagcaagtttttattgggactttcaaaaggggagggagtgtacaaatagggtgtgggtcacaaagatccgtacttcacaaggtaatagaatatcacaaggcaaatggaggcagggcgagatcacaggaccacaggaccggggcaaaattaaaattgctaatgaagtttcgggcaccattgtcattgataacatcttattaggagacagggttttgagagcaacaggtctgaccaaaatttattaggcaggaatttcctcttcctaataagcctgggagtgctgtgggagactggggtttatttcacccctacagtctctaccatagaagacggccacacccaagggggccatttatagacccaccctcaggggcatattctctttctcagggatgttccttgctgagaaaaagaattcagtgatatttctcccatttgcctttgaaagaagagaaatatggctctgttctgcccggctcaccggtggtcagagtttaaggttatctctcttattccctgaacaattgctgttatcctgttctttttttcaaggtgcccagatttcatattgttcaaacacacatgctctacaatttgtgcagttaacgcaattatcacagggtcctgaggcgacatacatcctcctcagctgacaagattaagagattaaagacaggcataggaaatcacaagggtattgattggggaagtgataagtgtccatgaaatcttcacaatttatgtttagagactgcagtaaagacaggcataagaaattataaaaatattaatttggaaaacaaataaatgtccatgaaatcttcataatccacgttcttctgccatggcttcagccagtccctctgtttggggtccctgacatcccgcaataatatttcactttcttttcgttattgagcttaattgtaatcatattcagaaacatatccactcttcgatgcattctttcaacaataacttctgaataatataccaagtactatgccaggaatgtgccctcaaggagtccataaagggctgctgactttaaaaaaagatgatacaaaactaaagaaaaacacagacaacaaaatgtggttactgtactctgtaatatctcataatgttgaggactgtcatgggttttatgggtgtccagagcaggggcatgtgactcagctcagtggtgcctgtcatatgggggttagatcaggtaaggccttcacagagaaatgtttgttctcagcgtttttgttgttgttgttgttgttgtttgtttgtgacatggagtctcgctctgtcacccaggctggagtgcagtggcgtgatctcggttcactgcaacgtctgcctcccaggttcaagtgattctcctgcctcagccgcccgagtagctgcgactacaggcacatgccaccacacccagctaattttttgtatttttattagagacagggtttcaccttgttagccaggttggtctcgacctcctgacctcatgattcacctggctcggcctcccaaagtgctaggattacaggtgtgagccaccgcacccggcctgttctcagtcttgaaggatgattagatgtgaataaggcattcaagcagggaaacacattcagagagaggaaacatatgtaaaaacacaggaacatggaagaatgccaatgtttcaggcactgaacattgggtttaatgtaaggagtaatgggcatgagcttgaagaaggcagaagccaggtcctcaaatgcctttatgtgaagttaacaagtgggaattttatgctaaagatagggaacccagtgagttatctcagtgaaagaagggctaaatctgtaccattgtcctaatttaagtgttaggggcagaggaagtccgtaatagaagggagaccagttacggggcaaagaggcaatattgactccctatagtgagggtcaaaactacagtggtatagacaacatggaagggataaggagatctggaagatagatgagcttggtaaccaattgtttcggcagggtataaaaaagaggaaggactggagtggatttcaaatttctaatgcaagtgctgggaaagtggtaatactgttaagtgaaattagtacaagaagcgaaaacaaaaaacaaacaaaaaactccataaagattataaagatttagggtatggctttagcctgactgctcacctgacctcaaacaagattcttaaccactttgagcctcattcctttgagatgatcatgtgggattgtttggaggattaaatgagataatgtttacaaaacattcacacatttgctcaatctatattttctgagcatttattgtgtaccagggtaaggggttcagagttcagaggtgtttaagacaaagtttctgctcttataatatatctgttgtatgtatgggaagatagacataaataagttaacaaataaatgagtaaacttcgaaaccccctctctactaaaaatacaaaaattatccgggtgcagtggtgggcacctgtaatcccagctactccggaggctgagacaaaagaatcgcttgaatccgggaggcggaggttgcagtgagccgagatcatgccactgcactccagcctgggcgacagagccagactccttctaaaaataaatatataggtaaactaattatagatttggaagcgtgctttgaaagaaataaaaatgttgatgtgacagttacagacagggttgagagttctactttttgataagttgttaagaaaggctaaaacttgcagggagttattcagtcagagacagctaatcatagttgaggaacagcatccgaggctgagaaaaccacaaagactctgaattgggaaagaatttggaaggacagtacacacctagcaaatccctaaatataataaacacacaataaataatagatattatgtttagaaacaagaagacatgtattgattatatgccatggaaaactatctgaacaaaatacctaattcatttattgcatacataatatagtcagaacaatatttaaaattgacacatttgcaaatgtatctttatatttaagaacgtgaatacaattgtaaatggagtgaagggttgggaaggagttctctaaagtaatattgaggtttatggactaggaattcttgtagggaattgtgtgattaatatgcttccccatggtattggaaatatatttttctttattttccaattagttttttatttgtttgagtcagactcaaccttaacatcagtggatcctccaaagatgggagactacctttttgaagactgcaatccacacaactctatatagaaaactctatgttaactttcatgcttttagtagaaatctctattattagtcactgctgcatttttttctgtgcagtgatagaagatatatcatctatttttttttttttttgagatggagtctcgctctgttgcccaggctggagtgcaatggcgcgatcttggctcactgcaacctctgcctcctgggttcaagtgattctcctgcctcagcctcctgagtagctgggattacaggcatgcaccaccacgcccagctaattttttttgtatttttagtagagacagggtttcaccatgttgttcaagctggtttcgaactcctgaccttgtgatcctcctgtctcagcctcccaaagtgcagggattacaagtgtgagccactgtgtccggccaatatatcatctaaatgataaaaaaatcactcaatatagattgtgttacattttttaaaaattgcaaatgtcatatgttatacagggaaattattaagtaactatcccgtcctagtgttcaagtgttatgtctgagagtttgctgttttacatgcaaaggaaagattataaacaacttctgtaccacatcaacgaagtcattcaaatttgatattaatcctagttaagcaatttgcctggcattcatttgatttgtcttcttaaactagaatgcatagtaaaaatgggttgcaaatatttggtagttataaatttaggattgaaaatatagaaacattaaacttagactgatgtgttaaagcatgttgataatatcaattaaaaatttaaatgtcaaaggaattaaccaaaaaagaaatagcttagcagacgttaaaaccacaaaacaggaataggactattctagaattcaatgaatgacagcctccacgtctgttcagagtgaattctaacaaatagctaatgaatataaacagtctatttaagtgctgctggaaaattccccttcaaccagcagctgacatgactgttgtcattcaaagggcataagcaaatgtcaaataattgaatcattgagaaactgagatgacaatggcctacattctccttaatgctttttgaaaattcttccctgggctattcaatagatgatgtttaataacggtattaagctaaagaaaaaccacgggaagtcaaagtttaaatagggcttaactctttaattggagattcctcagggaaattggctgtggctcttgcataccaggttgagtgtgtttctgtaaaattgcactgataggatcctgaatcaccatgttttatagataagagaaatacaaacttcacatgaaacaatgtggtgctccaatccagtatgaagattgtcatatcctagcacaggcagcgccttccaattcttttcctgccttcctataactgagtatgtgtgtccttaacatttttaaaggaactgtaggccagcaaggtgctctttgctagaattaaggtccatgttctccttgtacccccatttcctgtttcttcatttgccgttggcttttatctggttttcattaactcagggacttacatatccattcattagttggcatcttctagcctgacaccgtgactgatcttggatttgcttcttgattcttcctttgtctcttggatccaatataactatgtgtctttggaactaactccacacatttttctgtttttagtcttgctacatcctgctctaaggcgagtgggttataggtatatccagcaataccattctagaaaagacaatctttaataatagaggctctaatgccaaatcccatgcatcttttagtaacgaacagaaataacttctacatccttcaagtttaaaaatattcatagcagattctcagaattttaatggttactcagatttgagctctgtggcataaattgtccagctagtctgtaggagcaaggcaggttattgcatctggaactatagcaagacaacaaaatcgattattctagatgtaatctgaatacttctataatgttcattaaagatgtactttaattatgaatacaaaagttaacattaatttgcaaacattgcaataagttacatacagttgatgtgttaatacaaactactaaaacaagttattgaaaaattctctgggaattcatgaaatgatctttgttctagatcaaaatatacttgtttatcctagatgcatgaaatgtggtgatgatgggataaatctgattccaaagcccacacattaaaactagcctccctgttttagtcatatatcaaatatgtccagtagtggatacttttgaggctccccccagaggctctggatctcctttactgggtataaacacccgttgctcagctcctttactcatagttttgccactaacagctgttaccagcagccctcttccaagactatctttgggctacaaattgctttacccagcagctgggaggcagggttgctggaagtgcctgggaggctacccttctcaggtaaaaggagagattaattctgcagatgagtaccatagacacaacattaacatgagtctaagaagcacatctctcacatttttacatgttttaactgggatgcaacttataatcgacttgttctacttcaagtggtagtttactttgtacacacaataaggatatgtctgatgtttgatggtgagttagagtcaatgaaattagggactagaaaagagtgaacaaaaactgtttgaaaataatcatgaagaggtttaggaaaaaactaacatttaaactggtaatatgtggaagtgtcaggcaacccatcctatcgttttgcaagtatgctatctggaaattaaggccaatcgtagtttaggtaaaagttaaaggaagagagcaacatttaacagggatcctactgtgtgtccagcactgaagtaggttctctgcctccagcaactttttcatttcataataaatttttgggccaggaggtgacataatcacaaggaaattttttgaagaagatccaggcccaaatcagatgcttgagaatcactgcactgattggcatcaagatggttttacaaccatctgcttttgatgacttctattttcccagcagccaaacccctattctaggcaggaaaatcattagctatagaggaggcagatctgggttctcatcctcattcagtcattgggaaaccagtggtcaccaagaattggactctacaaatttggcttcttatatacatcctttccaggaccaggaatggcctgaagtgggagagaacctgcagtttggaagtagagagatgcaataataggtagtcaggcagaacatctttggggtctttaatctgttcatcacaatataaagtgctgtcttcattaaatctagtatttgagagattttttctatcaaataatgtttaatcataacagtccatttcattcatctataactgtcaaatggagctactgggcagcaaaaaatagctaagagtaccactttgaaggccgggcacggtggctcaagcctgtaatcccagcactttgggaggccgagacaggcggatcacgaggtcaggagatagagaccatcctggctaatacagtgaaaccccgtctctactaaaaatacaaaaaattagccgggtgcggtggcgggcgcctgtagtcccagctactcgggaggctgaggcaggagaatggcgtgaacccgggaggcggagcttgtagtgagctgagatcgcgccactgcactccagcctgggcgacagagta

SEQ ID NO: 2546 - DNA, 1615 bp, Homo sapiens
gggctcctccctgcctctcagcagatcgcttcatgcctatcagcctgcagcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagataggcagtggagcaggggaatccagttgacactgtggctaaatttcagaaaacctcccatgagatcttgcaaaggagatggagaaaatatggctgaatgccagcaaggtaggacggaagcatgactgctctaacaaccaagctcaaagagcactgctcacccaatgtttccttcatgactagagcaaagtggtgaaaggaccctggtgagaggcccaaagaacaggaggtgtgagccaagagaaggtcctgccaggcctatgttgcaggctatttggaggctgaacttgaggttgacgcagaattaactgttgcatgagatgtggggtatgagagaaggcctgagtacctagaaggattgggatgccatgaactgacagaggttgtgtaatagtgtgatataataagaaatacatggtgggcatggtggctcaagcctgtaatcccagcaccttggccaccactgcaggaccattgcttgagttcaggagtttgagaccaacctggacaatatagtgagacctcacctcaaaaaaaaaaaaagaagaagaagaggaaatacatatttgatctctgcccctggttcttgagacagagctcctaaaacttttatgattccctaagtgacaagatcacctgatgcagagctcctaaatcccttggaatttcctggaggacaggagcatcttttgttctaaaggtcactcttggtggactcctcaatagcctcatgatgggggctggtagccaggggaatcaaccgtgtgattacagtagaactttcaaaccccactgacctgacctctggggaagagagggggtgctaaagatgagctaatcaccaatggtcaatgatttaatcagtcatgctacacaatgaagcctctataaaaccccaaaaggacagggttcagagagcttcctggttgatgaatcagtagaggtgctgggaggatggcacacctggagagggcatggcactctgtgccccttcccacataccttacattatgcctctcttccatctggcgttcatccacatccttttgtaatatcctttataataaatgggtaaatgtaagtcaagtgttagtctgagttctgtgagatgctctaacaaattaatcaaacacaaagaaaggatcatgggaacccttgatttatagctagctggtcagaaatacagatcacaaccaggggcttgtgac

SEQ ID NO: 2547 - DNA, 12625 bp, Homo sapiens
atagctcagctcttagaataacagaatttggtcccctcccacttccgaaatccatcactatgattcagtaagtaaacaaattcaaggtgtcacatcatattgctttttatgcttttgattttagtaatatcctttcacattcataatccagatagagagataagcaagattgtatccaccaagcctcctctttattgatcttccaaactgaaaaacatagctgccattttagtcagcagttaaactttattatagaatatttttataccttttctgctaacattacctgcaactcccatggtgatgctcaaatcccatttgggaattcagtgaactagcagaatgaaattctaagagactggggcttgttgatgtgtccacgctttccatgggaactgatgttaaatatttcacaaataccataacttccaggaattcacatattctttattgaatgtagaattgtgaaatctttaagaaataactgaatcattatttcttcactgtctcctgcctgtgaaagcagaactatgaaatagctcaagggaatcagtgagagatttgtatccattatattcagtagcctgcatgtgtccaaatcacaaatgaaatgatgtgggcaaatataaattaaaattgaatgttgcagaagtggttgaggaacttcaccaggatacattaatgtacaaactgaaaactgatgaaaggtaagagtttggtcctatgtggtgtaaaggataggagcagttttgtggacatttcttcattcttctctttctgcttttccagacttctgaagagagatttgctaggaaaaataaaaagatatataaatttcagtgatgctgaaggtatgtgcaaacaaattgtcctcattaatagtaaaggtataaattgatgtggattttctagaagacaatttaaaggtacacacttggtttctaaaaagtacactttttaaaatctatctttttaatcccaatttatttacaatttattataagaaagtatttaggtaattatgcaaagatgtatgtaaagtaagttcactaattgttctcagtacaaaaaaaaggatgaaattccataaacatctattaagaaagacctggttaaataatgtattgtacctccatatgtttagtcattaaaaatggtcacttaaatctctagtgtattgacatcaaataatgtcaacaataaatttaaaaagcataactctctagtgtattgacatcaaataatgtcaacaataaatttaaaaagcataaatctctagggtattgacatcaaataatgtcaacaataaatttaaaaagcataaatatatagaaaaatatccctatctctatataaagaatgtctacatacccacttatgaatacatggaaacatatctgcaaggatatagtctaaaaccttatcggtagtgtttcttcgcagtagtgtgaaagaaatacagtagaaacatttaactccttccagtaatgggaaggagaggaagagctcacaaaaacagaaagcatatatttttgacattttgatattttaaatgtaatctcttttcttcatttttctggctacatatgttgattcaacacatattagtaagcaggatgtaatattcaataaaaacttctgtaattgtctgcattagttccaatttattcatatagaaactattcattttacatatctctttctattaaactaacatttagcatgtaaggcacagttttatttttgaaattattaataaattaaaatgttagtgacaaacataaactcttgagctttacaataggttaatgataaagaagacagccaatattagatggagaaaagcttcataaaacccacaggttagagaaaaattgttaggcatttaataaatgatagatcctttatattttgctgcacaaaaaccaaagatgaaaccttttttaaatgcatggtctcagcatgcatttcaaatcacatttttgaagtttatgaatttatgattatataggggaagaaaaaattctttgtttctccacccatcttagatctattggctggagctctgcaatttagactgacaaaagacggattaaacaagataaaaacaagtttattaacataggcacaatgcataagaatgggaactgtcactaatgtataactcaaatgagtggttagaccttagagttatataacaatctgaacaaggaataataaatatgttgagaagtgtcaggacaaaggaaaggaactttgggcttctaggggcagcaaattgtgggaaggtaaatttttgggaaaagttaatggaagatgttgggcacggtgtctcacgtctgtaatcccagcacttcgggagaccgaggcgagtggatcacccgtggtcaggagttcaagaccactccagccaacatggtgaaagcctgtgtctactaaaaacacaaaatattagctgggcatggtgggatgcacctgtatacccgctactccggaggatgaggcgggagaattgcttgaacctgggaggcacaggttgcagtgagccaagatcatcaagatcatgccactgcactccagcctgggtgacagagtgagactctgtctcaaaaaaaaaaaaaaaaagaaagaaagagagagagagagagagaaagaaagaaagaaaagaaagaagaaagaaagaaaagaaaagttaatggaggatgaggtctagttagtaggtttgttttatatactatgtagattcctctctggtgccttccttgggctggtagactttatagctgtttctggtgatatagaatcatcctgcccttcctgatagagggggaggataacagagagtttttctcgtgtcttcttgtgttttgttttgttttgttttgttttgttttgttttgtttaattgcctttgactcaaaatagtccttaggccagagtgacatattttggggtgacatcctctgaaccttttcaaatataaggtctgcctccttctttctacttcataacataaagtcttctttctcttccatgaatattacaattcctgcctgagtcttacaaggccctcctcttccctgtaggtcaggacacaattggtcctttgaattgaggtgtggtagtagccaagctttcaggagtgaggtttccacctttcatcttgtttctaaaagtaaatatctagtaaatgataaagctgtgtttttagttgtaagtctatggtgattgtatagcacagaatgattctaatgtattattttagcaatgaagacaagcagatttgatgcagaaatccttgacataaggagccaaaatatttatgttgcccttaggggatagatattaaatatatctacccatactaaactttttttttttaagagatggagttttgctgtgttgcccaggctggccttgaactcctggactcctcaagcaatcctcctgcctcagcctcctgagtagctgggattacaggtacatgtcactatgcccaactttcccaaattaagctttaacaaatcttctcaataatgttttcctaaattattcttgaatacagtcatgtagaacatataacaattatgaagttttaaaagtctttataattcaggaaattttgaattaataaaaacaaaggaaactttttgttttttgagacagagtctcattcggtctcccaggctggagtgcagtggcatgatctcgggttcaagggattctcctgcctcagtctcccgagtaactgggattacaggtgcttgccaggaaataaaggcaataaaaggtcattgctaattatctgctctaggtttaaaaagttcatctaaacttttcaagtatctttttttccctgaagcctacattttgttattactttagttggaaaacgactgcagtcaatgactcctcattccctcaccattctgacatgcactccagcatctctttgccattatttcagcaaagatagatataatatgctatagaagaaaaagagtagcaaccttaacttaagagttgagttcctattgtaaaataaagacattactgagactgggtttcaaacaaatatatttttaagctccactcctgtggatttttttgttttgttttgttttgtttttgtcttggtctctttgttgatcctgtcagccaatggtttctcacttgcctgtcagagctgaagagtccattccttgtcaattcagatgcgaagtggaacaaacgtcctttagtaacaaaacgaatccgaaatgaaaaaggatatgttactgctgactgtggtggttgtcaataaagatgttttcatagcaactattccttcaaaatacaatgaacatctgcaatagtcttttacccaaatgacaaattcctttcctactaaatcatgtctttacaaaattagaaggctctattttaaaccttgaattacttgacattgaaggtaatgctaattacaataaaatctcccacttacataattattaattcaaatttgcacctttttcctgaattttacctgcttagaaatccttatggtgctaatgatgaacataacgattaagaattttgttgctgaaatctctctatgcctcagtttaaccatgttaaaaattgataagataatacttaattgatagaaactgtgataataaaataacaccacaaatgtgattacaacagaacatggcaaaataaatgctagctaaatttttaaatcatggtttaaagatataatttgtgttactttaattaaataattgataaatagatttcttgccttgacattaaccttgagtattcatatttctgcaagtaggagaggaaggatgtgatgtctttccccatccgtcataagggtcatggccaacactcctataacaaaaggtaggctaacgagaaaaaagcatgacaaatatttaatcatgcttttacgtgacagagaagccttctgaaagaaggctcaaagaaccagggaaaactatccatctttatgcttagattcaatggagtggacagttgtgtagaaatgtgatcggacaaaggaagaattatctaatagtaatggactgcgtgtggaaacccataagaactgtctattctgattcttcttggcctctctgtgtggcatttcttcctcctgggtatggggcatgactccttctggaattagggtttgatgacctactatcaaataaggggaggtcagagaatgtctttatggccagctcctagatagaaaggcaggacaaggttagactaatcattctagcttttatttttggctttgaggaaaagcagatatggtttgtatgacccaccttagggaagaggaattccagtttttatggttcaccttgagggagaatgaggggcaaaagacatctgaatccttcacttcagggtatcattttctgaggctcaatatggacaagtatttataactaggtgcttaatatggccttttgagatacacagttcctatgctgcaatctcacaggcaatgaatggtctttataaaagtgtgttaaagttgaaaaaaaagcaacaaaacaaacaaaaacctgaagaaatattcctcattgaaggtccagcttacattaaaaagaaaactataataatttattctcttgagaagggttgtatagcaaaggaaaattcttgaatgttccctctgcttgccccatgcatcaattctattgatattaaagtaggcctagcaaatgtacttccattctcactgactcagtctttgtaattcaacaccaattctgaaaaatacttagaaattatttcagtaaacagctcttataagtgctacatgcataacaatatttcaatatcagagacttctatcccatgagaagatattttcaacctaaaatttattataaatgacctaacaaagaactattttttcagtaattggctattatggttcaatctgttatacccactttacactagaaactatcctatattttcttgttgcctacgtaaaagtgggcacgaaaaggttaaacagtaaacttcctgactcctgccagccaagggaagactactggtgttacctacgaagtgtcatggcattctcatttctgaataatgagggaaatctgctttcaatacaaacccccataagacagtcactcttccagacaaattaagctaaataatccatcatgacagctgagaagacaatgtgcaaaatgtcagtggaggccagggagagaaaggcagagatggactgtaagagctgcagcatgatgcaaatactgagaaaagacattctctgttaatacagctcttaattgtaggcattttttacagaacatattgagagtgaagcaaagcttccttagcagtactctgatgtcttctcagcaggataatgtagggtaattcacagtgaaggcaaggggttaggaaagtcacagccctaaaaatcaatgggctgcttacagggaagaaggtgcaacagatcttggagagcacagaaaagaagagatgagcagcctgtattgaacagaaaccaaaatattagttagatatatccagcaaagccattccacaagttcgttagtgagtaggtgccaaaagccaactgtaaatcctagatacttgtacatatgcatgcttatattacttatattttaagcagtcatatcctcaagctatattatgagttcagtcattctaaaaagatgcttccattgtcttcttggcacttactcagaatcttcagttatcttattcatactgtgtgcttactggttgtcttaacaggtgagggcaggggccctgtcttattcacctccatatctccaggatatagaatagtgcttggcacacagcaggaactcaataaatattcatactattttgagtcccttaatcctcatatcaactacaggatttagattttattgttatctccattttacagatgaggaaaatgaggaacagagaaattaagtaatttgcccaagctatgcatgaataagtggcagagtcaggatttgaagccaggcagtcaatccctagaatttacactccaacaactactgcctctagtggttatgtatgtatttatacacgtatatatttgcagaaataattgaaacttatttctgcctaggtgcatgatatattaaagcatcactaaatccttctgaatataattcaaacttcttcctaccatagacaaagtaatggcctatagtgaacataatgattatcccatcatacaccttgtactgtattagttttctttgcaatctcaattacacttgcatttttattatcatggttttataaaactttatgactggaaagtaccgtattcataaagagttgtgcctcatatatgttagacatatatgcatttttattagtaattataacttttatgcagccagatagccccaggtttatgattccacatcttttgtgttgtgtcatcttttgtagctagttgatattgtaatgtttgctgacttaattcattcagttattaatttctataaactagaatttaggggacatttcaatggactatggagagaaaataactgaaaattggaaattaagagcatctgagaaaattcaagttgtttgtacatcctggacataaatctcaggaaaactgacatattttccttccttgtcaagtcatacaaccaatgctatcactaaaactggtctaacatttaaacattcagacaatcagtttagtcaatgcttcaataagtttactgaactagcagtttcttaccaactagttacagaacagtcacagctgaaaatgatctatacattgtattataaatgggattaattattctgccagacaaccccaggtgtgccaaataacccaaccccttcctccaagacactcattgagaaactagacagcatctgagcattgtaggaacaaacactgaagtaaatggattctaaatccctttgagttctaaaatgctgtagagatctgagaagcccacaaccttataacagcaggcaacatagattacgcttaaaaagcaacatactttcaattgattgataaacccttttgttgttcatttattgcaaataggttttagagctcaattcacacttttgtgaataaacattgaaaatatttgattcaatggttatatttctgcctgacatgaggaaattatagaatctattaaccttaacaatttaattagcatgtcccagacttaatcactcactatctgggtagaattggcccaattagttaaccactctaaaccacagtttcctcatctgtaaaatgggatggaaaataataacaactcatagggttgttaagaggaatacataaattattcatgtgccctgtatggcacacaataagtccttattaaatgaaccggttgtagaactgtattaagaacaagtagtagtagcttccatatttagagagccatcaattctgttttccaacagctccattagtgagaattgtgctgtgtgttttccccccaccccgccccactacaactgcattgctatatgcaaggatataacttctgtctctaaaactattcaaatagtgagcctgggaaaaacaaacttaggtcaaaagagtttgactaaactggctgagaacatttaagttggataaaaatagatgtattttgtttgtataaatagattttggtcatgagaaagaaataaagaggttcctctcaaaagaaagcctggtttagcagtcagtaaacattgggaagagtcagcagttgacttccccactgtgtggaagaaactgccaaaagcccatccagaattaggtgtgtgggagggaagaacaaaggagaggcaaacaagaagctgtcactattcaccactttcaccttgaataacctttaattgaaaaataaagttgccaaaacaaggagtaaaagaaaaactaccattttattccctccttgagattgaattagagggaaacatactgaccacagtaatcccaaggttggactcacatgatggcaaatgtcacttagttctaaagctctaattagaaacagggctgaagttttagccagctcctgctactagaaataaaacatgaggcaacagcaacccaagccctggacaccccctgacagtgaactctgaggtgctttctgagtgagttgagtataaagctgacagagcctagagaattcatacttgagcaaatattgggaaagaataaactgggtcagttaccacctgtttctagattttatttttttctagacttcaactaagattgtctttcacattaataagaagaacgatgaacataatctatttcatccaacttctacattccaggcacagtatcaaccactttattacattttatcttctgtaatattcacagtgttattgggtagattaaacaacttgcccaagttcacacaactggtgactggcagaaatgggatttgaacttatttgatgccagaggaggtgtatcctttaatattttagaataacttatttatttcattatattttatgaaccttgaaatatgtttattgtaaaaaaaaaacgcagaaaatacagacaggctaagtaaaatgtgtctttacattaaagtatttaatttgcaaaagaacagttgttattttaaaatcctaccccacagtttttcatatttctctttctatgtagggttaatctcatcaggaatttctcttatccatccacagtttgtaggacaattctttgcacataatgggcactcaaatgtacgcagatcatattagtccaagaaaaagctgcttgttggggctaccaagccagcatggtaacaccttacaatcaccctttctacctgcagtcacattgttcccagagtggggtggtgatacttgccagctagcccaagtttctggatatagacctttaacaacttcacaagtacccttagaaaattcggttaagaccgaacatggacatgcttgctccatttttttccactctcaaaatatccttgagcagtaactcattcatagataagaaaaactttttctcttcagttttttcttttctttttgaatattctttgattttagcagaaataggcacagtaaaagaataaatataagagacgaagaataaaatttatgaaatttagaaagctcatgttagagaattgtactctttaggtagatccttatttaaagaataattagaggaaagaaaacaaaagatgaaagagtacaaatgagattcctgagcagttttttattttgattgataaacttttaaaatgtgtttgaattacaatatttatatatcaggaatatgaaaggtttaatcataaaaattacataatatttcttccaacattttcatcttgtccatttcttcatatctatagtggagaattatccctctgtaggcaagaagaagtctttattctcttcggaagctgctcctcttgcactccaaaatatagttctgatggaagctgccaatcactttatcccattcccagaacaggcatggtaccagactgaggtcaatcctatactccaccttatttgccatggaaaatagcctagcgatacttgcatgactcagggcagttggagtagtttgatggaattttttaaaccacagctgacaggaagtagctctgttccttattagttgcaaatgctgcaagcatatgaccctagagttatctgttgccagttgttgccttgtggagatcataggcttaagatgatgaaggcagcaatcagcaataagcagaggtgtgcttgtgtgtgtgtgtgtgtgtgtgtgtgtgtgtgtgtcagaatgagagagagagaaaaattactgcttctgaaaccaaatccatttccaaggtgtggttttagaagcaaataaattgccaatttcagagctgattcaagttgaatttttgtcctgtaaccaaaagagtcctgactaacagccaaaactcaggctgtcaagtaaacataatctgtaagaatccgctttccagcctccattccccttgacatcttcctgaaagaagatttgtataggaaatgctgacgtctctttggcaactgcataaaaattattgtattcaacaaatttattatatgtctctttgtggccaggcagcttgcttggcactggaaattggctagggagattggggcaagaaaaatacctctctccatggtggaggcatacataaaagccgattgctacacaactgcgtaagaagtgctttaatcaaagcctgaataaagtgttgtggaaactcaaaggagcaagcaaaatgcttcacatgaaagttggacattcgagtcaaagactcacaggattttcccaagcagaaaagaaaggagaggacatcatggacagaggaaatagcatggtgcaaaggcatggtatgaaaaaaatacacgacaaatttgtggaataacagaacttttgatgtgatcacagcataatgtggagttgggtaacagtgagggattaggctaaccagcttggcagaatactgactaaaaattcttaaatgctgtgctaagttgttagaattttatcttacaggttttgagaagccatctgcagctcacaactagatgagtgacacaatcagatgtgcgtatgcaaaaaaaagcctggagacattgaactaagatcaaatttaatgtattaaatatggtagaaagaagagagaatgaaaaataatgttaacaatctaggtgaggaattgctgaggagacaaattaagtaaatcctgtggaaggaaagaagaaaggaggaaagaggattggatggaagaatctccacttctcataggtgtagtccttccttagcctgctttttaatgagtgctgctaaagcccttagcctgcctgtttacccttggagtgaatccgtggaagacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaaaatctcagaatctgcttgagaatccggtccttcttcctccatacacccatggaacactcccaaactctgtatgctgctcactaattctgattaaggtcttcaccctccctaccttggaaattgctacaacataattgtgtttgtatgtataattaatatatacaatacattttaaatgaataactaaagttgacaaaaacctc

SEQ ID NO: 2548 - DNA, 17417 bp, Homo sapiens
cgccaccacgcccggctatttttttttttgcatttttagtggagacagggtttcaccgtgttagccaggacggtctcaatctcctgacctcgtgatccgcccgcctcggcctcccaaagtgctgggattacaggcatgagcaccgcgccctgctgcactcttttcattcttaactgcaatgaatgagagtttctgttgctctgcatcctcccagcattttgtattgccagttgtttgggttttagccattctactaggtatgcagtgatatctcgctgttttaatttgcattactgtaatgaggaatgatgttgaacatctgtttttatacttattgacatttgtatatattctttggtgaagtgtctgttcagatcttttgctcattttttcaagtgggttgcttattttcttattattgaattttgagagttctttatatattatggatagaagtccttgattagatacataatttgcaaatattttctcacagactgcgccttgtcttttcattctcttagcagtgtctttcacagtgcagaagttttacattttgataaagtccaattattcctttctcttctttcatggattgtgcatttggtattgcattttaaaactcattgccaaatgcaaggtcatattgatattcccccatgttttcttctagaagttttacagttttacgatctacatttttggtctatgacccattttgagttaaattttgtgtaaggtatgttatacatgtggaggttcatttttttgcatgtaaatatccaattgtttcaacaccattggttgaaaagacggtatgttctcctttgaatgcttctgcgcctcaattaaaatcagtttactctatctgcataagtctacttctgggctgtctactctctttcattgatctgtatgtctgtccattttccaataccactgtctttattactgtagtttcatagtaaaccttgaaatcataattctatagtaagtctaaaaaaatcacacaggttggaaatgcacaattagtatgctaaatcagagcaatcttgttgtttcagatggtttatgggagaaatattagccagtgtcttcacatgctcattgatgataactgtagcttgtaagtaactgtttcccagattactgcaatgatgcctgtatttcattccaattttggtcactttaaaatgattttaaaatattttctctgtttcactcaagatgtgaaatcattgtttctcagccttgccagctatttcaaaaccactgcctgtgctcggtaagtgttgcctgtgtcatcattattgtctggaccaaggtgatcataatttgatatctgagaatggtttctgctgcatagtagatggcaatgacaggaaacatcctgatcattcgtcctgaagactactttctgttactgctaaaatttaatagtattatcatcctgcctcctaaatttttacatcaaaataattgttaagcacaggacttagaaaataatttgaaaggcgatgtcatttaaaataatttttaaagtgattttgtagattcatagcactacactttataaatacctcatctgaagaaacctttgtgttagacgttcccaaatagctggcaaactgcccatgaaatgatctcagttacaaactgtgatttctgtgccttctcttattcatttaatgatccccttgtgtgttaactgccatggttcagcatatttcaaagggttactggggtctggttgggatgcccatagaatttcaaacagtctggatagcaccatcctattgcacgatggactgtgttaattaccttcacttcaatatggctgccagaggcaaactcacatggcttggagactgaggtctgtaattcaccatggcactcttacaaaatctgcgctaattctgaaatcacaatggggtttagtgaaaatttattttggttaggattctagccaatattgacttactgacattttgagtgatgcttcccataatttctgggtatttctggtttctgggggtgcacatacagctaagttttattcaacctgatatttagaaaatcgaatctctgggtagctcaagaaatccttataatttagcccttgaaattaatgacaaggctgggtgtggtggctcacacctgtaatctcagcactttgggaagctgaggcaggagacttccttgagtccaggagttctagaccagcctgagcaacatagtgagacctacgaaaaatagacaaaattagctgggtgtgctgatgcgcacctgcagttgcagctactggggagactaagatggaggaattgcttgagcctgggaggtggaggctgcagtgagctgtgattgtgcccatgccactgcacttcagcctgggctacagagagagaatttgtcttaaaaacaaaaagaaaaagaaaaaagaaaaaagaaaaaggagttaatgacatttgtttaaaacaattattgatttctaaagtggcaccacctaagttaccaaatctttattaagaatttacaatatgttctatacggtatggggtaccaagtttagctcagttgctgttaatgaagtgtctaccatgggttagacacagtcactaggtaccagggtgtgaatgccccagcatgtggctggctttgagattttatcatctcattagagtaaaggacttgtaaggggcaaggtgaagttgccttttaatatggtaagtgcaaatatcaggttagtacaggagccagggggagcacaaggaggtcagtttcccagactaagaggagtggggagtatgttcagggagggcctcctggaagagccaatatccgatctgcaggggttatatcacctgctgttttctcagaacttcccattgttctgagctcattgtttgttctctcccaaaagaaattacatcaggacaatatttctatcctgaacaaacacttttatcttctgactcatttatggaaggagatcctttctttgattatttgtgtacatactttgacttgttcttctcttgttcccaactccattttttcctgtttcctgcccaccagcctcatatacacacacatttgcatttaagacctgtgaaaacaaggactattgacttcatttttgtatctacaaccaaagccttgaaaatagtatgtactctgtacatattcattaaatttaatgtatttactgcatcatttcttgaagtacttccttgaaagccaagagctctgcgtgtatattaaagattttgcaaccctctccttcttatataaacataccgagaaactaataaaccaaagatatggttattaatatcgagaatcaagaatgactcataagtctcctctaacaatcaatgatgagaatctaaggaactgaattcagttcaacaaatattaatgcagcaccctccccccaacacacacacccatcctgcactgtgcaagttagattagattaggtgcctctttagcacctcacacggctcacatcatatcccttttcataacataatgaaattcttagtcaactgctttcctgattaaatttaaagcctgtgaagatagggactatctgtcttgtccaccactggcctgagtgtcccttgcaaatgaaggtcagcacaggtatctcatgttagtaatgatgtgttagcatcagcggtacacgttttgcacacttatgatttcatagtaacaaaatgggtcacatctgttctctcttaaatgaaggaatgtatgttcgtatacttaatgaatgagtgaataaactttagggaataaaaatatggggaaaatccacctgttaccctacaggctgttctacggggcaggagagagcaattttctggaaggtgtattcttttgagccattttctttaccaagtttttaatcttcttgaggatcatgattacctttcacttaaagtgcaattaaaatactgatataatacagaaaaatgccataagggcaggtgggaagaggaaaccataggaaatattagttaactaagtaccacgctgggctgaggggtcaaaacctctatagtctttcagacaaaaaggagagcactaagaactgctgggataaaagcaaaaacgaaaagtacccttagttgaggctgcactcttcctagttgtgataattcaggcccgttgtgggtatgggtgtgggtgtgtgcttatatatgcgcaaatgggtatgcagtgattagatactgcatttcctgtgcatggggatgaattatgcatttcttttcttatttctccaatctaggtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagcaaatttatatttgtgtgtgtgtatatatatatgtatatatatatttttttgagaaatcatggcagaacatcattcattgaagactgtattatttccctattgctgccttaacaaattaccctaaaccaagtggcttacggcaacacaaagttattgttttacagttctggagctcagaagtctaaaataaaggtcagcagagttattttccctctggaggctttagggaaaaatctatttccttgccttttttagcttccagtggctgtctgtattccttggcttgtggccccctcctccacctccaaagcacaccactctgatttcttacttccatcattacatcaccttctcctcttctgcagtaaaatctccctctacctccctctttaaaggacacttgagactacatttaggatccactctgataatccaagataaaatctttgacttaatgacaccttcaaggcccctattttcatataaggtaacattgatgggttcctatgattagaacctggctattttgggggaccattagtaagcttaccacagttgtatttgaaatagcctcgtgtaataatttagtaggtctgggatatgtcccatgcctttgccatttttacaagtaggttaagtgatcacaaagtgatccacaatccacgtgcatgaatgctttgaagtgggatttaaaatgaatttaatggagaactaaatgcatatggagcctttcatttaatacactattaggagaacttccattgagaatttctacatttcctttgtctatgtgtaacacacatttttctacagagtcatttgatttaaatgataatgtttttcaaagtaagatactgaaatagtactaactgtttacgtgcatataatgcttcattgttgacaaggacattttctccccggctgtataagcttactatggctacagtaacaagttaccacagatttggtggcttaaaacaatgcaaatttattatcttacagttttgggggtcagtccaaaatgagccttacaagggtaaaacctagagactgcttgcattccctggcccctggccccctcctccatcttcaaaccacttcactctagcctctgcttctgtggtcacatctccttttctgactttagacatcttgcctccttctttaaataatttttgtaattacatggggcccacccagataatccagaataatctttccattttaaaatccttaacttcatcccatttacaaagtccttttgccacataaggtaatctagtcataggttccagagttctggaatgcagatatcttccaggacccaatggctaaggccttccccagtgaaagcttcagatgagaggccggtgcaggacaacaccttctttacaaccttgcagaggacgcagttaaagacctctgcagaaactgagattaatgtgtgttctaagctgctaagcttgtgctaatgtcattacatggtgatagataatgaacacaacatccactgattctcctccaagtgtataaagtgtgttgctgtgcaaaatgactttaggacatgtcccctagcagtgggctccagccagatggttgctcttgagccccactacttggagtggagagtataaccttaatatcctgcagatccatctgtgacagaggtgcacaggacctgactagtgatgtgtgtgctgccaggaagacttgtacatcactggatgtcagctctctgccaatggccagcctcaatcctcttcagttctggcagctgtgaaacccagtatcaaggtgctggcatctggcaagagccttcttgctgcatcatctcatggctgaaggtgagaagatgagagaaggccaaagggaggaaaggggccaaactcatctgtctatcaggaacctactcccgagataactaatctattctcacaataataacattaattcattcatgagggctgagccctcatgacctaatcccctctttaaggtcccatgtctcaacactgttgcactggggattaagtttccaacatatgaaattttcaggtcacattcaaaccatagcatgcccttttaagaaccgaagaataaaaagagacgaaatcttgctagctgtatcaggagccctccagctgccccttccaacatcctcaccttcagaataaccactatggctgagtttatgataatcacctctgcatcttgctttatagtttttattaccaattacgtttctaaatactatagtatagctctgcctggttttatttgtttgtttaatatgcctattgggtctctttgaatgcataagttcttcctccctgacctttgaaatttgtttctttgaaaactgcatcatttgtcttgtagactttactccattggaattttgctgatcgcatgtctgtggtaaagtttaatgtcttccttagtcttctgtatttcttgccaactgaaagttgattacagaggcttaatcgttttttgttttgaattttgtggggaacaattacttcctaggtggtgtcatattctttgtcaagagtgacattatgtcattttgtgttgtcagcagccatttctgatcagtggttagatatctaattaattagagattgaaaaggatgatattccagtttgatcacatcttctttattgggaatatatctgtgcaaggaaacatctaccgtctgattgcccagtggttcagattttataggaaaggagagatgaatgcttgagtcttttcctgtatttgctaattttcaaaacaaaaagtttatttcttaatatcttttaaaggtggccaggatgctatgtataatcagcatttatatatatgaaggaaccatgtttaatatataaaatttcccaaaaggcacaccctccaacttccaaactctatatactttgtacctcatcaagatgctaaaaagattgagaaagtaaattaaagtatgggagatatatagataataactcaactttaaaaatttaaccaccatttattttttgagagcctactacctgtaagaactgagtcaggtacagatgttttaaaatatggtgcctgccctcaacaaacttgctctctaataggggaaacagggcattgcatgaaacaagaagggtaagaccatggggccaatactgatggaagatgctaaaggactgtagaggatttccactcacccactgtcatagctcagactgctataagaaaatactgtagattcagtgtcttacccaacaaacatgtattttttttcagaattctaaaggctgcaaagttcaagattgaggtgccagctgatttggtgtctggtgagggctcacttcctggtttgcagatggctgtcttcttgtttcagcttcacatgttggaaagaaagatccagtgtctcctcctctttttataagagaacaaaccccattcatggaggacccattatcataaccagatcattttccaaagtccccacctccaaataccataacattggggattagagcttcaacatatgaatcttatagggacaaaaacattcagtacataatactcagttaccaaaaatgtatgcctaataaattttagagattcaatacttctgaattgaacatcactgttttgacttacaggtcttttaacgccttttactagagatattattttgctgctctaaaaagtataaatggtttgtagttgttctagctcattcatccatgagttcaatcaatccaatcaatcattattataattgatcacctgataattacctggcacttcttaggaaccaaggattttttaagtgaaggaaatacaattctactctcaaggagcagatgtcatagcagactgggaaccagctaagcatgtaattacaagtgtcaaatatactctagagccaaaaaatgcatttctttgaaaacatttacaaggtcagattctctggtaatttagatgaattcttcctttgggttaatgggaattatggtattgtcttctctttttgagagcagagagggatgagacatgaagggagaaccaaagtatcagaaacaggtagtgaggagaagaaaataaaagaaatgattacagtggcaataagttaacagtaataggaaatacgatcactggggaacttttattctgtgcctgatcctgcccctgacaagttcacgttgcatgttctattaaatctcataacaaccactttagctaggcaggtgtgatggttaattttatgtgtcaacttggatatatcatgatgaaaagttgcttggtcaaaaactggtctagatgttcctgtgaaggtattttgtggatgtgattaatgtttgcaatcagttgacattaaataaagcagattatcctccataatgtgggtgggcctcattcaacacattgaaagccttaagagcaaagatggatgtttactaaagaaggaagtctgcctccaaattgcaatataaacattctgcctgagtttccagcctgtagagtcaagacagtaacattatctctcacctgaatttccagactgccatcttgccgtatggattctggacttgtcagctcactacgactgtgtaagccaattacttaaaatctctctctctctttccatatatatatagtgtatatatactgtattagttaaggttctccagagaaacggaaccaataggatgtgtaatatagatatacatgtattacatataatatacaaaaaatgtatatttataattcatcacataaccaatgggacatataatatatgtgattatgtataatatatgtgacatatgtaatatatatgtttataatatatcatatatcctattgtttctgtatctctggacaaccctgtctaatatagcagatatgattattgccattttatacatttaataacgttagacaggttgaataactttcctaagggtttccgaagatgataagtaagtgggagatctagatttcaaagccaagcctatctgacccacagcccttacttcccctactactgattgccgctgagaaggtcacatgagaggggcatggtgccttggtgatcaaaggctgtgtgagtcattctcgccagaaatgctaactcaggagaaagttttccatgaggtgaaacattaaatgaaaagagtcatctttcaaagacaatgatgaccttcaccttttttcttgtatctcagggttctcaaatctagtttcttggagaattggcatgaatgagatgcaatataaagagaggaattatctaacattgtccggtctgctttagagcctctgttcatagaggctgatgtagctacagagctcataaaaagagttgctgttttgttttggcgcatctactatatgccaggtgatttatcttctttgtctgtaatcatcgccaccatcctgctgaggactacccttggtttggtcagcttccacagtatgtaaacccacatcatctctgatgggatcagccagccgtccttcatcttgtaaccatgctgtatggcctccaagcttgcctggcgtattctgtcttaattttctctgactgggaagtgtcccttcgtttataggattggtcatatgacccacttatgcaaggtggtggagaaagcagggaagtacacgatccgtgtactttgacgagctttagcagctctgccacccactctcatttaaaagtgaggaaggcaaacttcaaggaggatgtattgctcaccctgagtcatacactgcaggtctctaaggcgcctgtgccactcacctccaccccctccccaacaccctcactgcaatgctcctccaagcaggtatctacggtagttacttcaaaacaactcagatgcaaaatgatctgcttgtgccgcaggagaggccaaccaccacccccaaaaggaatcccactactgcaaacacaatgcagcagacacagacacctgccaacttggcatactttgcatcaatgccacatttgcctaccaggctttgatgaagatctgatcatgtatttcaaaaaaaaaatctaccctactgtgcaggctgtatcccctccatctgtcccatgcagggtaaaatctgctacagctgcaagctacacctgctagagagccagacagggtaacttgggagtggagggcaatttagcaggtggatgctaaaagctggaaacattttgcaaaaattttcttatccttttgtagccttaaaggaaactttttaaaaaagaaaataagatgcaaagggtaaaacaaaggctggtgaatcaggacttgtactttcaatgcaaaatgaaattttgcatttgcattgtagagagggaaggtagtccctcctccagcccaggccaaattgaaacaacatacctttgtgtgggtgaagctcatcttcaggctgcaagggatctgctgtgggggagacagctgaaattcactgccggcagttccattttattctcattttcttttctctttttcagtaaaagaaaaggtcaagaaacacattctagagccttccgccttcctaatcttccttgtttcctctcttgctgtgtccttcgaagagtagcatcgcagtatagcatgatacttcagctctggagtcagaggagacctgggactagactgtgatccagctacttaactgctttcactttggacaagcgatttcacgtttctaagctttaatttcccagtctttaaaatgagactaaaatattacctaattcgtctaacttttatgagattaaacaagttcatgcaggcaaaatgcttaacacttaaaacagtgctagatcataagcttttctgaagtgggagctgcaattattattattatcattattattgtataataatagtagtggtgacagtagtagtagtatttatgacctctgggacaacggaaatttttcagttattaggtgagatgatagaaaggagagactaactgtgggctgaggcttagctgcggccgtgttaatctagctgaataaatacttcttccaatatttaacacaagttagaatggtataaaggcaaaaatacagattttgaggtcagatagacatatatgtagacttagacacagacacagactctggcagttccaccatttctagctttgtgatattggacctattagtcaacttcattgaccctcactttgctcatttataaaacagacctaatttcatgacttgtggccgtctctgaagtgcttgctgcagtgtggagtgatcgtatggctttattgtcatagagaagaccaaataagagaaagtaagcttatatagtggcatgagaaaagattggctttaaaaataacttctttaattcaattttctttattttgaaagtgactcaccatcattttatttaaataggaaggaaagaattcaaataagcaaaagagaagaaattacacatcatccctcaactcaagaatagccaaggccaacatcttgatgtttatccaagaaaattatcttggctgcaaggttgatgagatatgaaagcaggccacctagagagggggactttgggcctaggagctgccaccatctggggtcaatcatgtggccattgctctggtggaagcagagggctctaccagatgacaggctcaaccccctgctatgatttattgtaagggaagtgccatcagctgtcacactgcaccagtgtcatcccacttcccatccccaacctgggggcaagatggccacacaataagttagttttaaagacactttatccaaagggaagcaggacataaactaaaatctagtgcattcggtgtgtcttcccaccttccttttcttcctcccttattttttgtttcaactctcaggcctttgttagttctggggtccatgcagctcaggagctcacagtcaagatgtagacaactccaggtagcccttcccacctctgcctgaataacagaaaggcagacagaaaagcttcccaggcatcctctgtacttcactgcacagtgctcagcacactggtctaagtccagtgtccatctttcctcatgactacaagctccaggagggaaaagatcatttcctctgtggtcattactctattcccagtgcctctggggaggcactcagtaactgttgatcagactgctgctattgaaagaatatatgagccgggtggtatttgtagtgaacatttgttgtcctgttctgtatcccagtgctatgttttgaatgtttatcccctccaaaactcatgttaaaatgtaattgccattgtaacagtgctaagaggtgggacccttaaaaaaggtgattaggccatgagggctccctcttcatagacaaggttggtgccattataaaagagcaagccccctcttgttcattcttgcccttccatcttcccccatggataccacagcaagaaagttcttgcaagataccaacccctcgatcttgaacttctcacatttcagaactgtgagccgataaatttctgttcattttaaattatcaagtatgtggtattctgtcatggcagcataaaaatgaggaagacactctatcacttcgttttctattctgattcctataacacccttttctttgggcaatcactcctcctcagtccatacattttggtaaggctactgatctcaaacccagaccccaaaccttggggacgatggatgtataagacacaagcttgggcaatcagattctgtttctatttctttttttacagacaggatctccctctgtcacctaggctggagtgcaagtgcagaggcacaatcacagttcattgcagcctagaacccttgggctcaagcaatcctcctgcctcagcctcccaagtagctgggactacaggtatacaccactgcatctggctaatttttttttttttttgtagaggtgggggtcttacttttttccccaggctggtcttcaactcctggccacaagtaatggtaccacttcagcctcccaaaacgttgggattacacatgttattcattaacatgaactgctgcacccagctctcaatcagactctttttctcccagagccagctggtgatgagaggaaggccatgaccaagtccaggggattgagggctgcactcattcctgctggcttctcccaaaacctggttgactgggtctgtcaaggagtctctgaggaacctcactgcctttcccaacaatctctccttttaagttagtcagaacacatttatcttgcttgctacaaaaaagaaaataatatatatctaatatgctctttttgcctttaagaagtttaattgaggtgaaattcatatggcataacatttaccacttcaaggtatacaattcagcgtcatttagtacagttgcagtgttgtgaaccacaacactgtggttccagaacacaatctatcaagttccaagacatttttgtaacctgaagagaaaatcctgtgctcattaagcagtcactctccattctgcccttccctggcccctggcagccactagtcttctgtctatggatttattttgtctatttcatataactggaatcatatgatatgtgacctattgcatttggtttgtttcacttaacataatgtttgtatgtttatccgactcacatcttagcatgtattagcacttctttcctttccatggctgaataatagtccactgtttggatataacacattttgtttattcattcatccactggtggatgtttgggttattaccacttttggggctattgtaaatggttgtgaagtgctcttgaaaaaaaaagagtgagtgagtgagtttggcaggtaaggaaaatgggaaaggatatttgaaggaaagggagcaacttattccagggcagagaaagttttctacctggccttccctcttttcactcttccaggctgcagtctccacacagcaattacagtgatctctctaaagctgacatcaggccacttggcttccttgttaattaccctcaatcccaccttacatttcctcttgcttagtacatcacagcgcctagcactgctcccctttctgttcttataacatcaccaagctcagctctacctgaaggctttggcacttgtaggacactcaggcagaaacattcttctttctgaacttctcagggccaacttcctctcatcatgcaaatacctcccccacagagaagatgtccctagcatcttagggatgttctccctattcaggcacgccacccctggtcacacaactatctcattatcagaaattatcattcttttttttttttctttttgagacggagtttcactctgttgcccaggctggagtgcagtggtgtgatctcagctcactgtaacttctgcctcctggactcaagcaattcttctgcctcagcttcccaaatagctgagattacaggcatctgccatggcgcccggctaattttttttgtgtgtgtgtgtgtgtatatatatatatatatatgtatacatatatatattttaagtagaaacagcgttcgccatgttcaccaggctggccttgaactcctgacttcaggtgatcagcccgcctcggcctcccaagtgctgggattacaggtgtgcaccatcgtgcccagtcagaaattatcattcttattcatttgtggtgtgtgatttttgttggtttggtttggttcttggttcctctctgttctgccctatttttttcaccagaacagaagctccagaaataagtaattgcttaaggagtggatggctggatatgacccattagtgaactggcaaggaatatattgtgtctggtgcagagaaagagagcttcaggtggcatggcatgtggtggaaatattgactgtgcccagattattcaagatgccctctttataccaggcacattgtaatttagctttagaaattctctggtgtgatgatttcacagtaccaaagggaactgaatgcttgtctattatttatgtttcagagtcagcatagaaaccctggaagagagttgcccctgagaagcagctttgcaaggggtggcagctggctgggaggggtcagaagatctatgttctcttgtagtgctgtgtggttttgggaaaatcatctaacctctctgaaattcaggtttctcgttagcacaaatgaagagtatatgaggataagagctttccatggtctattacgaagtgtgggataggtttgtgcatacttactctagtctcatgctcagaacactctgccttatgttgtgctgcgaggttgataggaattatagttcccattttacaggtgagggtccaagagggtgagtcacttgcttgaggtcaattgtcaaccactggaggagtcaaggtgaggtctgcctccaagtccaggatgttttccacttgtgcttccctgcctatctcacaggggtgttgtgataattaaagacaagttataaatacatacattttattaatattttctgtcccattcttattgtatcactggccctagaagtaagattgaggtcctccttgcttctcattgcacctactggatgattatcccctcttctcccctaaaacctccagttttgaagctcatgacaccagactgcactatctgctgctgcttctacgtgcaaatactaactcctcatttcttgaagactttagcatctctctcattgtcaatctctctagtacgattccagtcattcttggtgagctccacatacacattgatgtctcctctcatactctggcccatcagtttctttatttttatttttggattttttttttttctttttgagatggggtctcgctctgtctcccaggctggggtgcagtggcaaaatctcagctcactgcaacctcttcctcccaagttcaagtgattctccttcctcagcctcccaagcagcggggattacaggtgcatgccaccacacccagctaatttttgtaattttagtagagatggggttttgccatcttggctaggctggtctcaaactcctgacctcaagtgatctgcccacctcggcctcccaaagtgctgg

SEQ ID NO: 2549 - DNA, 512 bp, Homo sapiens
gctgatgtttcgcatggaccttaacagagtaactggtgtctcttcaggaatggggcacaatccagaggttactaaccacggaacatttactggatttggtacttggcgaaagaaactgacaaattaagaaatgagagagagaataaatgcactgtgcatgctgaaaccccaagaagactttttttctcctactttttatggacctgaggtgttggaaatggaaacattgtttcaaacaaaatccagatttttatctctctccccaagagatatggctttaatcttttttcttttcttctgctgcttttctgaaacactctgctaggggctgatttcctcttctttgaaacagaccaaaatatccctgtgggtgaaaaacatgccggaagtgaaacagaaagactcagcttgccccgtgttcgtggtctgtcaacttctctagccagtgcctggatccacagctcactgctgccggttgccctgcgttagccgcattgcgggggagacaggag

SEQ ID NO: 2550 - DNA, 3217 bp, Homo sapiens
cccacattataattattgcaatcagaaaactaatactgattcaatgctaacatctaaagtacaaacttgtatttcaccagttgtcccaatgaaaaggttttgggaggggatgttcagggaccaatcaaattacatgttgcagttagttgtctctttagtctcttttagtctggaacagtttctctttgtgatttttcattttgacatttttagaaagggtatataggtcaactgtctttcagactgtctctcaatttgagtttgcctgatgcttcctcatgattgcaccgaagttacaccctttgggcaggaatgacactgaagtgatgctatgttctcagtgcatcataccaggatgcacctcatgctaatttgtccagctattggtgatgttaacagattgctctaatgtaaggctacaatttttcaatgtactaaagttaaaatttgatttagattctaatttcctcagaattgggttcaaatcaagtccattgcttaagaagctttgggtattctgaaaaagctaacttcctgatctgtaagtatcaggatcagtcatggaaagtggtgcctggcacatacatttatattttatgtgccacataggtggcattgaacaaatgtcatctattagtattattaggtcaaatatgttgagaacctcatgtaagtattgcttaatgtcttgggacattaagcagacacaggaacttggtactctaactccagggaacaaaccagaaaatggcagaattattgtacaagaccaggtctgggttggcaccaagcatgacttgaagaaggcaccaaggatggggctagaaagctagttaaacttttagcctcaaatctggctgggtctgagagactgaggaagagaatcagaagatttcagctggcggagaagcagggcacagtgtgtggactgagcttgatggcatgatcagctgatgctgctaaagacctgagactcttaatcagcaactgtgcaatcagcaatagcagttgtacccaccttatctgctatggaggcattattattggcttttttggggggcatttaatgaaaatttcttgctttcaaggttattcttcaactatacatcacttgggcagtgctgagaaacacataggatgatttggcctgggctccatatccttcccaggaatatcttaagactgagaaatatggtctcttttccatacctccaagttgcttttacatggatgaagagaatcagaatgctcagtgaaatatgtattcaaaaagaaatgtaccagaataaaattacattagaaaataattgcttctaaaaatcatcacccattcttaccctctgttattctgttctctttcaactgtctgtattttaatccctttcttcttccctgatgttttctattcatttaatttaagcaatgtttctggataccatagcaatagcaatgaggtgttgtataaacgtacaatggagcagaatggaaatgcttcctatggtaacagaaaccatagaaacatgtgcgtgtgtgtgtgtgcatgtgcgtgcacacacacgtgcatacaaagctgttttggggtcaaagctttgtagagttcatgcaactaggaaaatgaagtgtttcactgtgatcacattgctatttgtatctattgtcatcatgatttaacatttattgcatgcctatagtcccctggacagaccctggaactagatgtcaactctacttagtggatttatgtttgaaattagatagcaaagccacaaaatggaaaaagatgagaatacttccaaaacagaaatattgaataatgcattttcagaaaaattaggtaaggagaaaatgagtttgacccaggcagttaggaatgaaggatatgggaggagacttaaatgtctagattagagatggtttgcagccatttccaagaaccctgggagggactgcttgtgctgcatgatctaacactttaatcctcttctgccatggctcagaccccatggggtggaatcttgatgaggagactccctgtcttggataataataacaagctgtcttctctgtaggcaaattttcaggtggaagtctcactctaccactctcataaccaatgcaacaaataatcaagttctcaagctgcaaggaaaactgaggggattatttttaaggatgtaaagaacattaaacaatgaagagatagtttctcagaggaaaagaaaccaagtctccttgaatcagtttatcccaatgtcttctggttttctatgttggctacagtcaagataacctattactaagggcctactccaatatctagagatggcagatattcagttgcagttcaaaccaatgaagtcagaatctctggaggtgggacaaaggtatttgtagtttttaggcttctcagatgattccaatgtgcagtgaagattgaatgctattgcttagaggaaaattcagtcacctgatatttgaagtttagctcttaggtggcactagaagaggaccacaagcctgccagagggaggagagtattgcttcttcctgttcccattagtgtcacctcagcagtgacttttcaccctggagtggcagctttcaagtgcagacaactttttcttgttgtctagagccattgcttccagagcttatgaggagctataaaagaggtcaggacacctgggtctagtctcagctctaccacgaactagcaatgtggccaagcaccaagcctttctggtcttagctttctcatttataaaatgaagaagccaaagttaactggatttctagcccctgccaactctcatatctctaacagtaagttgagagatttttctctctctgacattgtcccctttctttccacctctcacaatgtgcgcaacttgagataagttacttcacctctgtgtggctcagctttcccatgtatacaatgggagatacctactttttagtgttgtgattaggattaaatgagttaatgcatgtgaagtgttggaacagtgtctgatgtggaatactcactaatgttaactttttattttactactttgctgaaaatgttagtgtatttccagttgttaaaattacaaaccaacccctcacatggtgcctgactcaggaactttaccgactatgggttttcaatctattttatatcattcctctttattttttaatttttagtttttgatgcagtgtctcccac

SEQ ID NO: 2551 - DNA, 1957 bp, Homo sapiens
gggattacaggcgtgaggcgccacacccagccaattttttaatattttatagagacagggtcttgccatgttgcccaggctggtatcaaactcctgagctcaagcaatcctcccatttccacctcccaaagtgctggggttacaggcatcacccaccgtgtccggccacagcaagcatttatttcttacagttctgggggctggaagcctgagaccagggtgccagtgcaagcagcttccggtgaggccttcttcaaggttgcaggcgaccaccctcgtgccatggccacacatggtgaaagggagctgagagctctctgggatcgtttttataagacactaatcctattcctgagcactcctccctcatgtcctaatcaccttccaaaggcctcacgtcttaataccatcacattggggaacagaatttcaatataggaatctggggaggaataaaatacttagttttgtcaggtatcttcagaggctatttaggtacagtattgtgctcagggtcagtgtgtacaaaaccaactcatttttcttctctcacaccacaacgataatcaacacagaaaactttgtgacttggccgggtgcggtggcccacacttgtaatcccaggactttaggaggccgaggcggatagatcactttgaggccaggagtttgaaaccagcctggccagcatggcgtaaccctgtctctactaaaaatacaaaaattagctgggtgtggtggcgcatgcctgtaatcccagctactcaggaggctgaggcaggagaatcgcttgaacctgggaggctgtgaacctgtgatgagctgagatcacgccaccacactccagcctaggtgacagagcgagactctgtctcagaaaaaaataagctttgtgactaaatgtgtggggagaagcaagctgtagtggacatcagccggatgtcctgcagttcagttctgacaccatctacctggagatggcatcagattccacaggttgtgagcaagactgtcccactctgccccactagccacaagaccaggcctctgggacatcttgccaaccctctacaggttggggttcttatactctttggcttctattagtgtatttgattgactcagaattcagggaaacacatataccagtttattacaaaggatattttaaaggatactaatgaacagccagatgaagagatatgtaggactagggttggaagagtcccaagcacaggagcttctgttcccgtggaattggggtgcgccaccttttcagagttcttttgtaccttcctagcagccacctcctgttcagctgtccagaagctctcctcaccctgtcttcttaggccttttatggagacttcattggataggtgtgactgaagcatgcacgaatgtgttgaaacgtgattggacaaataagagttgatttaatgctaattgattgagtggggaaactcaaggcccgtctgttcagattcttcttggcctctcagtgcagcattccttcctacaggtacagggcaggaccctctctggagtgagagtcctgctttgggcaggtgaaaggagggcaagagaagatgagagagagattctgcttcccgaggcctgcttctgaggctgaaagtgccctaatattaagattttaccaagggttatggaattatgagccaggaaccatggacaagaacatacagacacactcataccccatatatacacacatataggcacctacatatatacacaccatacacacatatacacacacataccatatacacaccatacacacatatacacacacataccccatatatacacacatatacatacctacatatagagacacatatatacacaccatacatatacaaacacaccccgtatacacacatatacacacctacatatagagacacatatatacacaccatacatacacaca

SEQ ID NO: 2552 - DNA, 9996 bp, Homo sapiens
tggaaggaaatgctaactttctcttaaagactagttaaaaataagattagcttttgtcctgttcaagttcatggactacgtgggaaggagttcatggaccactggttatgaacctctggtagaaaatgggccgacttttacctccatgttcttccctgttttatgagactgtgtcctctttgcatcatcctgtgtccctgtgcacacaccctcagaggacctgtgtggccagagccttctaaatggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtgagattaccttcatagatctgaaaatctgatgttatccaggtttctgaagaacttctcgccaaggccatttgtgcttgtgtccaattctctgacctagattgtgactcaatctagtgtgtttcttaccaagtacataggcagagcagggttactgtgattgaaagaatccattttttttttggagacgtagtcttgctctgtcgcccaggctggagtgcagtggcacaatcttggctcactgcaacctccacctcctgggttcaagcgattctcctgcctcagcctcctgagtagctgggattacaggtgtgtgccaccatgcccggctaattttttatgtttttagtagagacgggattttaccgtgttagccaggatggtctcgatctcctaacctcatgatcctcctgcctcagcctaccaaagtgctgggattacaggcatgagccaccatgcccggccaagaatccatatttctttaccagactaggaattctattctagtgcaaatgccttaaaaagcttatcactaaatcattacgaatgtgtgccatccgtggaattgcttttttttttttttttttgtaaatatgaggtctcactatgttgcccaggctggtctcgaaatcctgggcaatcctcctgcctcaccctctcaagtactggaattacaggcgtgagccaccatacccagcccaaatttcactctttaatgttttcctgttgctattctttaaggaaaaaactttcctattcagacagtgtgaaaatcagtcatcaagtcagaataaaatgatgaatattctaatgctcagtatcttagttctctcgggcctaaccaatgcctcctaaaacaatagatactatcctgccccaccctaccacccaacacacactgtatagtaaactgcatcaaaacttattcctgctaagttcatactttctccagctcaatggattcacaccaaatttttttttttttttttagacggagtcttctctgtcacccaggctggagtgcagtggcgcgatctcggctcactgcaagctccgcctcccaggttcctgccattctcctgcctcagcctcccgagtagctgggactataggcgtccgcctccacgccgggctattttttttttttattttatactttaagttctagggtacatgtgcacaacgtgcaggtttgttacatatgtatacatgtgccatgttggtgtgctgcacccattaactcgtcatttacattgggtgtatctcctaatgctttccctccccccaccccacaacaggccccagtgtgtgatgttccccttcctgtgtccaagtgttctccttattcaattcccacctatgagtgagaatatgccgtgtttgattttttgttcttggcgatagtttgctgagaatgatgagacgaggtttcactgtgttagccaggatgctctcgatctcctgacctcgtgatccacctgtctcggcctcccaaaatgctgggattacaggcgtgagccaccgcgcccggcccaagtatcacttatggtttcagaacgccattattagtgtctgactgtcttggtcttcttatacattgattcccaaatcacgtgtggtaacagcatctcaatttttcatgatgacggtttgaaccattaatttaattcctcaggctatctacttttttgttaaacatactgtgtagaccatcttttttttttcccatcatgatagtcaaaattttagtctgtgtattcaagtgagaaaatttttagtcagcattatacaagtagtatttattatgtatacattcagtggagttgtttctacaaaagtatttcggaatgactattctgctgcaaacttttgtgtaagcgcttcaccttattcctacaataaggagaagtgcactaacaaaatgaacaatgcagcaagggcttcagtcgcagctcaggtcttatcaaacaccagagaaccctcaatgggagaagccttatgagtgtgacaactgtggaaagacagttccttttttgttagtatcacttctacttattgtagaaatatgctttcattattgcatctactcacatttctcactcggtttctggcaccagcaatctcttccatatttataatatcagtcaaaaactctggaattcaaatataacaagacttttctggtcacctttgatagttaatgacttgggcattgtgatatattatctcctgctgtatgtattttgtttagtagaaattgaatcattatccacaatcctttatagaactatccaagtccctgtttttatgctagtttccaaggcttggtccttcaaggttttcagggatctaggggacacaaatctaacaaatcctaatgtatattatttgtattatagtaataaaccatatggttactttgtttgagtggattcttaaattgagaaaaatgcattgcatgatttccaaactttctgaacatatattaggattctccagagaaatagaaccaataggatctgtgtctaaatatgtatgtatatgtctgtatgtgtatacatatatatttgtatttataatactggtttatgtatattatacataatatatatgtgtttgtatatatatatttatttattggaaagaattggttcatatgattatggaggctgagaagtcctaggttctcctatctgcaaactagagacctagcggagccagtggtgtgagctccagtccaaaggccagcaggttcaagacccaggaagagccagtgttctagttggagtctgaaggccagaaaagactgatgtcccacctcaagatgggcaggaggagtaccctttgagggagcgttatcttttttgttttcttcctgccttcaactaatcagatggggcccacccacattagggagggtaatctgccttacctagtctactgatgcaatgattcatcacatccaaaaatcaaacactcagaataatgtttgactaaatatctgggcaccttgtggcctggtcaagttgacatataaaactggccatcacaatactatagtttcaacattaaaactacagtatagtattacagtttcggtaaagcattaaaacctttaacccgtgcttcccccttttgtcagttcttccaattggcagtaggagcctgggaaataatgtttgtagcctccctaccctgcttacagatcaggatagggaacggctggtatgaggcaggctgagggacaagagataaacaactagatcaccattgtatcctcagcatctagcagagttcctgataaatgaatgattctgaaaattgactggttctatttgttcttttgtattattaacataacataaaatctcctgacactgagtgccagagaccaaagtattcatattcatatttccagacataaaagtcttcccttatttctaaagaaattatgtgtttatagccattcattcagcaaacctgattgtgttatgtcaggtgctaaggaatcaaagatgaacaagacattatctctgcccccaaagaacctaagacctaaaccatcttctgtcttacaaggtattttatccatttctgttctcactttggtgccgacttaatagttcttccttcagaggaatgactgcaccatggctgcctggcaacttgcatctcttcatatgagccacatagaccaggatttaacaccagctgatgtaagccctataactcacctagaacatgagtgcatggtaggttgtgtgagaagctgatacaatgccatttctcacacacctccctatctaccatggaggctgtcctgagacagtttcctctgatgaggaatgaggctttctacctctccccatttaaggtataactgtaagctataaactgcttatctgcagaacaacatcagctcctcagcaacgaaatgtttcaccatatgtgttgcagtcacatggcttcttctgatgccatcttgtgagaaaaagacatagagagctgaactgttttaatccagaaagggcttatttcttttctgatcaaatacagtcatgcactgcataatgacacttcgctcaatgataatttggtcaataacagaccacatctacaaaagtggccccataagtttataatgacaggctacgtatggtggttcacgtttgtaatcccagcactttgggaggccaaggtgggaggatttctggaggccatgagtttgagaccagcctgggaaacagcgagactccatctctaacaaaaataaaagttagctgggtgtggtggcatgcacctgtagtcctagctacttaggaggctgaggtgggagaattacttgagcccaggaattcgaggttacagtgagctatgattgtgccagtgcactccagcctgggtggcaaagcaaaacactgtcacacaaaaaagattataatatttttactgtaccttttctatgtttagatacacaaataccattgggttacaattcagtatggtaacatgctctatgggtttgtaacctaggagtaacagcctaagtttgtgtaagtacactctacgatgttcacacaatgacaaaattgtctaatgatgcatttctcaaaacataacctctttcattaagtgacacatgactatatgctagcctttccttgacaaattggtgccaaacatggggctggtgacattacaatgccctttcagaagaaagatagatgtgctcccacaggactggataggacacatgatgagacttcccaggatctagtagcacatgttcttgcctaagtggtgggcaagaaggaaggagtaagagtcttcccattgtattaatagctatactgcattggctagattataggatgtgaatagactctccaggatccaatatcatatgccacttcctgatgaatgtttagaggttaagttactttaggtaggattgaacccagttgcccaatgccttagttgttattaaaagtttgttgcaggccaggcatggtagctcatgcctgtaatcccaacactttggaaggcccagacagcagtatggcttgagctaaggagtttgagaccagcctgggcaacataacgagaccttgtctctacagaaaatttcaagaattaaaaaaattagctgggcatagtggcacatgcctgtggtctcagctactcaggaggaggctgaggtaggaggatcccttgagcccaggaagtctaggctgcagtgagccgagctgtgatggtgacactacattccagcctaggcgatagagcgagaccctgtctcaaaaaaaaaaaaagtttgttatgactgagtggatgatttgcacttaaaaatgaaagtgcaagtctgtgcttaccagtgtggaacaggtctttttgtgctcccttgatttctctctggcctatatcgcaacctcagttttttaaggaaagaagattctctggtgctccagctaactctgcatgatggactcctccacattacttggcactccgcgagctcccggccaacagactacgtgctctcctgatagttgctattgtaaccttttaaatgtctgcacaaaacttctttatctgctttttttttttcttttaagtgtctacattcagctgataagagtttggggaaaacttgcaatgaaaagaaaaaagttaagcaaccttgtgagtgagggtgcctggaagatgctattcactggggcataaatggtccagtgaatgacacaagtagctgcccattgttggacactctacagcaaaatgtgtgttcgtgatttttgcccatacctagttaaattgtttgctgtttaactgttgagatttggtgaattctttttatattctagttataagtcctctgtcaaagacttggcttgcaaatatttttccctatctgtagcttgtcttttcatctttttttttttttttttttttttttttttttgagacacagtctcgctttgtcaccaggctggagtgcagcggcacgatctcggctcactgcaacctccgcctcccgggttcaagcgattctcctgcgtcagcctcccaagtagctgggactacaggcgcatgccaccatgcccagctaatttttgtatttttagtagagaaggggtttcaccatgttggccaggctggtcttgatctcctgacctcgtgatccaccggcctcagccttccaaagtgttgggattacaggcatgagccactgcgcccggctgtcttttcatctttttaacagggtctttcagagcataaattttacattttgataaatacaaagtcataaacatttcatttaatgaattatgcttttgatgtcagttttaagaatctttgcctagccctaggctctgatgcttctaagaggtctcaagttttaggtattattttagcccatgacccattttgagtttgttgttgttgttgtttggtttacggatgttcggtgctctattgccattgtctgaaaaagctatccttcctccactcagtggcttctgcacctttgtcaagaattaggcgtttttgtttggatctatttctaggttctccagtctgttccattcaactatatgtctgtccttctataatatccaactctcttgatcactgtaggtttatagtataccttgacatcgggtacagtgattcctctcactttattctttttcaaaatttagttattagtcctttgcctttccatgcacattttagaataaatttatatctacaaaaatttttgctgagattttgataggatttgtgtcaaacctaaacataggaagaatcgatatctttaccatgttgtatcttctaatccacaaacatgatatgtctctccatttattcagatttctttcttcagcattttatcagcatacagatcctgtacgtttgttagacttctacattatttttggagtgattacaaatggctttgcattttaaatgtcaatgtccaaatgttcattattagtacataacaacaggattgttatttgcatgttgatttgtatcttgcaaccttgctgaattcatttactggttctagctacattttgtattagcttcaaaaattgtaatagattatttggaatattctatgcacacaattatataatctgcaaataggagcaggtttttttgtttccaatttgtattttgttttcttttgtgcgtgtacatgaaatctacaagcaatctgtatgcttttaatcattttttgcctgttgctttggcttgtattttcagtgctgtgttgaataagagtggtgagagtggacattcttgtcttcatcccaatgttatggttaaagcatagtcttttgctgttaagtatgaagttatctgtaaatgttttgcagatgttctttatgaagtgggaagtttttatttctagtgggctgtaagtttctgtcatgaatgggtgttggatttgtcaaatgctttttctgtgccaattgtatggttatacaatatttctgttatatatatatgttgatgtgatgaaatacactgattaagttttaaatattaaaacaaacttttgtactggaaaaaaaaatcccccttagtcatggtgtatacttctttttataaatacctagattcaatttgctaatattttgttgagaacttttgcatctaagttcatgaaggatactagactgtagttttcttttttgtgctgccgttgtctccttatggtatcagagtaattctaaccttataaaatgagttggagcgtatactttccattttctggaacaggttttgtaaaattggtgctaattcttcttcacatgtttggtagaattctccagtgaaggcatctgggcctgatgatttggaaacttttagattatgaattcaatttctttaatgattataagactactcaaactatctgtttcatcttggccacctggactttttgaagaattggttcatttcttctaagttgtcaaagttatgagtgcaaattttcaaatctacctttatgatccttcaaacgaatgcaggatctgtaataatatcccttttctcattcttgttattagtgatttggcctttctttttatctttgccagtcttgctagaggtttacctgttttattgatttaaaattgttttatgtatttgacacaatgtaattttacatatctatggag

SEQ ID NO: 2553 - DNA, 4778 bp, Homo sapiens
ggcaatcagcttcagagagcccgaggtcttggctgtcatgcgaataatgattttgatacgacgtacatgtgttgcagatcctgatgcccccaaactattttctgcaaatatctgggtgaattagatctgtctacggcagggaatatggcagaagaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaattgcatgcgaacttctttaatttgtcgtttttggtttggttgcccc

SEQ ID NO: 2554 - DNA, 6555 bp, Homo sapiens
ccaggctggagtgcaatggcgcaatctcggctcactgcaacctctgcctcccaggttcaattgattctcctgcctcagctgggattacagtcacctgccaccacacccagctaagttttgtatttttagtagagacggggtttcaccacattggccaggctggtcttgaactcctgacctcaggtgatccgcctgccttggccccccaaactgttagaattataggcatgaaccaccacactggccaggatttgcattttaattgaggggagtgtgcagtttaactcaaacaagagaattgtcaaaggaaaaaacagggatcaagataatgcagcaaatgttacaggtttacgtcatgaagaaaaatgacttcaaaaatctgtattagaaatgttctcagggcatgcttggagtggtggaaggaggtctttaattagccaggcttgtctaggacttgaaccatagacgaagaactaaaaatttgtgttttttcatgtccttgaatcttattgtaattttcaattagatatttcaagtcaacaaatatttgctgaacatcttttctctgccaggtttgtattaggtgttgaaaataaatgaacaaataatataaaatctctcctctaaaagatctagcaggcagatagggatggcaaaatattataataaaatgaaacaaaattatgcatttaaggtgttagaggaatgaaaagataaatgagggatgcagtggggtcctgggaagggacctgtcctgggaggttttctcagttgctacctcgcccatctgctttgccaggcagtttttgacagttgtatcctccacctctagcttttccattatcaggatcattatagattgtgctctgccagtaatccagatataaggaagtgtctgggcaatccctatgaacgggatcagggcttggttgagctttcatctcaggactgatgtcagggagattctgactcaggtaagacagacgtgatcaccgaggagcagaaagtgtacatgtagagtgatgctctcatctctgcccaggaatgcttctggaagaagttggacatggtggtagtgaggcccttcaccatggtttcctcatcctattgtttatataacccaagtttcttgcatttactgcaccggtccccaacctttttggcaccagggaccagttttatggaagacagtttttccatggattgagggtttggggatggttttgggatgaaactgttccacctcagatcatcaagcattagattcttataagggacacacaacctagatcctttgcctgtgcagtcacaatagggtttgcactcctatgagaatctaatgctgctgctgatctggtaggaggcagagcttaggcagtcatacacgctcacctgctgttcacttcttgctgtttggcccaattcctaacaggtaccagtttatggtctgggggttaggggcccctgatttaccacacttaaagtgtaactgtgagtccaaacccctgatcctcaaagcaactaacatagttcactttgtgacctcatggatctttattactagagcctgtggtgaaattttagacatcagcaacaggatatatgactttagtggaaaatattttctgaaggggcagaatgtgttcttgctatccttaccttcaaacccagaatttatattgcagctggcaactagcattgcccataaacaggattagctctggtaaacataagtaataaaatgccattttgttttccaaacctaaactttgacctgcaccatgcagaggatatttaagaaatattttttaaatgtttactgaaagcatagattacaaattggagagaaccaataggtattattgccttgtttgccagattcaggtttaggccaatcatttttacctcctatgattagctaatgtttactctaaccctgtaattccacattagaatgattagtaattttaagccaaagaggaaaataaatgaatttggtttagcacctggaagccttgaaatgcttaagaggaggtgtgtttcaaattagaataaaaaattcatatttagatcgagtacatattgttaagagaacccagaggaaaaacagtggactcaaaatgtgtctttttttgggcaataaataggatttttatactgaaaaggaaagggtatgtatgtcttagaggagtagtgcatgtcatgtagtaggtactcaataaatatttcttggccaggcatggtggctcacgcctgtaatcccagcactttgggaggctaaggcaggaggaggccttaaacctaagaattcaagacaagcctggacaccatggtaagaacccatctctacaaaaaaaataaaaaaaaattagctgggtatgctgccacatgcctgtattaccagatgctctggaggctgaggtggaagaattgcttgagctcaggagttagaggctgtagtgagttgtgatcgcaccatggctctccagcctaggcaacagagaaagactctgtcccccaccaccccctcccccacaaaaaaaaaaagaaaaagaaagagaaaaaatttcttgaataaatacgttagttgaacaaccataaatagatttacaggatcagttaatgtccaccaagttgggagaccccagtggcaggagttcctagtccttagtatatgatttgagtgaagataaaaatgacacacctaacaaaatgtttcatgaaataatctaaaatttcttgtcttcattgcttacaatgacaaacccaatctaatcagataaaacttgataaagataatgcctaaagccctgtttttgggtataaaaaggtataaataagcataaatataggatggaattattagtaaatgttttgaaaaaagatgaaaggattaggaatttaggtgatagcctactcagtgtgatccaacagtatgaagtaattccaacctcctttcttgcatatttttaaactctccacaaaaactaaggagatgatcccaattattatcttcattacattaattgagtttatcatcaatatcatggaggtgatgatttgatgattatattttactatgtgctaaaaacacatctattaaacgctttttataattttaaggaatattatcagaggagagcaatgagggtagtggaattcttcacttgagtatcagggagttggtgaaggaagcaatataattatgcagaagagagctcttggcatgagccatgatttcaagaggggggaaataggaccaatgagataagttagcaggaagcatattttggctcaatgtaggggagaattttgtactaattctaacacttagacctgaatgttctgccttgggaggcaagcaagtgttcatttggctactaaacagaacagagattcatgtgtcagatgagggagttgaaccaaatgaccttctatatcacttcttatggtaagattctttgacattttgtgtgcaataacaagatatgtctctgtacaggctttcccagctatattctttagggaagttgaggataggagaacaagcactgtaaatgattacacatcctgaaatgagaagcaagggcatttgtagatatgtgcatagttgttgggataaagtgcctgtgtccaaattccagccaggactgacatgcactatctggtgaccttcgattagttatttaacatttctgtacctcagtttccatatataaaatggggatagtatagtatctacctaatagctttgttgtgacaattgagtgagttaattcactcaagcttttagaatggtacctggctcatagtgattgttagatattgttattatgattgcaactataactacaattaactattcataaaaccatcatagagtgagatggtatattttattctgcattacatgtaggcttaggtattctttggaagaaaatattatagagaaagcacgtatattggacacaggcaggctctttatgggctgcgtggtcttggacaagtcatttgacctctgcttttcttaataactgtctagttataggacttctgtaaaattaaatgagtaatagtaataaatgtcaacgtagtaataaatgtcagctcccatggaaagatagtatttcaatttccgtcctttttcaaatatcttgttgtctagagaccacagcagtgcagggttaatgtagcaacttagggcttgaagtgacctgagacatcttctagcaattgccgctcatgtaggagatgggagtgtaggttccttaagagttaagagacttgcagaaagcgacgtagcttcttcctatgagggagaagagctatatggaggagagaaagtggaagataagtaaacattcagagtacttttttgggaaaaagtgtgcagcttcggagctcttgtgcacgttttgctgagtgcgtgtttctgaatgattgtgtgtgtgtctgtatgtgagtacatatgtatatatgtatatattcatgtgtatgaatcagagtgtgtaagtgagcatgtatttgtgggtgactgattatcttgctagtgtgactttctatgacacttgctggcatgcaggccttgggttgctaattccttttcattatctaactcagtataccaagaaaagaaagaaaacagtgaaaaagagaatgcattctgctgttagctggatgctgactttcttcttctgggtctggcactttgattcctcatgacttcaactttttcctaaggaaaataaatgtgctagcctcttaccttcaccaccccactttaatgaagcttccttcaattacatctataaaacccaaggtttaattttatttgatgacactgtcttctgcagacactttgttttgcttttgaagacactaagatagcctggagctctgtgccaatttcctcactggtactggccactggggaagctgcctgagacaagggcatctgaagtgacaggagccttgaactcagttcatcagctggagacccagagcagtatcaaaactgagtttttgattatgcatatttatcctgatttctacagcttcctcatgctcacccatctccctcagatattctacaacactgaactgtattattctgagttgtacttaacacttaggaaattttaacatttgcttcattaacataactgttagaaggtgcagggggtgatgaggtttaaaaaatgagtttaagatcaagagtgtgtactttttgtttttctttatggagttacattgctgatattatttatgttcaaattattgactactttgctgcttgtataaaaaatggctgctaatttttatgtattttgatctctgtttttacggatgatgcaagaaaatgatcaagagctcaattacacttattggcataatatttgttaattgtgacactgtagaaaagaaacattcctttgaggatcaagcagagccatctcctgtcctcatgtatagaatagtactcccattagggaatgctgccaatgaaaaatttatatataactttgtgtaaaggaagtttttaagctctgaaatggagtggcatatagttgcctgtaatctctaggctgatattttactgtggcatttcttcgcttctcattctaataaaatattaacatggtaagctaattgtttctgtcagaaacaagttgttcagcataataacccttttcttcatttgataacgtatcatttaacttggtagaactgtctgaaaattatgtcatattctttcccattttcatctctactcttgctttctggttgcccattctagcaatacaagaccaagtcaagctacaaggcttttgcagcactagatgaaccagccaagactgaaagtgtctccaaggacaacacattagaaccaccagtggaggtaataacttcagattacccctgcttttggtatgcaattccaaaacttattgctaacccagtacctggtttcaattcttccagctctattttcctgcacagctcaggcagcaaactgaagagctctgtgctaccattgataaggtcttacaggattccttgtctatggtaatgctttagactagaatgtgcaattcaaacatttgctttgcttctcttcattttcctctactttagtatgatgcctcacaggcttgtccttttctttccttttctcttcttctttccttcctttctttttttttcagcattcttctgattctccttcaaggtccccaaagacattgttgggttctgacacagtcaaagtatgtatgtatttaatataatttatggaaccataagatttattagatcaatgatttccaaactgcaagtcaaggtccaatagtgaattgagaaataaatttagtgaatagcaatcagtcttttttgtagaattttaaagatagtaaatattagacttgatttcaagtaatgtataggttttgttgacatttgtttacatgtgcacatataatgcaaggtaagtgtatacagggttgcaaagtaaaatctatttctgtgggtccagttcaaaacagtttgaaagccaac

SEQ ID NO: 2555 - DNA, 2962 bp, Homo sapiens
aatgatctttgataatacaattgattttaaaatcaaatcttgtcctgtttttaaaaatcagattccctaaaattttgcactataattgtgcacagcttctttacctgaaattatttacatgtgccaatgttcttattttcaaagattcttctcctttgaagcttctttattcaacttatttatctcctcaatctttgtcagtaggattctatcctactaatctttattcagttaagatcatactggcgggtcatctctacatggcttcttcttataaagggaacatggatgaaaaatggagttgtgtcacctactcattaataacttgagttcagaaattacactcctgtgtagcataatgaaggaaacaaatatttatcttagtagtaatttacaatggtccagcttccaggattgctactggcatttccttcttactatttgaacaattacagatttattgatgacttttaaattcttactaaatgaattaaactccaggacacaattttaaggtgtctcttataaaagatacataacagcattttggaattaagaataaatcagctaaaattcaattcaacaaatagttattgagcagctattctgctgggtactttctgaggtgttgggagtaaataggaaaacaattttgagaaaatctcttcttttatagagcttaactataaaggatgtttccaaaatttcagtttggcttttctaaagaaatattgatttagatattttattaacgcatttttggttcttaaattccttaggcgtcctttcttttgaagttaccgcaccttaaaaacctggctttatgttttgtgctcaatatcccttggccttatatatcaaatattatggcatgaaatacttatggtttcaaaaaactttacttttattttcattattttggattgttctaggctggtttcgttttggtaatcatgtacattgacaatttctgaacaagcaaaaaaaaatgctctcaaagataagcaagcaacagttgcattccactattgaaggctattacagtatgagttaaatgtactgaacttatttttcttactcctctgtgaaacagtcttaattaactaatgtagtaagcagctttctaaccttcaaaatgattttctgtggtagcaaaatcattttgcaagtcaaatgcaacactagtttatcttttgcatttgaaggactgtttaactattaactggttaattgtgtatcattcccatacagaaggtaagtactcaaattattttcctcataaaacctgacattcagcatcttaaaggtaggtatacatttggtactttcttatgttcactcctatacccactagatcaaaaatataaggtactgagtgattttaaaacttaaatgaaaaattttaataaggaaaaagtaatagacaatatcagtatgataaagtgggatctacaccagttatcagagaaacacaaatgtgtacatactgcatgatctgcaaagtgtagccacatataatattttgcataatcatactttataactacgaataaacagatggatttatccatctgtttaaaagctaaagcagatgaaagtaattttagtagcacacaaacagactaaatcatttgttctcataactcttgtctaatttgaagacaatgggaaatatttaaaagtgatttcatagagcctgaaaccactttgacatttgagttgagtcacaccgaatgttgaaataaatgtcctattccggtaaatttaaaggactgttttaacatgataatttgtctcctaaaataatgtcccaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtact

SEQ ID NO: 2556 - DNA, 3660 bp, Homo sapiens
cggcggactacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacgtaggtatttatcttgattctagctggtaagtttgttatgagttctgtgtttgtctcctgtgcttttctgtttgtccaaaaacaagttagtttttttatcttactgatacaataactgaacacatacagcacatagtctttttttattattatttaggttttttttttgagatggagtcacactctgtcgcccaggctgtagtgcagtggcgccatctcagctcactgcaacctctgcctcccaggttcaagcgattctcctgactcagcctcctgagtagctgggactacaggtgcacgccaccacacccagctaatttttttttttttttttttagagagtctcgctctgttgcccaggctggagcacagtggtgtgaccctggctcactgcaacctttgtctcccgagttcaagcgattctcctgcctcagcctcctgagtagctaggattacaggcacatgctaccaaacctggctaatttttgtatttttagtagagatggggtttcaccatgttgatcagactagtctcaaactcttgaccttgtgaaatttttgtatttttagtagagacggggtttcaccatattgatcaggttggtcccaaactcctgacctcaggtgatccacctgacttggcctcccaaagtgctaggattacaggcgtgagccgccgtgcccagccagaacacatatagtctcttaagaagaaaaaaattaactactgattattattaagaagttactgtcctaaatttttagaaacgcatactcacgtatttagggatgaactgtcatgaaatctgtaaaccactttaaaatatttaattaagcaaaaaacaatgaagcaagccagatacagtggcttatgcctataatcccagcagtttggaaagccgaggcgggataattgcttgagcccaggagttcgagaccagcctgagcaagatggcaagaccctgtctctacaaagagtaagaaaattagccaggcctggtggcacatgactgtagtccccactacttgggaggctgaggtgtgaaaacagcttgaatccaggaattcaaggtggcagtgagctttgatcctgccactgctctccagcctgggtaacaaaacaagaccccatctctaaaaatattaaattgggccgggtgctgtggctcacacctataatccagcactttgggaggcacaggtgggtggatcacctaaggtcaggagttcgagactagcctggccaacatggtgaaaccctgtctctactaaaaatacaaaaattagccgggcctagtggcgcattcctgtaatcccagctactcaagaggctaaggcaggaaaatcgcttgaacccaggaggcagaggttgcagtgagccgagatcatgccattgcactccaacctgggtgacaagagcgaaactctgtctcaaaaaaataaaaaatacaaaataaatttaaaaagttagaaaattaaggaaatatggcaaaaatgttagcagttaataaatctcaatggtagagatagagggagttacatattatttacttttcagtgtttgaaaattttcttaataaaaatttgtataggtttaagaaagaaaaagtgaatagctgattatcatttttcttcacttaagaactttaaacacagaatttaaatttttcatattttttgaaaattaacatatatttattacagtgccaaatctcatgagtccctgtctcataatctaagaccaggctactctgaaagaggacagagttcactgcctaatccaacactggctgtagtgtaaatgcaacacaggtgatttttgccccagttccaaggctacctaactagctatgtgggccttagtcacccttaaaggaagatggttgcaactatgccagttagaacatttttctgctctgcttccacagtggcactcacaagaggaggacttgattttatagcttgtgtacaggagaatataaagttggcttcaaaggaggtaggataggtttggcatttttctcctcataatgtttcctgaagcatgaaaggatccttgatcagaagagtgctcagttctaatttctaaaatttgctggcttaatatttttaaagattcaattctccatatgagtaagttagcgtgtatcatcaaaaactatctagaactgtgtgcagagactgttactggttttccaagttgtatatttttgagtatcttaaaatatttcatcaactttctaaaacatcaagaaaagctctctatacaaataccatggttgattttaattattttgttttccatccttttaaaaatattttctgctttgcatcccattattattttgagtttcttttcatttgtagtttgttgttcattgtgttgttttacagctaagattcatttcatacgtttgatgcttagctgaaaaattacaataaattctccaatgaaattatgtatctttatttaatgaaaatgcctgctgcgtaccaaggtatgtactagggcatctggggtaagtaaaaacaaacacatagagcctgcctggagaagctcatggtctgatggaaagataagcaagaagagttaatttctaatcaatatgataaaaaggtcagagagcagtttctgaaaaacatgtttttgagttgagtcctgaaagacaaggagatgttagtaaagcagagaagggagaattcattctagaaagatcagacagtgtgtgggaagggcagagtctgaaaagagcatgccccatttggagaagcatcaagaagcccacgtgttagaagcaccggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggtaagttttgtttggaaaataatatgctgttgccccaaatgccttaatgtttattaggtttatgtaaaattgtacatttgtacccaaattgcc

SEQ ID NO: 2557 - DNA, 833 bp, Homo sapiens
gctggcctgctgggcagagaaagggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggagg

SEQ ID NO: 2558 - DNA, 499 bp, Homo sapiens
gatagaccgaggttaatagtcacatcatttgaaactgagccatacagttgaatgtaatttgccgtaaagatgaatgttttgtagagttcctctttattttcttaagggaatgtgcttttcaacataatgtgtataatccctgcctccacacacacaccagaatgggattatgatttccctgatgggattactaaattttgttcttactttttgaatgagcttaattttagttttcaaacaaactggtttataccttttgccagtatgctaggccatcaaaagatggtacaatcatcttcaaaacctgagtttaatagaagaaagtatgagaaggcatccagtaggtgtttagatctgattagactttgagtggtccctttctaacaataagaggatattaattcctttggaattcatgttcttcattcctctgcagattgtcaagagctatttgaatcctaactatattccaggcactatgttaggtgctacagtggat

SEQ ID NO: 2559 - DNA, 13785 bp, Homo sapiens
catgggcatgggaccctccgagccaggcatgggatataatctcctggtgtgccatttgctaagacctttttaaaagtgcagtattagggtgggagtatcccaattttccaggtaccatctgtcatggcttaccttggctaggaaagggaattccctgcgcttcctgggtgaggtgatgcccctctctgctttggctcacactccgtgggctgcacccactgtccaacaagccacagcgagatgaacctggtacctcagttggaaatgcagaaatcacccgtcttctgcatcactcatgttgggaactgtagactggagctgttcctatttggccatcttggaacctctcttaagctttatttttagatatttactgagtagattaacattacagaagaggaaaaatattggatataaataacacagtggaatttggaggatgcttgtcttggggtatacatacatcatgtagcccagctatttaaatcttgtcctgaacctcagtagttcttgggtccaacttaaatattagttattttgacctgggtatttcttctacaaaataaatgcaagtgatgtcagctcatccctgctggcagtctttccagatgtagtagcccttgatttactgtagatttgaaagttacatatgatttttataccctatgttagcaaaactcattcattttcttgcataatctgcaggatagagttcctgtacaactaaaataagttagacttgaaagtctttgcaacttatatattaagcataagggaggaaaagagctgaagatgtttgaagatggtcatgaaaagtaaggaggccagaggtgtgagttactgaagaggaagctttcattaccatggccaggagcacaaagttaaagctaggggagaaggtgtgacgtttcttggtcataggagggagtgtgatctgacaccagaggacttaatataacattgcagtgttaacatcttcactggcagattcatggactttccccctcctgaatgcatttcaacaccttgaaatgaacgatgcctcatgtctctgcagggtggacatagctctaactctctgaagctggtgagaatgttgaagcctaggggtgccttttgaaagacataaatttgggccctgaagtggtagtggggaggtgggataggagaaaaggagaaacctttgtggtggaaagatatctgggttggtcgttcaggttctgctgtaattagttgtgagaaagtcagtcagttaccctctgtgagccctatttttttaaaaaaataataatggtctgcctatttcagaagtttgatgcgagaaccaagtagaaaggttctttgtgaagcaagtattgaaatatattctcattaaagcgtgtgcatgggattgtgctaagcactgcagggggtaggatacaaataatacttagactctcacctcaagctaataaggcaataaaataaacacctcaataaatagaacaagtaaattgcaaaaccagtaatttggagagtgattttcaccacttgagacatggtgtctctagagcagtggctctcaaatctggctgttcattagaattacctgggagctttaaaaacagataattgtccaggccccagccccagaaattttgacttaattagttggatatgcctcaccttccactttcccctacattatcattttaaaaaatgtgctttaggtgtgtttaatttgcatcagaatcgcttagagggtttattaaacctcagattgttgggccccactcctgtatattctgattcactaggtctgagggcgggggcaagaatgaacatttctcacaagttttgtgatgctgattgtctgcaggtcatacttcagagccagtgcattcattttattttactgttaatgctgtgtatgcaatacgcatatatttttttcaggctgaaggaagcaggtggacacaaaagtccattctttggtgcaattttatagttgggaaagtcaacactgtgtggccaaatgaacacaactgcatttgatcaaagagatagttggctaacagaaaaaaatttcttcatacaaagattatatgtcaagttctgtgtgaaatgagagaccatggggattcattattgctggagttgacgctttgagattttatggaacaatgtagactcatgcccagtaacagatctggagaggagaaacaggctaaaagccaatatgtttcacaagagcaactgaaaccaatatttcaaatgaaggtaatacctataaagaaacataccagggatgactttatatttcccaaatcatgcagactgccttattgacttcctatttggataccttccaaggtaagtaggtgattgttttgtttgttcttttctagaactgactcgtacacaggtactgtaagaatcctgggaagtggaaagagattccaatctcacctcatcagggagcatcgaatgctctcttaagctcaataggaagaagtgaggctactttcagatttctctatcccaatggcttcaattgtactaaggttttctatttattcactccatgttcaacaaacatctattgagcatccattgtgagcattgacatagccctggttatgcagtgaggaacaaaatagagttcctgatgtcatggaagttacacccgtggagaaggcagaccttaagcaaatagttacacaaatgcacacatcattacttatgcggtgagtattatgaaataaactgcgcagagttctacaggaagtagtgtgctcctcacatttgaggaattaaagaagcccagggtgctggagcagggcaccaataaggaagatatgggaaaatgcttatatagcacacccaatgtatcaggaggagccatcaatcagctcaagtccttactaccaccttgtgaggccaacgtcagtgttattctcattttatagatcagaggcatagagagtatgccaattgcccagtgtttcctgggtagtgtgtttcaaccaaagatatgtggcttagggtcttcctcctctgccctgcattgcctctctgcaggggaaaggcagcagggctcaggagatcacacacattggcagctttctcttttgtcctctctctgtgtgtaataatatgcaacttcaaagctttaggcgttatgtgaaagaacagcaggttagttgacttaattagataaaataaccatcaaataaaatagtaatagttcattacctcataagacaacttatagagctgataagtaagcactcataatgcgtaaccatgttgtcatttcaaaagatctctccatgagggatgtgtggaagaaaataaccataaactattttcacatctcagcatgggtgattcaggtcttcattttctgactgggatggtaacatgctgtgatggttaatattgcgtgtcgacttgatcggattgaaggaggcaaagtattattcctgggtatgtctgtgacggtgttgccaaagaagattaacatttgagtcagtggactgagagaagcagatctatcctcaagctgggtgggcaccatctagtcagctgccaccgttgctagaataaagcaggcaggaaaagatggaaggccagacttgctgagtcgtctggtcttcatctttctcctgtgctggatgcttcctgctctcaaacatcagactcccagttcttcagcttttgaactcttggacttagaccagtggtttgccagggactctcgggcctttggccacagactgaaagctgcactgttggcttccctacttttgaggttttgggacttggactgatccaccactggcttccttgctccttaacctgcagatggcctatcttgggactttaccttgtgatcgtgtgagttaattctctttaataaactcgctttcatatatacatatatcctattagttctgtcccactagagaaccctgactaatacacatgccctttctataattccttgaagatgtgtaagtgatacaattcattgaggagactttttttttgtatttttttcttttcttttcttttctttcttttttttttgagagggggtctcgctctgtctcccaggctggagtgcagtggcgtgatctctgctcactgcaagctccgcctcccgtcaacaccattctcctgcctcagcctcccgagtagttgggactacaggcacctgccaccacgcccagctaattttttgtatttttagtagagatggagtttcaccatgttagccaagatggtctcgatctcctgacctcgtgatccgcccgcctcggcctcccaaaagtgctgggattacaggcatgagccactgcacccgggctttctttgtattttctaaggcaggaaaatgatgtaaatgtttagatgttatagcaggagtctaagaaatggaattttaagtaattttccttttgtcactaagagtagtttagttttgctatagatttaccttaagctttaaataataaatgcctataaacttaaaaatatttattgcaattttcatttaatttcctccttaagccagatacatttcccagcactgaaaccaagcagttggataagtttttgctgtcatagtttagtaagtggcaatgctaaggaagagaacaaaactggtgcagggctgctacttatcacaccaaggaatccagatgcctccatgcagttagtgtatctgatgggaaactcagaaaaagacagatatgaagctcttacgtttcatgatctaggcttttcagggctttaccttttgtgactggcttttatcaaattgcatgtttaatagtaggcagaaaaagttaagaaaacgcataaaccataagctggataataatctttgagaaactaaaagttggctgtttggagcattgattgttatagaatcataggaatgttagaaatactctttttcccctttaaggatgaaaagcaaggctgagacataagtgaattttccaagatcatatatcaagctggtagcagagaacgagatagagccacactctcctaactcatagcagtgacctcagcattgagattaggggtgtgtgtctgtgtgtgtgtaacaatgtgctttaggtttcctaagacaaaggccatgaaactagaaacacaatatgcagttctccaggaaacatacatatccagagcacatagaaaatcccaaacttagagtgcacatggcttctgaagcaaagattaagtcaataaagatacaatatggggataatgtttgagcaatatgctactatggtctttaataaaacaccttcacccttggtaaggcagcaaactatggtcctttttgatttaatcagttatttttaaagactaaaacaccttacagatagtctacatttgaaaaatattaggataatttaatgaatttattatgcccttgtccactcttggccatgtagaaccaggtatgatctcctactagcgtactcctgtgtgaagccctctcagagcctttccagaactgtagctacccaggggctgtggtgggagaggtcttcccagggcacagagagcatatctgctgctgtgaacttggacttttaaacaatgtcaatgaaaaaatactattccctgctggggctgaccacaccaatctctgctctccccttagtgccactgctccaagagactgttccaccaagtccaaaggcagaggaagagggaggggatggaagctgggagtagataatatttacttctttaccgatcttcaaattggcatctagaaatgcaagaaaaccataagcagtgaatagtactaatacgagaaataagattttctgttacaagttaaatgttaataaaaggaataaaaccataactaaatagctttccttcaatagaaaatcaagtataaaatacaatggagaaaaaccacttttacagtaacaataaagaccatgaaatatctagaaatactttttaccccaaacatataaaacctatataaagaaaaataaagctttcctgaattataaaagaagacttgaataaatggtggggcatgccatattcttggttgtaaaggttttgcttttccttgagagagtttatgtttataatacaattccaataaaaattcagtaggattaaatacatacacacacatttcaaaatttgactttggacatgatacataaggcctttggactttggtatgagaataaactggtcaacgtttcttgaatacattttgaaaatatgaataatcttaaaatgatcagatctcttaatacttctagttttgacactagatacataattggaagtgataataaaactccatgtttaagaatgtttgtcaaagttttgtgaataaaattggcctgggcaacatagtgagaccttgtctctactaaaaatgaaaaaaaattagctatgtgtggtggtttggtgcatgcctgtagtcccaagctacttgggaggctaagatggaatgacgacttgagcccaggagttcgaggctgcagtgagccatgattgcaccactgtaccccagcctgtgcgacagagtgagaccttttctattaaaaaaaaaaattgaagttggcaaaatcaatgaggcaactggctcaaacacattttgacataaacatgaggtaaagtattatgcagctactaaaacctctatttaaatactaattaatgacatgaaaccataaataaatttaaaattatataaagtttcttaataaaaaataagtatattgcatatacacatataggcaaagaacacatgtaagtgaagaaaatttattgaaatgtttccagtagttatcttaggatggtgaaatcgtaaagtagatgcgggtccaacttctaactgtgagattctggttaagttttgttgttattccaggtcttaattccttcatatataaaatgaagaaaataacaatacagttgctgtgagggttaaatttgctaatacatgcaaaatgtttagcatagtgcttagcatataccaagtattgaataaatagcatttatatcaataattaatgttacataatttcatattttataaattttagaccttgcagatttattaactttataatcagaaaaagatgatgaatattatacatttcaaaaagaggaggttcagaaatttaagtcaaagtgaaaaccaagagcaaaaaagacatgggaagttagcagagaatgtaccgcatggagtaagatgaatttggccttaagtagcccaatttaaaaaaggaaattataacataacagttattgaatgtgttctctgtgctaggacttttaagtattatgtacatgttatatacattcttgatatcagcctgtgaggaaggtactattattaccatcttacagatgaggaaaataaggtacagaaagttgaagtaattcattcaaggttgtagagcaagtaagccgcagaactagactatgaagcagtctggatccatttaaccactccactgtactgccttcttacatgatgagttctacatgattcaggtaagataaaagaaaatgaattgcttaagataagcacaacaatttctgatagtgagataagaaacattgcccctgaatggcctcatgaagatgacactgctcaatttaatgatgaacattctccatgtatccttacaacagaaatacaggtttcatagctctgtttattatgatgtctctcaatgtgagttagtgaccttgcattaaagcacaatcattaaaaatctttatcttggagaaaggcccatgagtagagagcagacttgataggttaatggagagagactagcatactgaaaaatctttaaaataactctcttttgtgctgaaaaatctttaaaataattttgagtaattgaagaatgattgagggctttgccacaaacttgaaactcaaacaaggacttctaaagaggtaagaaatctcataaaacacaggaataagatcacaattagtttctattattctttaaagtttagatatgaaaaaaattaaaaaatgtaagatgttgactagaataacaaaaaaattgtgtacagttgtgatactgaaagtgaccgttttggtttgcagttgggaaaagggtattcattaatttggtgtggcatactgaataattcagttgtcatatatagggtttaagtttgtcacaggttggactctccagaagcagatgttgagacagagtttgggtacaagatgtttattagggatcaagacctgtgaaaggaatggggaggaagcagaactgtccatgttggaacacaatggcctgacatttatattcacgccgtgctcaattactggacgcaagctgctctgaaaagggtgtaatctggagtgaagcatctctctccagctgaggctaattccgaaggagctaacagctggaggccatctgctgagtgcgttccccacaaatgggccacaagcccttcctttaagggttcccttaatctcttaacagatattttgggagtgggtgcctgttcaaaccaaagattcctgctggctatactagtgtgtggtcagtttccaggggagttagcaggtaagcactggaagaacaatgcttagaacagagatcggcaaatgatagatagctcatgggtcaaatccagcagtgatccatttttgcatggcccatgagctaggaatgtttgttacatttttaaaggattgcaaaaaacatacaaaaatacctcgaggaatatgtgacggactgtatgtgacctacaaagcctaaaacttttactatatagccctttataggaaaatttttctagatcctggcctagaatcaagaccagccttagtttcaagtaaatattctacacctagtttttgcagcttgagaaatgagaactagaagttattttttactgtagtccttagaaggaagtaattggtgtgatcatcgattgtggcaggagatatttcttaaatggataatcagagcatgaggacctgcccagatgaggcctcttgaattggatccctaatttacttggggctttctgttctcctgctctggaaaatgatggtagatcaagtatttttaaagcacatttcttttaacattttcaactatagctgcgatttctctttaggttattttattaaagcaaccaagcgtttgataccgtgactacaacttcactgaacaagaacctcaatcctgtaaaaatgttatttgctccctggtagaatgtcactgatatgactttgagtttcatatcagtttcattgaacttcaacttgtttaagcagaaaggatcctgctgaaatccctgttgcttgacaaccccctaagtgcatgctgggtgttgactgttactttagagaggactccttagttgatcatttggttcagtgatccatgttataatttttttctcttttcatgccttattacccatttaaaatactttcattagaccagagagctgtgtatattttgttctttgagtttttgttcagcaagacactatttccttttagagtacatttcacataaaggaaaatgaaatgagcatggtaaattttatttataaactggcattttctgccagctggatttcaagagcattcacaaacttccacatttatgtattacctacgtggaagtgtaggtgccagaaaagaagccagtataagctttccaaataggagaaaatttactgtatataaaaggtcatccagctgcctgaacagttgtataaaaaggtcagcttctgtaggaagcagagagtgtagaggtagatgaagtagttcagatgtttcaactttaaatcttctataaggatgacagacaagatgaaggcaagagacaaaagaataaataatgttttgaatgtttcgtagaataagcttcttcctgcttgttgaacataaaatgattggaaggaaagattttattactgtgctatggtcaactgtggagggacagtatgatttcagtgctcacattcattgcaaatggctgtcatgcgtcctctattgttttcttagaactaaaaacaaacgaatggcagattatgagttctaaaacaaacaaaatcctaggagattaagagttcattattagcagagatatctggccagggattttgtttctttttccttttttttttgagacggagtttcgctcttgttgcccaggctggagtgcaatgatgtgatctcggctcaccacaacctctgcctcccaggttcaagtgattctcctgcctcagccacctgagtagctgggattacaggcatgcaccaccacacccaactaattttgtatttttagtagagacagggtttctccatgttggtcaggctggtcttaaactcctgacctcaggtgatcctcctgcctcggcctcccaaagtgctgggattacaggtgtgagccaccatgcccagtcttttgcttcttaaaatttgcatataatttgaagaatgtgtaccttgcattggcttgaagaaatttttaattttcctcttttatgtaaacaactcttaattatttggataaatgggtcagggaaatcatgggtaacaaacccaagaacagaaaattattggtctttaatagataatcttcaataatctttaatagacctctggtatcaacctgtggaccctggctgctgacaacagttaaatatactgtgatttatttttttattctctgttaaaaacatattggttaataataaaatggctagaagaatagtgacagagggcctggataattaatcaactaacttggtaaccagtcctcaaaatttgagaattcattatgcagcgagttgttagtttttaaaatattatctattatgtaagtcataatctaattttagatcctaatccagtctttacttctggaacaagtttatactttgacaatacaaattcagtcttacccaaggagaagctattgtctcaaaccatataatatatttcatgaaaatacagattaattttagattgcccagggaaacagctactgccattcttcttctattaatactttagtgtatagggcctgttgggagagggtggaggtgggggagtgcatcagaaaaaagagctaatgcatgctaaacttaatacctaggtgatgggttgataggtgcagcaaaccaccatagtacatgtttacctatgtaacaaacctgcacattctgcacatatgccctggaacttaaaaaataaaattaaaagaaaaaaatactttagtgtagaactcaatatatatattgaggcattttctatgtatagtgctctgtctacaaaagagacaatgaagtttaagtgcctaccaacatgggcattcttaagattatctgccagtccctgtgtgggtttcgcaagtgtttgcatgcatttatccataagagaaacaatttattgtgtgtctttctggcatttcttttctttctttttaaaaatttttaattttactttttgtaggtacatagatgtatatatttatggcatacatgagatgttttgatacaggcatgcaatgaataataatcacgtcacgtaaaatgcggtatctatcccaagtatttatgctttctgttacaaataatccaattatattcttttagttatttttaaacctacatcaaattattgactataatcactctgttgtgctatcaaatactaggttttattcatttttatttttatttttgagacaggagtcttgctctgttgtccagacaggagtgcagtggcacaatctcggctcactgcagcctctgcctcctgggttcaagcaatttctagctaatttttgtattttttagtagagatggagtttcaccatgttggccaggctggtctcgaactcctgacctcaagtgatccacctgcctcggcctcccgaagtgctaggattacaggcatgagccactgtgcctggcctattcattctttctatttttctgtacccattaaccatcccctcctccactgtatgttcacactgcttttcccagcctctggtaaccatccttctgctctctatctccatgagctcaattgttttgatttttccctacaaataagtaaggacatgtggtgtttgtctttctgtgcctggcatatgtcacttagcataatgacctcccgttctatccatgttgttgcaaataacaggatttcattatcttttatggctcactagttctccattgtatatacataccacatgttctttatctactcatctgttgatggacattttaggttgcttccaagtcttggatattgtgaagagtgctgcaacaaacttaggactgcagattatctcttccatatactgatttcctttcttttgggcccatacccagcagtaggattgctggatcacatggtaactatatttttagtttattgagcaacctccaaactgttctccatagtggttatactaatttccattaccactaccatttgtacatcaagtgtatgagggttcccttttctccacatgcttgccagcaattgttattgcctgccttttggataaaagccattttaacaggggtgagataatatctcattgtagtttttatttgcatttctctgatgatcagtgatgttgagaaccttttcatatgcctgtttaccgtttgtatgtcttcttttgagaaatatctattcaaatcttttgtccattttttgatgggattattagttgttttcctatggagttatttgagctccttatgtattctggttattaatcccttgtcagaagggtagtttgctaatattttctcccattctttaggttttgtcttcactttgttgtttcctttgctgtgcagaagcttttaacctgatgtgatcccatttgcccatttttttgctttggttgtctgtgcttgtgaaatattactgaataaatttttcactccaatgtcttggagactttctccactgttttcttgtagtagttttatagtttgaggtcttaggcttaatttttaatccatttttatttgatttttgtatatggcaagagataaaggtctagtttccttcttctgcatacggatatccagttttctcagcaccatttaatgaagagactactttttcccccggtgtatgttcttggcacctttgtcaaaaatgagttcactgtaggtgtgtggatttgtttctgggttctctattttgttccatagtctatgtatctgtttatatactagtactatgctgttttgtttactctagctttatagtataatttaaagtgaggtaaagtgattcctccagctttttttttttttttgttggaggggggctttaaggtagatttggctcttctgggtctttactggtttcacataattttaggattattttttctatttctgtgaagagtgtcattggtattttgatagagactgcaatgaatgtgtatatcactttgggtagtatgtgtcaggcctctaacacatacctctaatacatatgatggccaagctaagccatcataacccctgtgacctgcatgtatacatccagatggcctgaagcaactgaagaaccacaaaagaagtgaaccacaaaagaagaaccacaaaagaagcaactgaagaaccacaaaagaagaaccacaaaagaagttcctgccttaactgatgacattccaccattgtgatttgttcctgccccaccctaactaatcaattgaccttgtgacatccctcccctggacaatg

SEQ ID NO: 2560 - DNA, 6135 bp, Homo sapiens
aagtgacagagtctctgttgcttaggctggagtgaagtggcatgatcatagctcactgcagccataaactcctgggcacaagtgatactcccacctcaacttaccaagtaggtagaactaaaggtgagcatgatcacacttggtcaatttttattttttgtagagatagggtttctctatgttgcccaggctggcattgaactcctggccttaagtgatgctcccactttggcttcccaaagttataggattattggcatgagctactgtgcacaggcaaatttactttctttataaattacctagtttgtgatattccattatagtaacacaaaatgaactaaggcaaaggactatagtcagaattacctaaaaccatgttgggaaagcattaagcaggacatatggtctaatttgccataggttctcaattcatgatttttttctccttttgattccaagcccaattgttttttttcctacagcatagggtgaacccccaacatcggaggcaggtctcagttaatttagaaagtttattttgccaaggttgaggatgggcaaccatgacacagcctcaggaggttctgagaacttctgcccaaggtggtcagggcacagcttggttttatacattttagggagacatgagacatcaatcaatatgtgtaagatgtacattgggccaatccagaaaggtgggacagctccaggtgaaggcaggacagctggaagcctggaggggacttccaggtcataggtaggtaagagaaaaatggttgcattcttttgagtttctgatgagcctctccaaatgaggcaatcagatatgcatttatctcagtgagcagagtggtgactttgaatagaatggaaggcaagtttgccctaagcagttcccagcttaactcttccctttagcttagtgattttggggccccaagatttattttcctttcacaatactataaaacatgttaatgcacttctattagttaggttccttttgattgcaagcaacaactacccaattcaatatagcttatgaaaaagaaaatatattttaaggatacaagggtatcttggagcatctctgagaattcaagatttcaggaatgatctgaggacagggaagggagtttctctttgggccacttcttttcttttctttttttttttttttttccccaagacagggtctcgctttgtcatccaggctggagtgtactgatacaaacacggctcactgtaaacacctcccaggctcaagcaatcctcctgccccagctccccaagtagctgggactacaggcatgtactgccacacctggctaatttttgtattattctgtagagacagggtatcaccatgttacccaggctgttctcaaactcatgagcgcaagccatccacctgccttgatctcccaaagtgctgggattgtgctggcaggagccaccacacctggcttaaatgctcctcttgatggttggcctctttctctggcaatggctggctccctctgctcctcaggcacagggggtgagatgcacagtaacaactctgatccaatccagctggttctttttagaggaaaaacctatagctggagcagtcaacagaggcaaggtcaccttgtggcagctgcagctgcaaacatgggaaggaagcagggggcaggggagggcaggagatcatattttggaagagggtgctgggcagaccatccaataagggctaatggcagcccttctctaagaatgagaaatgtcattctgaccagcagttgacagttaagggtcatccaaatgagctacatgcttatcctaaaaggattggctagagacaaaagaggaagtgggttacacacttatccaaaaaggattggttagagacaaaagaggaagaagaaataaaagggactggctcatttcttctgaacttcctgtctgtaactttgtcaggcagagcctgaagtgctctgtggttcctgggctattgcccggcattagcaggactggagtttggctgcagagggaggcgagagtacaaaagatactcgggaagctgattgaaagccattaaattgtttttagagccaggaaaggagacattaaaatgtcttaggagctgtagcctgagatgaataccataagagcatgttggatttaatcagtgacatacaaataggctaaaggaagtttttgttgttgttttaggcttttttttgagacagggtcttgtcctgtcactcaggctgaagtgcagtggcgcaatcatggctcactgcagccttgacctcccaggttgaagtgatcctcccaacctcagcctctgagtagctgggactacaggtgtgcacctcgtctgcctgatctttttgaatttttgtagagaggggtctcgctatgttgtccaggctggtctcaaacttctgggctcaagcaacccgcctgccttggcctcccaaaatgctgggattataggcatgagccactccatctggcctcaagatgttaaatgcagtctaggtgggattcagacttccccctaccccaagtggatgaaaaagtgggtgcaggctgtgagagttaaactgacactttgaggtgctgccattgtaaatcagagagttaagaaaaacaaatagctacatactgtgatgaaccagaaataaccaggtcatcctgtgcagttcagttcccccaaataaaagaaacttgagcattcccatactttactgattccctaaggaaaaacggcattatctcttatgactgcagtgcttacctatgtcaggggatatgatgtgacatttgtgggtttgataatcaagtgacaacatttctaatttcacacagtgagcagcctatcataaacttggtaaccttggcaaatttgtagttatttccctttggtttttttccatctttcaatggattcgttttctttttaagtagagacagggtctggctgtgtcacccagaatgctgcagtgcagtggcacgaccatagctcactgcagccttgaactcctgggttcaactgatccttccaccttagcctaccaagtagctaggactacaggtgtgtgccaccatgtctggctaagttttgtttgatttgtttgcagacatggaggcctgctgtgttgcccaggctggtttcaaacacctgacctcaggtgatcctcctgcctcagcctcccaaagtgctgggatcagagacttgagccactgtggccagccggaatgtaaattccactgaatttttttgtgtgattagccttcttgccgaagccttgacactcttgcaagcctttgcgagtacatttcttctatttcagaagactccttgctctccaagacttttttctacaaggtgtaaccagaagccaggaggcctgttgcaaaaccaatcccatttgaaagcagagaatgtgaactcacctattgtcataatgattataaaagaggctttggctcactcctgtaatcccagcactttgcaaggccaaggcaggcagatcacctgaggtcaggagttcaagaccagcctggcctacatggcgaaaccccatctccactaaaaatacaaaaattagccaggcatggtggtgcacgcctgtaatcccagccactctactcaggaggctgaggcaggagaattgcttgaacctgggaggtggaggctgcagtgagccaagacggcaccactgcactccagccaggcgaccgagcaagactctgtctgaaaaaaaaaaaaaaattatgaaagagggtgggtgcggtggctcatgtctggaatcccagcgttttgagaggcaaaggagcgaggatcactttagttcaggagtgctagaccaacctgggaaacatagtgagaccctgtctctaccaaaaattaaattatttgggcatgatggcacatgcctgtagtcccagctacttaggaggctgaggtgggaggatcacttgaggttttagtcatggaagtctcttgccctggaggtcgaggctgcagtaacccatgatcgtgccactgcactctagcctgggcaacaaagcaagacactgtctcaaattaaaaaaaaaaaaaaaggcttagggagttactgaagaatcaccctgggctgtagttcacagggagtgtgcataggttaaggagaagacatctgcatgagtttcagtaaagagatacagttgcggtggctgggcaacctcgtaaacattctgggaaggaatgcagaatgcaaaacccagctgaaaaatctagaagaaatcatgtcccagttaaagaagatattcctcctgagtccttcaagctctgctactttaatgagatgcaaagaaagcttgcagagctaaggaaatagaggataaagcatcacccttacagaatcaaaaaactggaaacagcaaggaacagctagaaaatggctccatagttctgaaaccacttgctacaccagtggttctaagtgcagtcccagcaccagcagtgtcagcaccacctgagaacttgttagaaatgaagtgaattggtgtggggagtggaaccggcaatctggcttaatcagccctccaggtggtcccgatgcccactaaaatttgagactatgttcttctccctctcaggctgaagagttgggcatagcaatgttgttcagctccagattccagaactagacacgtttctcccagggagattcttatgaacattccttttcaagaacagaaagaggccaggcgtggtggctcatgcctgtaatcccagcactttgggaggctgaggcgggtggatcacctgaggtcaggagttcgagaccagcctgaccaacatagagaaaccccatctctactaaaaatacaaaattagccaggtgtggtggcacatgcctgtaatcccagctgctcaggaggctgaggcaggagaatcattcaaacctgggaggcggaggttgcggtgagccaagatcatgccattgcactccagcctgggcaacaagagcgaaactccatctcaaaaaaaaaaaaaagagagagagagagagaaaagaaagagaaaaaaaggccgggtgcagtggctcatgcctgaaatcccagaactttgggaggccaagttgggcagatcacctgaggtcaggagttcgagaccagcctggccaacatggtgaaataccgtctctactaaaattacaaaaattagccaggcatgatggcagatgcctggtaatcccagctactcaggaggctgaggcaggagaacagcttgaacccaggtggcagaggttgcagtgagctgagatcatgccactgcactccagcctgggcaacaagagcgagactccgtctcaaaaaaaaaaagaacagaaataatcaaaccacagcatcaattcattcattcattccaccaacatttattaagcagcaagctccgaagcagacgtttaccagttttgcacaactttgtcatggaccaactggccttgtggctcagtggcatctggaggcaagagggccaagtagacaggggtctcagccccctcctccacagtcctgatgctgtctttcccatccatgtctgtcttcactggtcctgggcagcacgcattcaccagaatcctgtcagctttcctcttctcatccagacgcctggccaggatcctcgataagaccgtgacccccaacttggacaccccataaggctttgttctcagaaacttggcggctacaaggaattaaatgtgaatgggaaaggaagaaagaaaaacacagatcatagaagctgtgccttcgaggaaataaatcctcttaaggggaggaggtgtcctctttgatctgagggcacacctctgggagagaggccagaggctgacagtcagcctcgtcagccagatgcgtcatcagccctgggaagggctgcacccacaccaccctccactgaggtccaggtggccccaccggtcccgaaacacctgctgccttactctagaaagagtaggcaagttgcgccctctagtggcttagtagttgcttgtcctattgactcagaaccttgaacaaataagcaagtcaaatacagatagatggtccctgccctctgatggttccacttaggacttactgacttca

SEQ ID NO: 2561 - DNA, 9457 bp, Homo sapiens
cacaagttcctcttctgttagtccaacatcctgtgacaaggatgtgatgaaattcctatgcagctacaatgacttcagtctttcttttcaagaggctccaagtaacctacaaaatacctctgatgaaaacctagaggaaagaaaattatgcattgctattatttttttttccagggatgactggaacatttgggtgcagggattttgttccatatcagccttctcctactttatattctgcgccaagtcagtgaaacttgataaggttgagctctaggcctgccatttgtttctctgacagggcccttgtgatggatttgaaggtcaagatgaccacatttggtgctgataaaaaagtataggaaagcacctcccctgactggagtctgtgaagatgggtgatggccatttttcatagactatatcagttcagttccggcttaaaaaaaaactttcaaagtaaagatatttctgacagttcaagaataggctattttgagaattccctttcctgtaaattataaatgggctgtaatactgtgggagaaggttttcatattctactgtttcttttttttgagatggagttttgctcttgttgcccaggctggagtgcaatggcatgatctcggctcacctcaacctccgcctcccaggttgaagtgattctcctgcctcagcctccctagtagttgggattataggcatgtgccaccatgcctggctaattttgtatttttagtagagacggggtttctccatgttggtcaggctggtttcgaactcccgacctcaggtgatctgcctgccttggccttccaaagtgctgggattacaggtgtgagccactgtgcccggcctctacacagttacttattgagcccagtttgattctttgtgaagaacagattgtacgaagttgctttcactaaaaggttaaaatgcatgtgcttgttctgtgcaggtgataagggattataccatccactgaatgttttggggatattgtttttgatgtctgagttttaaactgcaatgataaattgagaattcctgttgtttgttccccattatataattggtgaactccactgtgtcgccatgttgaaagggtgagatctgttctcttggtggcgaagtcctttcttgagagtgagtgttcatcctttaaaatatgccagcagtcttttgagcatgacagccaaacagtgccccatcttcatactttttcttatgactgcttcaagtattcaaaggttgcaatgaaggccagctgatgtccatttagtctgactctgtcacagtccaggagcagtactgggtgggggctgtagtagccaagttacatccatggagctggttgctcttctatagggtgtagggcaccagctaactaaagggacttcaaagatgtttaaaaatggaagcaccagaatgtatattaacttagacaccgtggaaagcagtttggagatttctcaaagaacttaaaacgaccactcaacccagcaatctcattcctgtgtatgtatccaaaagaaaacaaattgttctaccagaaagacacatgcacttgtatgttcatcgcagcactgttcacaatagtaaagacatggaatcaagctaggtgctcatcagtgatgaattccataaagaaaatgtgataatatacaccatggagtactacacagccataaaaaagaataaaatcatgaccttggcagcaacatggatgcagctggaggccattatcctaagtgaattaatgcaggattagaaaaccaaataccgcatgttctcacttataagtgggagctaaacattgggtactcatggacacaaaaatggaaacaatagacactggagactactagagggtggagatggggagggaggtgtgaaaaactacctgttgggaactatgctcatgatttgggtgatgggatcatctgtacaccaaacctcagcatcacacaatagacccgtgtaacaaacctgcacatgtactccctgcatctaaaataaaagttgaaaaagaaaagaaaacggaacaccaatgagatgttcactattattggcgctaaagtcatcacgattgcactataaattctctgcatttaatagatgtttactttagggcccactgtgtgcccagagttgtgctaggtgctctgtgagcacaaagaaaaataaggtttggatctgttttttgaggggcttctctaattggagagcccaagagttaacagcaatggaggcagaatataatgatgacaaaaatgagcctgcagaacgtgaatggtattgaatgttgaaagcttcttagaaaagtttaggtttaaacaattttgaccagcagactttgattctgttagacacacacttgagatccttactgttaccaatgaggaaggtactttcaatgaaatattttgtgtttgaaaaaatatttgagctattttagagtacttttacttaactttgtcttaatattcttatgccacagttagcttttgaggggcacacaactcatctttattttgctcacttagatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtccgtagaagatgaggagagaccttttgcactgggaatgcagtttgttttgttgcgaacacttgcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctgaaaagaggaagctgaactttccatccagtactgttgatagcattttaagccatagcagttataaatcaggtagagtttttcaaatgcttcagaggaaccataggcatagtgtgatagaaggaacagctacttcaggtcgtaggacacattctctttcagtctgcctgccccatcctaagataaagaggctgctgaatcataaatctgatagcttaaatataaactccagtattcttttgtaaggagcattaaaactagtgtgctaaacaatatggctagaaactgtaatttgaaatgcataatagggaaagaaaatgacagctttctcatccaagaaaattgttgcagaaattttctttagctctacgggcccacaaagtcactgggaaaagtcccacctgagtattttagttacatcttgaaagcactggcaaatctgtgtggttttctttttttctggacagaaaattgctgtggttgctcctgaaaatgcatacttatatcaggaaatctgtgcctgggatatgaaaatcacttagaatacaggaggagggagatctgtgttctggaacagaatatgatcttaagtaattgttgaaaattatgtaaaataaaccagtccatccgaaagaaccctactttatcagagatagaatcgttttacactaccctttgattcccccttactgtaagtttctggcagtgattctgagagaggatttttctgttcctaaatgcactttgggttcattacccatcattcttttcagtacctcccagcacatcactttgaagtaagcatcatagagaatgctttctacatggctcttaagatagatgcttcctgacggcgctaacggattgacagcaagttagctcaggggttctggctgccagggagtgtaagggccaaatgctgatataattgtgaactttttctgccaaggagcctatggtcatggagggctaattagggaaatgtttttctcttctggtttacccttatccccagaagagatgtgattgacagactgttccatgattcaggcttctgctctccaaccttgcttgactgcacaggtggaattgtgcaaatactcctgggtataaggctgtttccctctcttcctaggaatgacattggtcaaacagttctcttggttgcatacagtttgtgttaacactgttagactgaacaatgtctacaaggggtggagctagtggtctcaggggctaaggacttccctctggttcctgggcttggctctcggggaggtgaggattcttgcttggttaagactgtaattgcactggtaattgtcagactctggccaatgtggcatatattggaagtattcaaaaaatcttgctgattaagaaaaccttgctgattgaactagtgtctcctttggggcctcagggttcccctttaccctctatgggagagctctgatcctttaaaggagaaattttcctttggtgtgggagttaaagatatgtagattggagaggtgtggtgttttcttaattttcttctgatcattaagatactgcattgagagaattttggtgggattggcactttttctggtagctaagattgctggactcagcacggagtagttagagagcccccttactccctttgctgccatgaacagtcatccagtttggcgatcactgatcaggtgccaggtatcttcaggtgtcatattacctgattaccatctgccactccataaaatcctttgggatgattgggccagaactcaaagaaatgggcctgaaatgtgcaccacagtgttaatattgtacttcctcaagtatctgctccttataaatagcaggtatttcattaatgtgttgttggtgaatgtagactaagtagtaaaaatcatgagaaaataaagctttggaatatgtaccaattaagagtggttcacaaaatacttggggctatggtagcatcactggaatattacatagccaactgaagtgactgttttgtagatgataccatttaattgtatatatagggtcttatatgtttcttaataaattgatcccattactttatagtcacagctcctattagaagttttaatgaagactctccatgagcttaggcttcaaattacttgttttggaaaaggtcatcttgtcctttataaactgtaaattcatatattatttagctttaatatgcaaatacaatatccttgagttcatcctattaatttagaaactcccaggaggtaagatgggtggttggagcgcattctttggttattttcattagcattaagtccttattctttataggtggatttaattcttgaaaatattcaaaagtaattcagagtcaaggtgttggggatggagagaaaggaggaacagagaggaaaaaaattagcatttgttgagtgttgacgatttgtagagcattttgacaagcacttaatatacatcatcattcattttgatcctcttaattaccttgcaaagatttgattctttttttttttttgagacagagtcttgctctgtcacccaggctggagtgcagtggcttaatctcagctcactgcaacctccgcttcctgggttcaagtgattctcctgtttcagtctcctgaggaactgggattaaggtgtgtgccaccacacccagctattttttttctatttttagtagagagagggtttcaccatgttggccaggctggtcttgaactcctgacctcaagtgatccacctgccttggcctctcaaagtgctgggattacaggcatgagccaccatgcccggctgattttattatttttttaaaaaacatatgaaaccaagactcagagaagtaaaataactcatttaggatcatacagaatggtaaagtcaggattcagacatagatttctctcactccattattcattttttacactacgcaatgtatacaatagcttttggttaacaaaggcaaggtgactataaaatcgtgagattaaagcatttcaattttttgatatattaccgtttatgaagagtagagaggtttttttgtgtaaataaaaaaaactgtaggaaacatctgtaggaaatatcaagatttaatgtttaactagattttcaaggtaaatttacatttatttagctaagtgttatattaaagttatttgtcataacatacctcaaatatttatttatagttcatatttaatacagaacaaatctagtcttcgtgttaacatcgggtctcggcagagtttctgaaatgaaacattatgaagaaaggtagttcagatttgttgaatctgagctttagggatttcaagtgtatttttttttattttcctctttcagaatattaacatctctattagttttttgatgaatatgagttttaagattcctaataagggttttaagtgaacacacataaaatacatatcaaaccactgatcccgattgttccctttagtcgctgtgacattgttacctttagtggcatgcacttggaaatgtcagccttcagagaagggggagttacatggagtaaggcctcatggatgtcatggtggtcctccatgttcaccaaccaccaagaaaattcttcttcagtccacaattccagcttgcgctctttggtgcacttggagccagaaagtgtctttttggccctgttttgtagaaaccgtgcatgtaccaaagagaaactttagagtttggatggagctgaagcattgatgggaattccctagtgcacccaggagcaggaggcaagcccaagcctcgggtggtagccaattatattttgtgatcgtgtatgtacttaaaacatcagagatgacacagcacatgaatataactattgatatgtaggtgcatactgagtattctaagtagcagatagataccaaaatactgtataatcccagaattgcctaaactgcaggtttgctagttctctgttatacagaccagtaggtagcctttccacacatttgtgttttctcttccataataagagagtgctgcggctggcaggcaaaggtagttgcctcatgcactttatctttttgtctttttctcttcttcatcttttgggatgctgctggctgtatctgtcccaaacttcttgttgcattagaatcagatctgtgtatgtttgaggaggttttattttaaagacttcagttttactcagctctaggaagggtcaaatacaacaacaacaacaaaaaacagaaaacaaaaaaccctccctaggtgtttgcttttgcaacattaaaaaaaatgccttggtgctaaaaagtatttaatgacgcatgttcaccactaaaaagcgccactgaattcacagtatttcactgctaagtggctgcatgtactttgtgtttggaaatctgaagaattttccagaaaacaagcatccattactctcatttcaacagttactccatctatgctgcaaaaatgaagcgtgaaaggggggatacttttctatggaatactcagtgcttttgatatttattttagcaagaataatcagatgccaaaaataatttcagagaaaggtagaaaaaatatttcaggtaaccttttcttatttcttctccaaaaagattacacccatgtaaggtatttttaacactggggttttgaaggtgttatcttttctggtatcctatcactacatgttaaaattgaaggagaaaatattattgaaactaaagtaattgcagggacacattaaaccaaaggggtgaacaaaagaggtttaaagtttgtatctagaaatgaaaaataagaatcattggtaagactagtaccgattattggcaattggtaattgataattggtaagagtagtaccaaataatgggcatttttcttaaaatacatacctctaccccaaaccccaaatgttaatttagaatcctgaaacaggcaagtcaggctctgactcttttgtttaaggaaatgtaatactgtgtcaactaaactggcattaggttcttagtggagtgtgtgtttgtgtgtgtgtgtgtgtgttttgtgtagaggtatgtttgtgatgaaaggttttgcactgttgcataaagaagtttgattttgtgatttttaaaatgatattcatttggagactttttaaggtaatttaaaagatgtataatttccgtgtgtttaatgaaatctgttgtcgatgtactaatcttggtttacagcatcttgaatacttgattattgaaaattaagaaaaaagttaaaaatgaataaagtgtgttggactgaaatgaaattgtttctagaactttgttgtttgaagggatgaagcaatgagaccaatgcgattgtccacccctcctacatcattaactccttacctaactgttaactctacattgaagcagaatgttctatgtgtaaagttttaggagtatagtttaaagagccatagcatgtttttttttattgagtctccaaagagaataattttaagtaattcatcacttacttattgaaattcaaaacagactttcagaacacagagctatgtaccttgaatgtgatttgttaagttatacttaaataacatattaaccctgaaatc

SEQ ID NO: 2562 - DNA, 111613 bp, Homo sapiens
gtgagaaaatgttctttccccagcccccaaacactgcagaatgcccccttcccttcttccggggccctctccgccgccctcctctgcttcattcagcgctgcctgtggcggagggaaggcgtttcccgactggggcgaggtcagggcccctccgctggttctgtctgtgggtattttttcttttaaatccctgaagtcatcgacgctttgtagggagagcgcgttggctttcgccgggcgcgcctgggctgaaacctgcgggtctctctccaagcggcgctggccgtgacctgcgttcgcaccttctcgcggccctctctgcgatttgcgagggcggcgcgcgacttggagttgttcagtgtctccgaaaagttgctcgtgcgttccacaggagaggggacttttaaacagatggctggcaaggcaggtatattttctttttcttgctttgtctgaaaagtagacatctggcggtggttaggggtacgtttcccctggagatttagcgatttctgtccttggtgctgaagtaggagggtcccagttagccttgggcttcaaccgggtgccctgggaaagactacacggaggaaaagaaagaaaatcagaacctttgaatgaactgagatattgagaaaggccattaaaaattgaatgaaaaaaaccccaccaaactaatatcaaataagtgtgattcttttatgctgaagtcttgcaaaatggtgtgctgtttcaccacgtttcctccattgtctatctctaattgtttataaagttctttaaaaggtttgtataagttatctttaaagtggtgtgtctattaatcttgcaagggctaattcagtttctgtgtcttgattttccttttacaaactgggagtggggtgtgggaagagaacaatgacaccctaatacatctagacaagtgtctttttgccaagaaatatacgtttttggtccatgaattccaaataattttacttttcaaaaatttaacaacattatacaagatttcgtgtttaaaactccatatgttattttggagagtctgattcatttggttatggcacctattttcactctgttcttgagctatgaaaattatatttggaaagattataatatatgtaggtttcattcattcttatagatctttgactttgtggttactcatcagtctaaatgaaatataaaactacttaaaaagacctaattagaattaaatagaaaactactaaaaagaactgatttatgaaattgcagaacacactttcaaaatggaatcagcaacgagatctcatttttacttccatgcagttcggaagattatttgtacattattttttgccattatatttgtaagtactaaaacgcatcataccactatattctaaacgaagtggctttatgttaaagtttcgtgttttgatatacatatttcaagaagccagtagagatatgtgttattatttcattttttcctggtccacagtaaatataatgtgaatagatcataacttgggtatatgtctcttagaggtgaaaattttaaaactgtgtagggtatgtaatgaagacagggcagtctctcatgtcaaattaggaaagatattcagtttacctgcagagtcagtttcctaaatagcgatagatccaaatagaagggttaacttatgtgattggacagcatagtttgttgcaagtatgggactgatttagttgtaacacattctcaataagtcactacccatctttgaaactcattatttttatctgacaacagtggaaatgatagacatagcctgttatatatatatatatatatatatatttatttgagtatactctaggtttaacagtgagtctgtgaaaacttgtgttttatttatatatgcatttttacttagtggggtagaggaattcttgtaaaatggtatttagttccaagtagtgaagtttccttcccaccctttccacagacagaggtaatatacggttttgtatcagaagactgtttctgggaactaaactacctttacgaaaattgtgactcttttaaacttatgatctagtgtaactaacatggccttgctgtttcctaattagtgcataaatgtaaattactataataatggtacctacctaatagattgttgtaagcattaaatggattaatagcagctaaagatttagttgagctctcatagtatgccaggcactgttataagaactttaagcctactatacaccatgtgcttagtatattttaggtccttttatcattgtgttctattttaaagcgatatttttttcatgtggtctgtgccattagtatgacctcacagcaatttttcatgtaatattgccatgcccagtgtgcatatgcaaattgaggtaatgatatcaaacattttttttcacagagcaaatgtataaaaacagctcagatgaaccactctaatttttaaaactaacttaaggagaaattaagtaatattttaaacaatgtaagcatgtataacaaagttttatgccagctgcttcttctccattattttacagttgagggaggtgaggtccacagaaaggaaataacataatttgttacagtaggttaagagattctcctaacagattgctgaatagttggaattataagcattttgatattttatttaagttttattaaatgaatagtactaagaaaatataaactaatcatttattttgagctttttagtatcattaaaatatattattgctccggtctttcctctacattatcagatatgaatgtcttgtctagtttatccatcatattagtttctgagtcctttgtactgcagtaggatgggtataagctatcaaatggaggacaatctcagacaaggttgagtggattgtttaaggctaaattctgggtctcttatgattcttttttttccatttctcaaaatgaatttttttaagcatgtaaaacccatccattaaatgaaagatttcaagtttaagatgctaaacaatattgctaaggttaaatggcacttgtattaatctgataatatattaagtttttagtttaaaggggaagtaaagcaagttcatttttctctagagatagaaactttacaaagaaaaagactcacagaagagtagtgattaaaacaatagctaatgcctattcccattcctctcaaaatgtagtcaggggaaatgtggaagcaatccatcagagtggtgttaaaattgcaggttcctcatcacttcagcaggaaagaccattaaaatgttgtagaagaggaattcctgtcctaatgatcaggctcctgagaaagctgggttaagtctcaatctgaaacagaagggcagcatttttggcagtaggtccctacagtagtagtaatagtagcaggtgtgtgtgtgtgtgtgtgtgtgtgtgtgtgtacacacaattgcttccttgcttgcctgtgttatcacttgggctgccccagaaaatcaacctccttctgtgtatagttatgactcttctgcgttatttactcaggggcttctcaggctggtagcctgaaggattatcagatgcctagagactgagctaaacaatcacatcaagtggccttgatgtggaattgaaacactgtaggcaaaaaaaacctcaacgatcctataaaaaacacatacctcaaactccatctttcctaatccctgaaaacctatggcctttttactatctctatagtttagcattttctagaatgccatatggttggaataatatagtgtgtagcctttttatattgacttctttcacttagtaatatgaatttaagtttcctccaggtcttttcatggtgtaatagctcatttctttttagcactgcataatattccattgcgtggatgtaccacaatttatttatccattcacccactaaagaacatcttggctgcttcgagacttggaaattatgaagaataatgttgctataaacatccttgtgcatgtttttctgtgaacataagttttcagcctgtttgggtaaatatcaaggagcacagctattggattgtatagcaacagtgtttagtttggtaagacagtgtcaaactgtctttcaaagttgctgtagcatatggctgtcccaccagcaatgaatgcaggttcctggtgctccacatttttgtcagtgttgtcaatgttttggattttgggcattctaataggtgtggagtaatttctcattattgatgcaatttacaattccctgatgacatatgatattgaatatcttttcatatccttgcttgccacctgtgtattttctttgttgaggtgtctcttaatgtcttttgaccagttttaaatcaggttgttcatttctcattgttgagttgtcattagcacttttcacccaatattttgggtccttctgctgggcatattgttggatggcattatcccattcactggaagttaggtgtggccgtatgacttgctcagacaaatgaaatgtgagcagaagtgacacactggaagctttcatagcctgagcacaactcacctcaggttctttgctgcagctgacattcaaggcagtggttactcccttagcctgtgtacctgagtatctgtgatgaagagccccgccgtatgacctatgatagacatttaatgcaaataaaaagttaaaacttctttttgtgagtaacttcaatttttaagttagtgtattatctaacttgcctttgttgatataataaggcggtgcagcttaaataataagatttaatggaaagttactgagctatgttgaagcctgttttcagttaaaatgctctaatttctctgtgatatcatgtgtagtatataataaatagatgtattgatttctgtttgtagtcttttgataattagcttagcataccaaattatgaggttttgttattaccattctagttagtgtgtgtcctgaggctagttggtgcattattccttaaatgatatcgatctcttttccaaagatgtaattaatccccactgatgttttccaagaactttgagattattctttcaaagttgtaatttaattgcaagactctgaaaaactcagtcattcctttctacttactctaaaatgtggaaattaccttttgaggctcccgatcacatctaggagaggaagagttatctccattgcctggaaagcactgacaatgtggtagctttcatcactgctgcagttttgccaggcaatggaaactgcaaataaatgctccttttcttctctcaacttataaacaaagagttgtgtgcattgggaagaatatcagggaagtagtttatggtgaaaggataggctcaatgctcccatctggctcatgggccagcaatccatttgcccgactctgtgttaagcacagcagaagagagaagggaacccagactttttctgaagcctaggatacttgcaccatgccaattaaccttccaaattgccacccctcccttctttctttccctctccatctgagattagaaagttagagaaatatgtctcttgcttcagagattgccattttccaatttagcaaaaaaaaaaacccttcaggattgattgtatctaggttctgtttcaggcaatagagactcagcagggaactctatacctataagcaaaaggtgtcatacaaggccaaagtgccaaaatgaagtaattaggagtctcagtttgtttcagttcaacaacccttacttgatttaatgtttaatggtagaagtcacctcaaggaaggaataattaattcaatctaagattcatgataatctctctgagcttgaaaagcatttaggagttcacaaggaagtgctggggtatgacagatgagagctttaatggaaatgagtagtatctctgtatattttactggaaaaaaatgtgtttgaatacaactaagataaagatataaaaagaagcaatttttaacaaaaggcaattactctacaactcagttcaagtctacttagctttgcccatattcagatatcctgcaaagttatctatgtgataccttttctctgctcttgcttcaacataaatccatttatttacagccagatatattagaaatcagcttcttagaaaggtgcaagttctattctgtggtaccagagttataaagagacatccagcgagtacttatagatctgttatctcagtttctatggagtatcttaaaacaatggaattattgttctttgtctaatttagtgtatgcaattgttatccttatgccatgtaattttcactggacaatattatgaatgtcatgtttgaatatttcttctgatgccattaaatgtggggcatttgcatttcatagggtgacaatcagaaagatactgtgactttttttgagacaatctctctttctgaaatgatctttcttgtttatacataagcttctagtaccgacctaccccctccactcattactgtttatagaaacgatagcattgcagttggtgtcactgattgcccacgttgttacttcaatgaagccagctgggatgcgattgcatggtctttaaataaaacttagtgacacaagatgaatctctttttttgaggggagaggggttgttgctagctggatcatttttctaaggcactaattatttgcttaacttggaggaacttgagaaccagtgaatcgccatgttggttcagcatctgaccttggctctaaggaacttgtgggtggatagcagagttacagtcattatgaagccattctcaaaatgatgatgatgatgatccttttaccccaactaattccaccattatgcaaataagtctttgactagagatagtagatgtgcctgtagttccagttcctaaaaggctgaggccagaagattaattgagatcaggaattctgggcagtaatagccctttcagcctggtgacagtcttctgttcacaagcagcctggggattacctaaaagtggtgaaaaggagagtgaaaagttggtgttgcattgtctaaaactgccatggtacggaatatggagaacatcaatcattacctttgacctttgggcttgcaaatcttatcgtgagataaagtaagatagcattcctccttacagttatagaagacaaattaggaaaccgagacttccccaggtgaagatttaggtctatgtacattattttatcctgaaaaaatttataaattttaaatatatttatatctatttaaaatgtctgtgtgcttgtatgtgtgtgtgtgtgtgtgtgtgtgtgtgtgtgtgtgtgtgtgtgtgtatttggtcaaatgcattaaaaattgctaatggcagtataaactacaactaaatgctaagccccttaattgactgactggacccccctctcaaccaagaggctcaccccagaagagccttaaaagctgtaaaaactgagttcatggccgggcacagtggctcacgcctgtaatcccagcactctgggaggccgaggcgggcagatcacgaggtcaggagatcaagaccatgctggctaacacggtgaaaccccgtctctactaaaaatacaaaaaaattagccgggcgtggtggcaggcgcctgtagtcccagctacttgggaggctgaggcaggagaatggcgtgaacccaggaggcggagctttcagtgagccgagatcacaccactacactccagcctgggtgacaatgcaagactccatctcaaaaaaaaaaaaaaaaactgagttaatggccatgactagatgggaggtcagattcgccgttatatcctctctgttttgcagtttagacacaactgaccagcattgttaaaatggagatcatacggctgttagaacagactctttgtggccaaaaattagcaaattataaatagaatctaaagccatcccaggcaagggttaagttatgcacccctacacttaaagaataaactatgttagccgggctcggtggctcacgcctgtaatccaaggactttgggagactgaggtgggcaggttacttgaggctgagagttcaggaccagcctggccaacgtggtgaaaccccatctctactaaaaatacaaaaaattagctggttgcagtgttgcgcagctataatcccagctactctggaggctgaggcaggagaatcgcttgaacctgggaggcgaaggttgcggtgagccgagatcatgccactgcactccagcctgggctgcaaagggagacttcgtctcaaaacaaaaaaacaaaacgaacaaaacaaaaaacaaaaaaagaataaactatgttctaactgccacaggatatttgtttttctgtagcagctaaacaggcactggctttgagataagcaatgttgaaacaattacagctccaccaaatgctaactgacccccaacttctcttccacaagtgataactgtagctttgattggacaagagattgatatcagtaactttctcctgataagagaccattgaccatgcactggctctggctggcttacagaagctatgcacttgagtgccttcctatccctgcttcaccttttgacccactgggcccaactgtaatacacttaatattaagcctccaccccaaagtgaacataggtcatatgttacatgcatatttgttcagtatgcatgcatcagaactactttcatgaatattcgtaactcctcctatattagccaccctgtttagcataaagctcccaccccaaccctcctccttcgaagttcgtgtgtctggtcttcgccagagctacacttcccagcctgtgggaatggccacttagcaggctgttaccctcgataagaaataaaatctccttcccagatttataattctgtgatttttcaattaaccgcagttacctttagggaatttgacagctgaaaaggaagactagctttttactttacatgtgtttatattatttaaatttttattaaaaatgtgtttcttttataattaaaaactagtgattatatatatattcagattatgcagttttctgatgatagcacaagactttgaaaatgtaaaatctctgtagagtaagaaaatctcttataaatctataaccccaatataatctcttctattctatgcgtgtgaattttttaaacaaaagttatcacacaaacattaatatgttttgtttcctttctatgggactaaacaattattctaaatatggaaagaggtacatatattgaaatatttggaacatatattttttccaaaaggatttacaagcagctattagtaatgattacttgaagagagaaacttctgaagcagcgggaatgaggctttcccgttttagctttgtgcatttctgtgctgtttctaatgatgtgtacatattgactttatttaaatataagtaagggtgtagctaggtggagaatagtgaatcatttttgtttctttttttttaagcttgtctgtatttaaaaatactaatggatatgccattttacaaaagattctcccaaacatgattttaaattacgttatggaatgacattacaggtctgtaccatacgtaccagtctactcaatgccatttgatatttagatttttgtgtgtgctgtgggcttgggggaggacatcagtaataacttttctttcattttcttcctttgaactccctccttcattctgagttccagacaactgagaaaatacagaaacttgtcaaacagatggctatccaccttcttagttgattgctggaatactagattggagaagatcaaaatggaacttagcacctttctcccaaaactaaatcttgacacgtcgaactcaccagagggaaggtctgggtctacagagaggactcatctgctgagaatccccgcctcatctttgttgaaccccaatagtagtgtgagagagatttgggttccacatctacctgtagaggcaggtcgaggtcctgacccattagtgcctactcagcagctcaggatgtgtccagcctgtggccagcctgatccacagagaaagaaacaacaggctacacttcacgtgttcaatttccccccgatctcaccaaacacacaaaagttttctcttccctggaaaagagtgagaagaatggatggaagggtaaagactcttatttccaatactctgggaaaggcagaagtgcctcttttgtgggccaggaagtaactgtggaaagtgagagagcaaatgttaactcttacagtgtgtaactttcaaaggcatagatattcttttatttattattttcacttttcttttaggttcaggggtacatgtacaggtttgttacacaggtaaattgtgtgttgtagggatttggggtacaggttatttcatcacgcaggtactaagcatagtacccaatagaaagttttctggtcttcaccctccccacaccctccactctcaagtaggccctggcgtccgtggttcctctcttagtgtttatatgtcctctttctttgtctcccacttataagtgagaacatgcagtatctggttttctgttcctgtgttagttcgcttaggataacggcctctagatctatccatgttgctgcaaagaacgtaatctcattcttttttatgactgcatagtattccatggtgaatgtaccacattttctttatccagtctaccactgatggacatttaggttgattccatgtctttgcaaagtgaacggtgctgcaatgaacatatacatgcatatgtctttatggtagaatgatttatattcctttgggtatcatgaggtcaggagatcaagaccatcctggctaacacagtgaaaccccgtctctactaaaaatacaaaaaatttagccgggcgtggtggcgggcgcctgtagtcccagctactccggaggctgaggcaggagaatggcatgaacctgggaggcagagcttgcagtgagccgagattgcgccattgcactccagcctgggtgacagagtgagagactccatctcaaaaaaaaaaaaaaaaaacacacacacacacaccaaaaaaaaaaaaccaaaacaaaaactaacaatcaccataatatccatagaattcagaaaaaaattcaatttggtttttcacggataaaaaatgtaaaatggtattgggcagtaatttggctgtaacatataacttgggtgatagtcttttaagtgattttggatcactgattttttggaattcggcatagtaacactactactgaatagtctatggtgatccattttcaaccctctcttatgttggtagattattcagaggatcaggacaggaggcaagccaaagtcatattaaaatttaacattataaattatataacaaaaatttttgacctcattaacctgtgactaaaaagtaaattcacttttatttctcaagtcctgacagctgggctcattgagtagactgccgatttttcattttcttgctgtttttctgtcaccaagtaatttctaagaaacactgtaagtatttatacattccacaaatttatcctggtgtttatttgacatatccaccaactttcctcgaaaactcagaaccgctgaggcgcaagaactttgccactctcctctttcagtcttaagaaaaaacagactgtgggtctttggaataatttgctgaattcctacagaaaacaaaagtgtattacagtgcagaaaatggaaatgttaagctagatattagctatcactgcttctacagcccttaggccatgtgcttccctagaagagcctcttcgtcttctctctttaacttctagcctagatatgcataatggatattctttgtttcctctagcaattaggcgctactcccaattccatagagaaaattcctgctcccattccaacgttagttgcttttcttactgccacatgactgaaggtagagcatctctgtcttttaggagaaacgcttgtaccacagggcatggtctggccactcctggtacagaaaagtaatcacagtagttatctacacagtctggccactcctggtccagaaaaagtaatcacagtagttatctgtacatttctatgtgtttgggttatttcattttaaacactggatgagaaacactaagagtctggcccaagtagcattacacctttccattatctgttatacaacgtagattgcaaagagattagtctgacatgctcttcttgggatgatctgttctcacagacttttaggaaaaataagacgttcttctaagaatgataaacaaggattttcaaacagggcagccaaatgcagaggaaaaatttttaagtctgcttaaacttggttctgcttaaaatatacccaatgtaaattactaaacaaaatacttaacacctcgttggaagcatctgttacaatggtggtggtgggaggggtatttccaagaacaaagaatgggaaatggacttagatttgtatgattagaaagactcacaaggcagtccctctcaaaacaaagtaatttctaggacaagggaaaattctcatctctaccctagggagcaacaattacaaacacttcccagactggtatctatctagctataggaattttaaaggccagcctcattggtcaccctactgcttgaagagttgaatgttttaggtttgggaaagaatgacattatgaaatattgcttcatttatatgttttcttcaactagcattactaagacccatgtcatgtgccaagcaatgagcctgcatgaaccctattttaaaagaactcacagtttgataagggagataacatgtgagcaaaactgatcctaattaagatattaatgatgtctaaagtgtgccattcttaatcagcattgtcattgttctagcagagactgctatgtttagagtagaaataaattctcccaaatatttttgtttgtaggttatcttctctggcaattacggttggctgctgtcattgtgtgcgtgtgctcagttcctattctagttgagtggtatggttgttgtgttgttttcaccactctcagctggaaatattctatttgtagttactattacgctaactagccctagatgagtcatcatgatgattttgttttccaaaatgcaatacttatggattccatgacttcaactggaagtagagttcatggcattggaattgggaaggcacaggaaggaatagaagaaaaaatatatgtagtttgtttttaaggttaagaaacagaaatgtgcagagaatatggtaacaaacaccaatacacctaaaacttagaatgaacaaatttgctgactttatgtcatatttatttcaagtttttttaaatgaagaagttaaatattagtgatacaattaaaattattagaacccttcccagctctattctccaattctttttttctcaggtgtaacaactataatgattttggtgtgtgtccctccagtccatgtgtttacattcttaacatatatgtaatggttttgagtgttttaaacatttatataaattatatctaactttacttatctctctgcatcttatttttcactcaaatttgtgtttttgaaatgtatgcctgttaaaagaaatttatcaaatttagaaagaggtagcctgatgtgaaatagtctactacagcggctgagagtatggactatggagccacgttgcctgggttttacgtggctctgagaggtaccacttatgcgatcttgaacaaccttcagagttgttctttaacccctcagtgcctcaatttctccattcataaaatggcaataacaatagcacctactttatggggattatagtgaggagtaaaatgagttaatatatgcaaagctcttaggatagtgcctggcacttattaagcacaatgtagttatttattatctgtatttcacttgggaatgcatattcagtcatagtaggaggagcagtcttgcttggctaatattctctgatttcttacattcatgttaactagaaaaaaacattctgtgttcagagttggattagtctcagaagcaattgggcagtaaatgaagcagaaagagtagtaacctgaacaggatagattaggctgttgcacagcggactggcatagagcgaaatttgtagcatctgctgagaaattgcctgactattctgtgtgtgtgtggcgggtggggggatgttggatttattatatcagcaataccacagggacaaactgagaatggtctgaaatcctattctattttctagaccttcaattgtaaataggtgcactcttgtcatctcaccttttaaatggaaagggcatggttcttggttgagctggaactagagtgagcacttgagactcaagtaaatccttccaggtgtgtaagaggaaaaataactgaaagacagtatgtggagctgggattgtccagtgacttcagatctgtgtcagctctactttccaagccacctgggcatccttagcaggtttcttatgtccaaaaatagccagctgtctcagaaaggtgtaagtgcatttctaaggcagacattgacagaggcaggactttgttttgattgatcttctcacctcatgaatcctttaggcatgaccaagtttcactaattctaatgcaccttgctgttattattgcaacaaagattttaggaagaataaaataatacctgggttgtaactttctaatgaaggttacagagcttaagtgcagagagcgtaagtgactttaaatgcagaatcttaatatttggatcctagcaggccgggcacggtggctcacacctgtaatcccagcactttgggaggctgaggcgggcggatcacaaggtcaggagattgagaccatcctggctaacactttaactaacatttttagtagaaactccatctctactaaaaatacaaacaattagccgtgtgaggtggtgggtgcctgtagtcccagctacttgggaggctgaggcaggagaatggcatgaacctgaaaggtggagcttgcagtgagccaagattgcgccactgcactccagcctgggcgaccgagcaagactctgtctcaaaaaaaaaaaaaaaaaaaaaaaaaaaaaaaaatatatatatatatatatatatatggatgctagcaacaattggaggcattgaatgcacccttttagttggcagattaataaattgagggccagtaagcttgagatgttttttcaaagccccaagtctgtataaagtggctggatctttgaatccagaacttttacctcttagtacacttgggatttgtagacttgtgacctgggttgaaatctagttattttggtcactcaatgcatgaccttcggcaagtttcttaacctctttgactctcaaaattctcatctgtaaagtgattatgatcatccttgcttccatcaaagcattgtgaagtttaaatgaaatagtgtacgtccaaagcgtaaaatataaaaagcatgacacagatataacttatttagtatcactgttgttatatttgatgcattcataacacaaagactatatcagggataaaaataaagcttcattttatatcaccttggagagagatttaaaggcagaagcaaattataccaacatgaatcttacagcttctttggcgtaagaggtatatcttccaatagctattttgttgcacacaaatttttctgacctattctgttatgatgctgtttacagaagatgctatccttatcagttaaatagaaacttttcagtctgtgttgtggactgggataacatgatagagattaatgcattttattgatttaaacttgttttaagggtttcaccagttaccagtaactagactcttacaaagtgtgtggtaatggactccaacatccagactgacttctattattaaaggcttgtgtcactctagttctcagtcaatggtgagcaaatatatactcaatcagggtttaattcctaggacctacatgcatttttatctgtaatcaaagagtaactagtaactagactcttacaaagtgtgtggtaatggactccaatatccagactgacttctattattaaaggccagtcaatggtgagcaaatatatacccaatcagggtttaattcctaggacctacatgcatttttatctgtaattcagagagaacagttgaactacttttaggtgtggcaaccacattaatgaacatcagctgttagtaaaaataacagcacaggcagaaggaaatagtaaaagctcacttaagcactagtgattagacacatttagacataattttgtttctagtaggtgccggactttgggcatacaaagataagtcaacgcctgccccaaggagttcatagtgtagccagggagcaaatatataatcaaaagtacatcttcaaaaataggtgctaaagataagaataattatccacaggagcaaacagagatgaaagcaagttatcattcaagttgcagttttaaaaataaataggcatacacttggcatagaaggtgatgagaaagaacactttaagtaaaagggaaaatgtgcaccgagtcatggggccaagaaagaacatgtgcttcaggctgatgaatttgctctttcatttattccttcattcatttattgatggcctactgtttgccaggtgctattttaattactagagattcagtggtgagccaaataatgttgattttgaaagcttattttctagtgcagaagtaaaacaataaataaacaacttgcatgtgtataatagaatgtcaggtggtgataggtgctataaagagaataaacccattgaggggatagagagtgaaaggaagaactctttggatagagcagttttctcctagggaattgctttttagtaaagaccaaggaagtgaggaagcaagcctgcaaatacctggggaaggtgtatcccagctggaaggaacagcaggtggaaaagtcctgaagcaggaaaaaacttggcatatttaaagaggggcaagaagagcagtgcggcaagagcaaagggaagaagaattgtaagaaaggagattatttggtgtcttacactgtgacatatatttgggaatgaggattatgggaagtcatggaaggattttggacaacggtggcatgagccatttacatttataaacggatccctctgtctgcactatgaaaacagactctaacagggagaccatttagtaggctattcagcatttctggtgggaggtttggaatagggtgataatgtgttgagtagtgacacatagtctgacttggaatatattttgaaggtagaactgtcaagatttgctattgattgacagcgggatttgagagaaagagagtcctcaaaaaggactcaagtaatcagtcctgagcaacgaggtgaagagtgacaccttttactgatttgggaaatagagtaaatctgtgttgtggggtggaggcggcagagggcggaggaataaagtgttctgtttgaatgtgttaaatttcacatggagtagagaagagacattgaatagaaagataaaattctggaatttaggagagactcgggctgagacatgagtgtgtgattcatcagcatatagatgatggtatttaggaccacagaactgtatttagtcatgtaaggagttagtgtcaatatggaagaaaagagatataaggactaagcctgcaatgttctatatttagccatcaggagctaaatcctaccaaaaacccagaaggagtagcttgagaagtagaggaaattcaggagagtgtgataacacaggaattaagtgaacaaagtggcagaaaggaatgaccagcttgatgagagttatccacaatacgcagactgggaatggatcttttgactgggaaatgtggaggtcattggtaaccctggtgagcagtttcgacggagaagtgggtgacaaagtctgatttgaaagggctcaggaaactagaaagtgaggtagtggggacagtgagtatggaaaaatctttctctaagagttttgcagtgaagttgtgtggagaagtaagggaatgtgagatgatgagaacattgtttttatgaaaaatattattagcatatttatatgctgatgagatagattgactagaagaaggaaagctgatgttgcaggaaaaagacggcggatattgcaagtgtaaaagcgtcttcctatggctggcaaatgtcaggcttggaccagtatatcagagtcacatcagactcttgtcaaacagattgccttgtcctgcaccagacctcctctatcagaaaggttctgtatttatattttagaaaagctccccccgagattatattgtacaattagatctgggaacatttgttttaagcaatgtaagatattgcagtggtggcaagaatccattagcttggggtggaaagttagacgttttataaatgtttcatcttgcttcggcttttcttggttttgaatttctcctattaagaatgatcatagcatttgtgactagaggctgctaatggtttttggagtccatgtggtttctttggggagtatttacataagagtctagctctatttatgattagaaaaactttaatcatggattttaacaaatggtttcctgtttttaaaagtgaagattaggctgggcacagtatctcatgcctgtaatcccagcaatttgggaggccgggatgggtggattgctggagcccaggagttcgagatgagcctggccaacatgggaaaccctgtatataaatatatatataaattagttgggggtggtggcacatgcttatggtcccaactactcgaggctgagttgagaggatcacttgagcttgagaggtcaaggcttcagtgagccataattacgccactgcacttaagcctgggcaacagagcaagaccctgtttcaaaaaggtgagggctattggatttggaatacaaaggcctaggttacaattttgtctctgtaatttaaaaactatgtgaattttgacaagctttgtgtgttatttgaaaatgagtgtgctaattctttccttgagtttacagcatcctggagttctgtaaagatcaagtaggtctaaaacactttatgattgataaagacttacacacacatatataatataggtttatatatatcattgttgtgaattgtggaaaacagctttcataaaaacaattatatactgcatgatgtaagtatcttgggaaaaaacattcatattctactacttgtgatgcaaagtaagactgattaaaatgtttatgtacggacactttatatattcacatacatatatataagcatacatagatataaatgtgtatgttgttgtatagctttgttcagtatagctttgttattaggtttcttcagagattaggatgatttctggattatggctaatgagactgtagaaaatgtgttagtggccaggtgcagtggctcacgcctgtaatcccagcactttgggaggctgaggtgggtggatcacgaggtcaggagttcaagaccagcctggccaagatggggaaatcttgtctctactaaaaatacaaaaattggccgggcgaggtggcgggcacctgtaatctcagttactcaggaggccgaggcaggagaattgcttgaacttgggaggcagagtttgcagtgagctgagatcgtgccactgcactctagcctgggtgacagaggaagactccatctcaaaaagaaaaatgtattttatatatatatatatatatgcataggccctccaattcttcccacagcactttcaagtatgtagataagcccttgagttttactagtgtttctctgtactacaactgtgtttcaatctgtgtcccacatattaaataaatcacaaatgagagaaggaatagaatgcatgatacagtaggttgtaccattgtattccatgcagatcacaaagcatttgcaggtgggaaggaggagattatatctggtcttgggaatcatgattttcaaggaatattatcacactagaatgcatctaggggataatgaccaggatattagtaggatttggaatcatgactcagaaggaacaggtaaagactaaaaatatttaacctaaagaagagagattgaagtaggatatgatggtctgatgattttgaggaagtagaagtaggtttgacagatttagtttgaaaagcagctctgtgccaacaggaagtactattgtagagaacacaatggatgttttggctgcttatcaactttgcagtgactgttattgtacaaacagatgctagatgactgtagggatattgcagagggagttaaacatctgatatgaagcagaaataaatgacctatgaagtgtcttctagctcccatattctgtgtcaaatctaagatgttacgagaggaagagctagtgaattttctgagctctaatggagactggaggggaagctacagaggaagacagagatgcaagacatacttggttatgctaaatagtagaaagtatttcagaaagtatctagaaacatgaaacttgccatttgatttctgaagtgtttagataaatctctaggtacgtgctgttctgtcattctcttctgatccaaggagtcagaactgtgtccttggtatatagctagttctcttctaaataacagaaaaaaatcatcctgtgatagggtttggatctgtgtccccatccaaatctcaggttaaaatgtaattcccagtgctggaggtggggcctggtgggaggtgattggatcacgggggtggtttttcctgattgaacaccatcccccttggtgctgttcttgcaacagtgacttctcctgagatctggttatttaaaagtgtgtggcacctcccccttttctctctcttcctcctggtctggccgtgtgaattacttgctccccctttaccttctgccgtgattgtaagtttcctgaggcctccccagaaaccgagcaaatgccagcatcgtgcttcctgtacagtctgtagaactgtgagccaattaaaccacttttctttataaattacccaggctcaggtatttctttatagaagtgcaagtcctgacgaatacattctttgaggccttcttatgtcttcctttgagtggtaaaatttgctataaaataataaaacccttagcacatagacttggataagtgcataaattgggtggaagaagcaagaatttaatttatgggccacttagttaagaagaagtccatttgacatacttaacagctaactgtgctcctaatgcagagttaatgttttatatgtagactcacagattgatgttgcagagagaatctttagagataatttagtcctttcacagatgagcaagctgaggttcaaggaagaaatctgctaaaggcacacagtctcagcacctagactgagaccctggactcctgctgtcattggccaaggcatactctgactctttatatttccatttgtctcctaaatttgtaattcccatgattacacattgagatgactatttctaagttttcctaaaaataagggtggattacttgagcccaggagttcaagatgagcctggccaacatggtgaaaccctgtctctaaaaaaaaaaaaaaaaaaaaaaattacaaaaattaaccaggcatgatagcacatgcctgtggtcccagctacttgggaggcatcatcacttcttatctctaccatcctgtgtataaattggaaaaattttggaactgacccagaggaaagcaccattaaggaggcttttctcacacctagtgacatgtgaggagcaaatatcaactaacacagtagcccaaaactagaaattcttgcacctcttgaagaattgtgttatatcggtgtgatcctttctcttttaatcaacgtatctaaaaattaattaagctttgtcctagtaatggtgtctgtaaaatcacaagtttagcatgctgttttttctactataaaaataattactttaatataaccatacttttttttaacagtttcatctgtgtgtcaactaagataattttgtataccgtgctttgggaattgctgaggaaatgagactgtttcaaaaaactctgcaatgtgtaataataatttcttcttctccaccctccccatctgactactaatatctcagtaatttaagagaaaaaaacatcaatccctacctttgcgtgtgtgtgtgtatgtcatttttatatatttttttctttctccataagggtggaggaaataggaaagaactggaaactaatttgttagaaacatgaatgaatcaggttacaattatatattaactaatgatatgaatcttttggctagaaaaagtgattaagaaaatgtgcaaaataattatttcattccttcttaagtattgatcaggtgtttacaaatttattctcattagatatgtaagatacaaacaaagtgtcctttataaagtttttcttcctgcgatgccaccaaaaagtccatacaaacctagataaacattccaaattcagtttaggagatttaagtctgtagtatgaatactcttacatgatgaatgacactcctgttttgatcccaatggtgatgggagcaatctgtcttgtacacctaccattgtgtttgagctcaacttaatgcatgttgcttgagagacacaataccttgatcctatctgagcgagaatttttcattttagtaaattcatggttttctagtgctttctagccagtgtgcataattacctgtcctccagctctaagaagccttgttattttactctagtgtattgtacaataattataattttctaggtgtgacatgacatgaaaaaggctaggaaatactactggaagacgatggagaacaatgcttgtagtttatatacagtttcagagtttatgtaacatcatatacattaagtctcttgagatacatagcaattttgtgaggcagacatgattatctccataatttagatgaagatattgcagatctaagaggtaaagttgcctgtattagtttccacagctaaaggtggtgtcaagtgaaggcttgtaaataagttcatcacatttttcatccaatgagtcttctacactacagctgccttaagaattgcaaaacttcatgatattaggttatgaaaactcaaaaatgcaaaagcacacaaaacagctgatttttggtacctatgttttatagaaagctattttgaagtaaaactcccttcaaagatgattactgatctatctggtgcattgcagtatgacatagcacagatgagatccttgccatcagagaggtcatggtcttatggggagaagaggtgtttacatatacaaacattgtaatacaaagcatcttgggatatctgttacatggtaagtgtagacaaaattctatggaggaataagagagaaaaaggttaaatagaagtgaagaaggaaccaaaggaagggttgtagaagaaatgtgtttatgttaatgataattctttggcctgagtaaacttttttgctttggaaaacaatttctttaaatatcacatacagaggaatgcacgaatcatagatatacagtgtggtgtaatttcacagagtgaacacaaccatgtgactatgacgtagattagaaaacagaacattcccagcatcctggtagctctacttgttccttcttccagtcactgccctccccaagggcagcaattatcttgcgatgacaccatcgattaggtgcctgtttgaaaacttgaatcaatgaaataatacagtacatcttcttttaatcctaggtgctttgctttgtgttatgtttgtgagatctatccttattgttgcatgtggctatagttgcaatttgttcattttcagtgctataaacataccacacattatcctttttaccactcatgtccatttgagttgttttcagtttggggtttttatgaatagtgttttctatgatcaatctctgtctttttggtaaatatatatatatgtatatgtgtacgtatgtgtatatatgtatataaatgtgtatatttgtgaatgtatacatatgtgtgtatacacatacatacacatgtatacatacacacttatatgtttatatatgtttgtatacaatatccatacacacatatgtgtaatataaacatatatatgcatttcttattgaaacattactaggggtagacttactgagtcatgaaatacacctgtactaacataacttttgatgaagaaaaataaagatggcaaaatacttcagtgatggaggtagaaccatttacaaaatcctgcagcgaaccacagagagaattcagagaatcgtgagcaatttgagtggctatttgagagctaaagtggaaagcagatttaaagagaaacacaagaaacaaggtgagacttttctttagaagtcctgagctactaaaaaaaccactgtatcacttagaaaagtattccactgtaagttacagacttcagtgtcttcatcaaatgaggatggatttttctcaaatactaagtctgaaagtaggcattttgctggatttcacaaagaacttagtatttttttaacttttattttaaattcaggggtacatgtgtaggtttgttaaatagataaacatgtgtcatgggggtttgttgtacagattatttcatcgcccaggtattaagcctgttacccattagttatttttcctgatcctctccctcttcccagcctccaccctctgataggtcccagtgtgtgtcattcccgtctctgtgtctaggagctctttctgtggtatctttagtgtgttgccatttatactctgacttgcttttttagtctcaagatagttgttgcagttccagatatgaagcctaaattcaaagcagcaaaagggtggcagagtgatgcctgccaccctagtctctctttctcctcaggggagtaaaagtttcccaaacatccctgcaaaggcttcttcccaagtctaattaccgaaagtaggtgacttctggctagaagtgaggcatagtattattaagtttggcttgcgttgattatgattagttacctgggactaagcacattgttgttctgaagaaaactgagactctcttggcaaagaagaaaaagaaatggatttagataggccattaaatgggtcttctatagcaatgacggcattggagtgaagaatgaattaggggcatgggttttttgtaatgtgcaattttatattcacatagagaattaaaaaaaatggaaatttgtatagggaaaattaagtattccatttgatgatgggaaactcactaagtctttttatgtgtagtatttttgctctttttattgttatttttattattgtgataataatgatatcacgagattaaaaaatgattagataatatgtctaaaagttactttggcccagcaagtcatcagttacataaagtgactttttaccagcttttccagaataaagtgaaaccagagcgcaggcaagcattgtgagatgctgcaattacaggcagtggtgtaaagagatttctatgatgcataaattaaagcatcctatcataaggctaacagatccaaaatagccccaatttggtctttcatgtgactttatttctatctctaacctgcagttgttgatttctgacaaattaatttgtcatgaaatcagttgagttagtgcacagaaagatagcacattgattcagatgttgtttcaaagccgaagtatgtattgccctacagagagaaagatggtcatatgaagttcttgaggttctttttgttttaaacaagtcttaggaatcaggttagtctataaattccgtttcctgacagttgactccctgcaagcagcaagacgaggttctcatccaattaaggctcacacaacataacttttgtctttgatggtcgtttgttaatatttagtttggtgataaggtggtagaattaatttggcaagagttgacattttctgtattgaatggaaggaaagagaaagaaaagaatcacaactatgtcatttccaatgtggtattgataaaggtggagctaatggactgagagattttcattttatgctgagtctgatgaatgtcttttccgtccaagaagttttgctcaggaagaggaagaagaggaaagaaatgtgactgtgattggaagatacaatttagacctgggttaagcaatatttaggtaactctattttcgtatgtggttattagtgatgaacgttatatttccatattaggaaatattccccagatatttcataatttcataattattgtatctattggtatgtttcaagattatgtattgaaccaatagttacttttatcaagaggtaattaatgaagaattttattattctgagggatattatagattcataatataaatagcttaggaaaacagcatatgagccagaagccatagcttatagttaagtaactggtgttgtttggagaagaaagtgatatagacgatgcttctgttattttagagatcttgtcagcaagcatgagcatggttttccatttagccatctcatatgtccagagcacaatattgtgctgcatgtctcatagcctggcattcattcctactcaacaaaatatgtactgagaagcttcccaggtcccactactctaggtactggagttacagtaatgaacaagttaaaattcccgacctaatacccttacattcttttagaaacatttagttttcatgatttgactaaattgcatactttccaggcagatgagagtaaagggataaaactagaaacaggcttcagttaatctcaacccaagaggttacacataaaatacaattaggattgtacattctttacgtttacattataaacatattataaacaaagcacgttaggcagcatcgattttgccaactaaaacacttaattttgtatacaataccctgcccctcaaagggtccagcaatgacatgaacagtagatgtaaatagtgcagaggccctgtgtgaatgtcttcagaaacaagcatgatcgaacaggcgagcttgagacctgggataatggctcacagaactgaagctaagcactaggcttggatgagcaatgagataggacaagttgatgtttcatgcctaggtgtggtcttggagaaacaacggacaaagtcatctgggactaataagtgaattaagatcaggtttagaaaaaaaagatcaagttggcatagtctttaccaaggtttcgaagcggcactaggaacagctcccaagggctgtgattgttattagttactatggttgctatgaggaagtagaaaataataaatgcatctagctgtagccaacaagtaagaaaagtgaatgaggtaggctagttcttaggcagtaggggatttggaagaaatgtgacaaatatgaaatcacagcactttccaaatggggaaattaaccagctactactcagctccagccagttggttctaggcaggactgcaggctcaatgttactggatcttccagaaaataataataataataatagtaaaacaaatccaaagatgcaggaggaaatccagatattttaagtgaaatctcatgattttaataattttggcaactcaaattaaaacatataaaacacacttgtaaacacagtcttggctctagttccttttaagacagttttggctctgaataaaagaggtcgtatccttgtccatctatgagtgttcagtgtttattcatgacacatctagccatcttacccactgtagcctgatgttctcaaaatataaattatatcatgtttgtctactgcttgtactcctcaatgtcttcccattccactcagaatgaaagaagaacactttaacatggccttcaaggccctgaacagggtgtcttgcttacctctgtgaccttgtctcatgctcttcttcctcctgctcacaattttcgagccacagtattcttcttttacttcctaggctatgccaaacttttccgacactagaggcttttaattttttgttccctcttctgcaacatttccccttgccatccgtgttcactctttgtttttacatggctcattctttcatcaaggcctcatctgaagcaatatgctctccaagaggctcccacggatgattatttaataccaactggtcctcccagttactctgtttgccacaggaccattcatacactgaatgcaatttgaattaaaaaaaaaactatttgctttcatgttaattatctgtctcactcatttgagtgtaaactacttgaggataagaaacgtctgtcttgctcattgatatataactccagtgtctaacacacaggaggcattcaataaatatgaatggatggatcactgcataaaaggacttgaaaggcttatgtcctggatgtgttggtttggtgctgtattctttggacctagatcttctggagcagtgttcctcgaacttaggtaaaggactcactttttataatgaaaaaccgtattaatggccatccactgtcaacttaggttatttttactacgtattatatatgcacgtatatggcataaaattctcttgtttatagtgcgtacaaaatgatgaaactagataatttacaaattaaattataaacaagtctatacagagacaattcaatctaaattagcaatattaatttaatgtttaatgacataaaattatctcagttcagatgcagttatatatttaatgtttctatgcttttatttcaataatacttatacagagaatctgttcacataagtatgttgaataaaattatattactaatttcttggtttttttacttaagggtaattagacttcatacttaactaaatgtttgcctgctagaaatcctaaaatgctaaatgtaatgatatcactaaaaaaaattttggaagacagttaataagacagcattactgaaaactacattaaaatgttttatcaactaattgctggaattgggaacagataaatttcttgttgaatatttgctatttagtcttactatgaatgaattattctaacaatggtattcctagagctgggatttctgaaagacgtatgcctgctaagtaaaatgtcttcttactgtcgaagcattaatatttaacttttcaaaagtctggtgattactccattttctcaatttgaactacctcaaacaattatttcttcaattcacagtgatttaatcttaactttattggagtgaaacatataatacaaaccagaaacattcgtttcaaaattttgtggcaataattagtctccataaagtcaataaagtcattgctcagatgccttagaatatgtctacttctaaataatagataaacatacttatgcacacatgcacacctgtttatagatataatacatacagatagatggatgtttatgtgtatacatataaaatttaaaattttaaaatttatgtgtacacatataaaatttaaaattttaaaatttatgtgtacacatataaaatttaaaattttaaaatttatgtgtacacatataaaatttaaaatccaggcattgattatggagggtggggctgtagaccaatcttgaaacatgtagacttaaattaaaaatacaaataaagagatgaaactcctagaaaatgcattgttgtctttgaactgagctctggtctagaaaatagccaacaagttgcacagttccgggagcaccattcacatggctttctggaattgtgtttcaagaaattacatttcatataaatacaatggaaatagtgccctttgggcctgtgcaatgtgggcctgtcgattcagcctgggagagtgcataaggtccgcccacctttatggcaactgtcctctcttttcacccagagaaacctgctcttctcctatactacctctcacagccgatcattcactttggcaacagtttaaatgataattccctcttacagaaatattcacatcctaaaagttaactgctgtatattatgaatatgtcaataatagaataataaggtagaacaacaggctgtattttgctttttgtggggatatgcgagctgtaatcagcatattttatcatgcactgactgaagggtctgtgtggaatttcagagtctatgtttatatcaggttctagagcaagctctagattaatacaaattgatgttctttttttttttttttttttttttaggaaaatggaaggatctctattggattaaaagagcatccagttgttgagtgttcttttgcatagagatcagaatctttgcacctaagtggtgataatagagagtactctctcagaaaaacactggctttaacagtatcacctgtccccaaagtgcccttctctttgattcaagaccaaaatagagtttgctatttcatctacttaactgggcctctgtggctagtcttcattgctatcagggataaaatcagttccccaatctttcaggctcaaattcttggatttacctttaatatcctacaattttttttatattgatcagtcacatataattaacatttgttctttataatgtatattatgccacaagtgacttctcaagagcataatgtctccttcatatgtacagcaatacgcctgttaaaccttacagcaatttttattttctattgatgtgtggcacagcccatgtgattgttagatgggttacttctctacctttaccacaaataaaatacattttttttcttctagggtactgcttatatattttttctagctggaacgcctttccacttccttttaatgcatccaaatagtaaccttccttcaaactccacctcagctacacttctacttggcaattcatgctggaatgatcattctctgctttgaattcttctctcatttacacaaatagcttgtaacacgaattcccctataccatattttctccttctattattttcgtttatttattgaactgatatttactataatatttgtgaattatctcattttagcatcttgaggaaataaaaccgtatcaggcataattctgttcataaagcctttacacttcagtaagagacattagacattttttttacgtgtggctgttgtataatacgttttcattttgtttggtttcgcttttaagagcaagcaagttacaaatcaagggctgtggaagtttagagaatgaaggatgacagctagtggtggtatatgaatccccaggaaagagggggcatttgaactgggctttaggtatagtagtccattaaaaaaattgtaaatagtaataatgtattaaaagacataggtagatgttaggtaggcagagaaggagtattcttcaaggaggaataacaagagccaagatatgtaagtggctaacataaggggtgctgagaatgaggtgtctaggaatgctggacggcagggttactggcatgcagaacttgtaaagatgagtagtaggaggtgaagctggaaacatatattgaagccaggttgtaagttgtagaagactataaattctattctaaaatatttggactttattcttcagacaatggaaagttggcagcctcgaacaaggaaatgaatcagtgttttaccatgcacattttatctttccaactaggttaaatactattcattttgtggaaatcatatgtgaataataaatattttattaagcttttttatattatctaatatcatccttttaatagcttttgaaaattttattattattttgttttactgctgaagggagtgcctcagaaagtttaagtaaacagcacaagatcacacagctaaaaggcagagaggaatttaaccatgtctcaagattcatactccatgctgttctttttttgttttttgttttttgagacggaatcccgttttgttgcccaggctggcgtgcactgatgcgatcttggctcattgcaacatccacctcccagtttcaagtcattctcatgcctcagcctcctgagtagctgggattacaggcatgtaccaccacgtccagctaatttttgtatttatattacagacaggttgtctccatgttggtcaggctggtctcgaacccctgacctcaagcgatcttcctgccttggcctcccaaagtgctaggattacaggcatgagccaccacgtccggctcatactgtttttctttaccacggtacctgttctcttctctgttgactttttagttttccagtaaaagcttaggttatcatttaataaaataatcttaaataatatatgaatatgtttatattttttctcatacacattttgcttagttcttttcaaattctaaaacactaaggttgcaatctcttctatgattgaggttcaaaactcaaacttggaaactcatagtgatcccaataatgaggtgcaatgttcttaccattctcagcagtgataaggttggcttgtgataatgacatagtagcaaacattgggcccaggagtccccattagttactattcctaaaaatcatcttatcttcttcatgtgactcttctttacttcttcatatttagacaaataaaaatatgcttgaatacccagcagtctttaaggttcagtttattattctctgactataggctctgtgaacaattgagcaatacatgttgcatagtggttaggatacttttgggcagaatttcagaaaatatgactcagcctggcttaaacaccaggggataacgtgattcattttattggaaaatccagacgtagaccgaacttcagggtgggctggtcgagtggtacaactctttcatcaagaactagatttttcttcacttttcgctctgccatttacagtgttactggcttcattcttagattggtttctcttgtggccatggataggaggctgcctgaagcaaacttacactactcagcaggatagtgtggatgccactgaacaacattcatgaaatctctgtggccagagaattattattaattgattggtatagacctagtttatcttaaacaaacaagatgcataggattacctttatagatgtggattaattaggaccttcccctagttggagatactggtaaatcctatcaaaagaaatgactgctacccaatggaatctgaaaagaaagactagggtccagtatacatcaggacaaatgattttttttttcctcagagaggataagtgcatttttttaaaccatccaagctatttatgctctttttcattttcaaagagttttctttaaaaattttatatcaacgtacccttacatgaaatgtattttgaagaatgctgataaaagtcattcctcagcaagccctagagatcttagaaatgaaatttctcttatatgcagtattctgaacaagacatacagcaaataaaaaaatgtcatctttcagcattatagttacttgattttgaggggaggttaaattcagcatgtttttttagaaaaataaattaagcatacagggcattaaccactgctactcctttccctgccttcatgttatgtctgaccaattataatggagccttctttgatttaattttaaacggatcatggagtaattaatctgtgttagctcagcatgcagacaaagaaaacactttgatcaatcaatagtaatgggtgaatgtcacaagataatgcagttaagctggtttggattccattctaggtttcacaatgtaatgagttattttattcttaatgtagaatatatcatgtatggaataagactgtaaatgacttttgctgtgttccatattgctggtgattgggactttggacagaaactttttatgttgcttcagtgtagggagagttgaaagaggtctcagtgtttccccatagtgagatacatgctttctgcatttagcaatgagtctactcaatggacaactttatttgcaaaataccttcgctcttttattgtttctatacatggaagcatcatttgtctcagattcctcttggaaagaggactatcttctctagtaataagcatatcctctttgcactggccagcacagcaattatatgccatttctacaatgagtgacttcctagaattagccatgggctctcgtactgatattcaaaatcttgtatttagaggagaagtgaaggaagttaatgttgatacttaaaggtgattgtgccaagtgaaatgctagaatctcatagtccaggttttgtgggagaaaaataggttttgttggcaagggtgagaagaatggtaaggttcctttgcgaagtcttacgattaagttttttcctctttattctgtctctataataatcaatgcttagcactgaaattgtttcagttgtcgttagattctgtaattccctttctttgtctccatccccacagaaaataattctacttgttggtgccagccaaatattcccagagcactgatgtcctctttgctattatcttttcatcatctgcatggcatttcccccctcctccagcccccaaatccttctttcttctctttctcaatcccaattttgtctttcaaacccaggctggcccatatctgtgccacaaacccttccccagttctcgagtctgtaaaaattcctgattgtatatgctctatagtgtttatagggtcttcattacctgtaatcttattctttagcctaactcatgttaccgtaataatttttaaaatattcttacttcttaatattctaggggatgggaaatgcaacttaaattgtgcaaactccagaaactgggcacagtggaggcattcagttaaaatggaccaaatgaactgggtagcattgtcatgagagtgtaaaacaggattttgtttaaccagactaggttagtagactcatgctgctatttttctcccccaccttactcacacctaccattcaagagtaaggaatctctctttattttggtttgctaaggaagataggagagtctgcagactttttttttccatttatcattttgtttggtgaaagagaaaatagataatgcttaaggtctcccaggtgtttttagttggacatctgaaataaagaagttgactaaatctgcattattaagactccatgtgactttcactgggtgatatgtttcaatgacacctgactcagatggagcctgggactttggacaggtgggcatctgctcagggacccatcctactgctctgtcttttgagatagctgctactgctgccttctgaaaggatgatggtgttagactctaaacatagatggcactgatatagtctcctgtggccttggaagtggaataattccttttagacactggtgaggagaaggagggaggcccaggcatattgcctcttcaaaagggaatatatttcctgtatccagaaaaagaagaactaaaagaagggaagaatttggctttggataagaacactcatctgcatgatgtttcacagtgtttttcaaacagcatgcctcttttaggcttccatattttgatcaatatgtacaaccggagatttattttgccttagtgatgtctgttctgcagaaaagtggactgagcaggttctaaccagagaaaacttttagtaagaattaaaatatataacataacatcaggacaacaccaacagtatgtttcatgcttactggaatatgagaaactgtttcttttgagtttatgcaagtcaacagttacactgaaacagtaatccaattctgaagaccaattaaatactatgatagtttttaaaagaattttctaaacttcatttttctttcagccggtgttcacctttaactacttcaagtatgcttttccacagtctagtatttgaaaattttatcttagtcacaagaaaactgaaaatgattaatagatgatcaaaatatttacatgaagaatgaatacagtagactctttgaaaagttatacttagggaatgatcaagaatcttagatattataaaacaaaaattatacatttgtataattctttacctttacataatattttaacatgttatttcattcaaaccctaaatgactattatggggtaggaagatagtacagtatatactatctactaattatggagtaggaggatatatagtatatagtttggagttgggccaggggctggattctaatcctactttatcatttattagctgtaagactataagtaaattacttaacccacattaataagactcacttttcttatcagtaaaatggagataactgttgtacctgcttcttgggttgtggtgataagtaccaacctggtggttggaaaacggtaattgctcagtatatatgttctatgagaggttaggtagggcaagatatttgcttaaaaaggtcaaaagacttgcccagggttacagagctaaaatgcaatgagattttaggcctaatgcctaccaaggatattttgaatttaacgattcttagcaaagtgaaattctggcttacatttttcataagccagtgtgcttatcagtcacacaaagaggtaacctatggatgcccatgtgggaaagcaattatctccagaattgaaacaagttgtatttttaagtgatgtaaagtacaaccacttagctcctgattaggaaacaccaacgttcttgttgatgacagttttctattgtgtcatgaacctgaaagaataattgatcaaacagcatattaaactatcattataaatatgtggtttcgagtgaagtcatttttaaatcaaccatatgcaattttctgctactaataatttatagctaatttttcatgccagatcaaattaccaatcaaaagtgtgtattttggggccagacttgactcttcccctctctccactcccattctccatttcaatagctgctatacttacagaaactggaactacaatataaatgagtctagtgtttaaaaataaatatagttatacaatcattgggaataaagtatctttatactggtaataatatcgtaccattgtttctacttattcttcatttatcttaatacaggtaactaaaaattgtctataaactatactgcaatagaatttttcttgttattgggaagactttgagccagatatcgttggtttgggcctccagatcccctccactctcccacctctgctttcttcctgggggtctcccctatgtgaactctttgaggggcatgagtgtactctgctgcttgttgggtttgtccagtgggaagcgctggcaggagatagagtgaagagagaaagcaaagtcagtctttattcctctagtttcttccctgtgaagtgacctctggctggccatggcagaatgtcaccgctgccttctgggtagtttacactgtacagctttctcccctggatttgggtagcccctctctcttctttttccgttaagctagtacagctctgctgctactagccctgggttcctacctgctccctgtagtttctctacacctcattcttccttctgtaatcacttcttttgtaagtaaatattcctcaaattatccaaacttaagaatgccatatccttttgggatctagtctgatatcaacttaatcatccgaaagcatttatcagatacttgcttgtatatggctccaatcttgttactcctcctcttaggagccattcaatggctctctattgccttcagagtaaagatcatccaaactcatttacaatttggctataatcagtctttctttactcccactagtgtcctccagacaacctttcttctagcaaaactagactgctaggtacttctctgatcctcagtgtctgacttcagggaagccattttgcttctttgttctcagatcccaaagtttgagcttctttcctgcaattttgcattatgttgtatttgtggaggtaattccatgaaaagtcacagtggggattaataccaacaaaataaacagggggcatattacagatggctgtgaggctgttggacttaatgccattgatcaattcattcattaattatttatcaagtacttcccatatgttgtggtaaaatgatgagtaattcatcagggttaatgtagagtggtggtgggagtcaggctttagactcaaacaattgggattcacatttagattctgccacttttttgttagagacctctgggcttcatttttttttcatctgtaaacaaaaataacaatattttcctcataggtaagaactaaatggtagtcactgggcagaatcatttaggtaaatggatgcagaaaaaagtttcaagattgtagctatgattatttttatgttgtcctgccctttaaaatatagagctcacatgtgatctctgaagccaatgtttaggccatgtatggaaagtctttcgggtgtcatctcacctggagctgcaggtgatctcttggggatcacgttattctattttatgctgtttgatgatggtttgggaagttcatagattgttacattctttgctgagtgggctaggctatttttcagaaatattttatatatctgcctatcattatctatctatctatctatcatctatctatatcatctatcatctatatctaccatctatctattatctatctatcatctatctgatctataatgattttaggcttcaagtggtggacttctggaaggaaattttctgactattaggtcggaatcgtatttcagacacatagaagttgtgttcggtccctgtgaatttccctatcacgagaacagcttttgcactgacgtgtaatcctttcatttctttgtcatttaaaaattatgatatgagaagatttggtctagaaaacatgggcctctcctgaaatactggaatccataatcacttaaagcactctggctttttctgtttggcttagctttacaactttcccatcagtgggtagaaacatctttgaatttgtgctttccttgtattttctgtatttatttcagtatttctggaaaaataattcttggaccaagctggtatttccagtcatctaaggcttgcaaccttgtgcatcatgctctctcatgcccttcactggcacctacattagttgtatgttttgtgtgcatgtcacttttctgtgtcccagtcattccgtttatagattaagggggaaaggtcttccttggatatgggcggaagctctggaaaggctcaggaacaacctatccttaatccttactaatttagagctagaatggaccactgattagggttacctggcgtgctttcaagagcatcatcattctttacaacccaacttgctgaattggatcaatgtaatatttgttctgttttgatttataaactaatggttgaaagctactttaattcaaattatattcaatagtacttgagatacagaaactcaattttaatttacttaagcaaagaaggaattgttagaaggataccaggattgctcacagaaagaagagctacattaatgaggtagatatgggatttcaagaactaggcaaaagactcaagagcccacagaacattctgttaattctcctactctctttgtgggctttgttttgtttttctttttcctttctttctttttttttttttttgagatgaagtttcactcttgtttcccagtctagagtacaatggcacgatctcagcttactgcaacctctacctcccgggttcaagcaattctcctgcttcagcctcccaaatacctgggactacagggacacatcaccacacctggctaattttgtgtttttagtagagacagggtttcaccatgttggccaggctggtctcgaactcctgacctcaggtgatccacccaccttggcctcccaaagtgttgagattacaggcctgagccaccgtacctggccttcctttttctttataccttttgggcatggctgcagtttactacatctgtgaacccaacaaaaaaggtagcagttttctccaaccacttcagtatatggaaattcaaggaaggactctatcatcctagattatgttcctatccaagcaccaatcactgtgacagagaaaatgaggtgctataattggccaaatctgggttatgtgcttaaacttgtggtctgggaagccagtgtcctatgattaaaagccttagaagaattacttgcccctaaaatgagatgagtgttgttcctggaagtagaggaagaaattctgaactgacaaaaacaacagatgtccaatacacaaaggagaactaatttttaaagttttaatttctacatcgttaaacacaacctgttttactttattgcaattatattaattcaaaatatttatttagaaccttttaatgtgccaaactataaaaaggcaatatgatatcattcttatccttaaattaaaataaaatcagtcttcaataatttgccctatgcataaggttttcttctgtgttctgtgtgaagaccaactataaagctgagtggcttacaataaatatttaattcatgctcacacaccatgagcgcttcagggcatgagtctaggtgagtgtagttctgctctatgtttctttgcattgtggaacctttactgaaagagcaacaacccctgtctggagacatgatattctcatggtggagggcaagaacagaaaagcttcagccatccacacagttacactaaaggcttctgtttaatcatggcaaatgtctgctcaccgttcttttggtcacacggccagtgcatatcacatggtggccaagcgcagaatcaatgaggtgggaatgtggttctttcccagagaatgtatgacaagtcatttgacaataaatagagatgtataatcctgttttagagaggaaacatgattcaggacagtaacccaaaatactacacttacaaagtaatattgaattttcactaattcatttcttaagtgtttcagaaatgacatattggtatataagtaataattaccatgagttttctttcacgtagatagaaattagatagagtgtaaccagctaaataatatttctgtatttcatttcctggattcaccagccatgtatacagcctttaatgaccactatgcctttagttaccccataataaccatcaactcatgataagggatggcaagtaatgtcatctggtctagaaaacttgttggaagtaggcatgggaataaattagtgaaagcacaaggaaatcagtgtgtcagccattctgaaggttaggtcaaacttctgcagcttgaggggtgaggtgtggttgataattttaagttacaattggctccaaaacataccttgtatcttgtatttcctgtttcaatcaaacatttttccataaattgaacacaacctaagagttagaattacaaagatgagtaaactcataggctctgaactgaaagaaatcacagtgagtaaaaacatgtcaattgtagaagttttttcaagtacagaaacggcattaaagagaaaatggctaaatctttctggagcctgccatgaaggagagagacatagggagagacttctcagaacaggtgatacttgaacagaattttgaataatgggataggaattatttaggtagaaattacatttgtacttctcaataccaagtaaagagaatagcaagtacaaactcgaaatcatggagacacaggctttgtgtttttgtctttaacacccctggtaggaacgaagggcaagtagtgggaggaggtgaggagacagggctgaggagcccagcagggagagcaagagaattagagaaaatgagacatccctcttcctggagcagagtgtgaatgactctctcccttcctactcttcattcctctgtggaatagctggatgctgttcatgagttttagcttattagccttttgggaatttccagggtgttgtgagtctttggaggccctggaatgtgggctttgggggaacctttggactctagcagaagacagaaatcagagggagaaaaagccaggtgacagtatggagtgtcatccaggtaccatgtggaagtgacagtgttaggaaaggaaatgttaagtttcattccaagtatctgaacctacactggtgtagctggactggatgaccggagaggcctgacccaatacggacaataagggagtgtggtgtctacagatttaaaaatattaggctgggtgcggtggcttatgcctgtaatcccagtactttgggaggccgcggcgggcagatcccgaggtcaggagatcaagaccatcctggccaacatggtgaaaccccgtctctactaaaaatgcataaaattagccgggcgtggtggcaggcgcctgtagtcccagctactcaggaggctgaggcaggagaattgcttgaacccgagaggcagaggttgcagtgagccgagatcacaccgctgcactccagtctggtgacagagcgagactccatctcaaaacacaaacaacaacaaaaacaaaattaataaagtgaaatacaatctataggctttttttgttttaatcagcatgtgcaggtacttgataacatactcttccccttaaaaatcttctgttgcagttgcttacagttgagtttttagaataaatatgtaagcttgaaattctcacattttaaaatcatgtatccttgaacacactgtattctatctatatgaaagctaatttagagacttcccagttccacagtcggtcctcaatacatgcaaactcagctacacatgttcattttgagcataaattagccatggctcagaatatcccagctcactttgagagcagcttatatctatcaattcctggatttaaatagtagatttgaaatcaacaataataacacagtttgtgaagatgaagaagtaatttgagttacttcaattctgtgaccacttgaagagcttttgtgcctagcatttaaatcagtgaaataaaatatgaaccatggtatacaatttttcccttttctaaaaagtatatgaatgtaattgttttatttcttctcattacattatttttattttactgctggtttcattatatatagaattgaataaacactttttcactgtttgcaaatttctctattagtattatgattacaaataattttgttgcatataggagagaaatgttaaaaagtaatttttttctggtgtcatatgtagtaattataccactgcttggctcctaaagctaagaatagaaatagggactcagagaaagctctgttcccgggctgaaaactgcatctgaataaaacattcccaagaagtacatgtctgcaacctgagcgagtatgatgtttatggagcatctaatccttgccaggcaccgttcctagtactggtaacatcacaatgaacaggccttgaagagccatacattctagtggggagagagtgaaagtcatcatgtaaagtaaaatactttaaatgaaacaaccaatgaaataaaactgcactggggataataaagggtggaggagaggtaatttcaataggtggtcaggcaagatgtctggggaagtgccatttgatgagaagccggaggtgtgaaactgtggaggaggaagagtgaagacagaagggtcagccgcagcacaagcccaaggaggtcatgcttcatttgtccagaagatggagaaagggctacagtgactggcgtaaaatgaacatggagaatgaagagattagttttcccttgtgggagaaaaagcccaaggaataactgacgtaccctgataatgatgaatgttcacgacagttatcaaactccgttactaggccgggtgtgggggctcatgcctgtgataccagcacttcaggaggccgaggcaggaggatcacttgaggtcaggagttcgagaccagcctggccaacgtgatgaaaccccatctctactaaaaatacaaaaattagctaggtgtggtggcggtcaactttaatcccagatattcggggggccgaggcaggagaatcacttgaacctgggaggcagaggttgcggtgagccaagattgtgccattgcactacagcctaggcagacagagtgagaacctgtctcaacaactacaacaacaacaacaacaacaacaaagttccattactaaaacaagatatttaatagagccaatgttggattttcaaagcattgtaatgcatttagattgttctcgcatgtcgttttgaattaaaatatcttcagtgctgaattttttaaaaaaacctcttaccctttagcttctggaggccttgaatgacaataaatttaatatgagtaaaaaaattgtttttaagttaaagactgatcttattattggcctttgatgatttcattgacttcttacacattgcctactttgatttttacctccagagaggacattggaattagttacactctccagcgcatcacacatcattatcttggttcagtgaaaatgcatttctcttattttgtcatactctttccctttatatccagttccattccccttcccatcatgatatgcagaatctgatatgtgccaaatatacacacatagctttgtaaaacagataatttttatgtaggcgtgtgttttaaatttacataagtggtattattattgatctcctgactcttcattcaacactgtttttgaagtctatccaggttcagtttattgcacagtgcccactttttatatccattaccttttatgtttccatcccccagtgatggacacctaggttgccttcagtttccacaactacaaacattgtggggacggttattacacacattcctttatagaccttgggtaaatagcacagaacagattctctgggtcataaaacatagagctacttaatttcacttagcctaatttagatcttacacaattctacttagtttggtaaacatacacacttttgtgttggctgagtaggttattgtggaggacaagctctgctattgattgtcctctgggagccaggtttctcatcttttgagaaaaagttacaggtaaagaaggaaggctatcatgagccctctggtatttgattggatttacaggtattagtaggaattcatagtatttaatagatagacatacagagagaaatacaggtgtgtacatgcaggtgttagcaaatgtacatttatttcctagatctattggctgagagggtgtagaaacagaggcactctgtttataatgaacacacttagcaaccagatctaagtttcatttctaaattgcattctttcataaaaagagccaggacaccttagagaagtgctagattgcagcgctggggaagggaaaatgtcagatgagcctggagcatcttgtgatactaaaaaatgaggacgtgcttaaacaggtatgaggacttgtcaaaagaacacaggagcctacctaaaggctctcgatatccaaatctggaacaatttgagcatgaacataatggtagtattagattttaatccacgggataaaagaaatagccgtgaatctatactggtataaataaataatcaaataaatgaatgaatgggggagaagggatcagtcttcttttcagaagaatttctattaataaatgtagaaggaaaaagggaaatagaaaaatcactgttccgcaaaccccacgttaataatgaatgcagataatgtgcctgatggaggctaaaatcagggggaagtttttgagaagaacagatatttgtagaggctcggagtctcctcctcaagatatatattaactacaagtgaaaagacagtaactttctggagaagaaacctggaagatgtcaccttaaccaagtgatcaaagttaatcatcactagtagtagacatattaacatcagctccttgatatgatgtctaagaaggacacagcatgatttttgtggcatcctttcaaaaaaatgcgtagcctccatctaatcatgtgaaaacagcagacaaccctaaattgtgagacagtctacaaaataacccatcagtatactgcagaagtgtcaagattatgaaagacaagattgagaaagtgttgtatgtgatacactggaagagatgaaggagaaatgacaacaaatgcaatttggatcctggataggattctgaaataacaaatggacatcagtgggaaatctggtaaactatgaataaggcctatagtttagttactatggtaccagtgttaatttgctggtttggataattgtactgtgattgtgtgaactgttaacattaaggggagctagattaaggatatacaggaatgctactcatctttcaatttttccaaaaagattgtcattgaaaccatcagacaggaaacccactctttagtcatagaactccatgtctcttatgtattcatgcaaaagggggctgtttgaatttccgtgtcaggacttccccactgtcgggagtgtaccatggaaattggtgtccttggtgaaccctggtccaaggtccacgccctttcatcctctgccgaggaggggaactttagtaaatgcaaatagcaaagacatttgagatgtatatggcctgttgtgctcggtgcctgccgctgaagacttcttttagagcctcttctagatgtcaaagcaaatgtgttctctgagacagctttgctacatgttaagtgtaggacattgacctgggagtcagaagacctgtctttaagtttgagctctgccatttcctagcagggaggcattgggcattcagtggttcttcatgtgcctagtatttttatctttaaaacgggcctgaatcttctattgctaggaattcacaatcatgtagtcctcttttaaaagacaaacagagaccttcctctctgtaagtgtagctgtgtttcttgacatagcatgtcagaggcagccaacctgtgaatatttctttcttaattatggtaattccatataaccttccacgttttcctcttcagcacagtgctctaggcgtcccgctcacctgttcggcgcacagtctggctaaagtagaactctgctgccatcatctggccaattctaggtactgtaaggctgggaaactaacaaaagagtaaacagattcaggaatttacagaatcatagacctctaaggaggtgggagatccctcagaattcacctaagccgatccctttgttaataaggaaactgatgcccatagagggagagtgaactgccttgtgctacttactgatcagtgggagaattaggagcagaacccaggcccatgcagttgaaattaattttccgacatatatgatgataggaaaaagattcgaatactacaaaatttgaataactgaaaaaattctaaaaccttttgcacagggcctctctagattcgtcttcttttaaatttactctatgcagatgttacaaacaattaagaaaaaacctaaaaattataaataagaagagccattatctattgtttgtatcatcttccaacaaaatggatattttaaccctaaaaaaaggcagaacatagctaaaaatatgtggcgatattatattacttttttttctcatttcgctgagggctaatgcaacttctttgctggtataaatgtctgtctacaaaccacatttgagggaactagttataatgaggagaagccaggggctctggattttaataactgggtctgatttcaactcttccataccctgtgagtgtgaagtaatttaaccttgatcagacccctgaccttctttctcttgtcccccatttcctcatctatgctagtgaatagcttcctcacaggaaatttgccaacattaactaagaaaattaaggtaaaattggtggtaacctgcaagcacaataagtatgcttattacttttttataattatggagtaaattgagatgagacaaagaaatttgttaatgatatggagagctctcaggaacccctttcgtcttctgctgaggagggaccctttggtaaatgcaaacagcaaatacatttgagaggtatatacctgttgtgctcggtgccagccactgcatatgtgtgaatttattacatgtttaattttgtctctgagtgcgtgtgtgtgtgtttaagtgctttcctgaggatctcgaagaccacgcatacattctgtgatttgctggaaatactcacaggatttagtagatatcgtcatgtgaatgacataacagcattacagtcaacaagagacttgcctgtatgatggtaatcctataatgttataataccttatttttaccgtatgttttctgtgtttagatatgtttagatacactaatacttactgctgttacaatcagctgtggtgttaagtgcagtagcatgccgtacaggttggtagcctagaagcagtaggctatgccacatagcctaggtatgtaggaggctgcaccatctaggtttgtgtacgtatgctccgtggtgatcgcacaatgctcacagtagcgatcgcctgatgatgcatcttccagtcattaagcaatgcataagcatagttgcactatccactgaagtttattgcagggaaaggaaatataacaggatcaataggggaaaagatactcagagactgtagagattcatgcggaggcttctgatgttttctgtctcctctgagggagcactgagggtgctcttttcttcagcagcaaaaaaacgcagtaacatgtatacaatgtttcttcccaggaagctcattagagacagagcatgcaaggaaattacctgacttgggagtgggggtcggggagggcgacagtcacgtaggcaccctctgcctagcagctatcaaaatttaagaaaagtagctattcagcataaatcgcattgtttgtatagacagtctgtgcacagcaaaccatctttatcagagagagaatggagggaactctccatcgaccaagtttccagacgccagcccagggccaacctttcaagacagacactctagagacagcagcctcagttccactttcttaacttttttctgcacagtcaagataatttctacagattctgagtgtagggcaagtcttgggtttatttttatcaatatggttttaaaaattcatgtattcaccttatatccatatgttaattctcaacttttacctgattgtatatttttagacggtgtttcggaatttgggatttttggaagaaatttaaatatttcactgttgccaggctatttctttgaaaagttaagtcttcagtggactcaaacatagagaagttttatattgccttattaaccagctaatttgcatttaacttaagaaaaagttctgcaaggtaaaaattcttctataagtttttaacaaataattgggatttaatctgccccaatttagatgccagtgaggaatttacattattatacacccacagaaatatcattatataatgttaaattgaagttgtactgtgttatattaattaaaacatacatgatctgtaataagaaagcacgggatatttgggggccttttctcattaaaatcagatcacaatgagataggaacttctcctccacttgatgctttagctttgctcattcagctctagggcatttttcttcttaacagccagacctctcagaggtgtgtctgcacctactgtctctattgccacacctgtttttaacacattcaggcaggcttgcactacccttccccagtccacaggaaaaagctgtaatccagttgtgtaaagcagagccccttctcccaaaggaaacttctgccattcggtccagcaatcctgctactaggtatctactcagaggaaaagaagtcattatgtgaaaaagagacttgcacatgcatgtcattacaattagcaattgcaaaaatatggaaccagcccaaatgcccatcaatcaatgagtgcataaagaaaatgtcatacacacacacacacacacacacacacacacacacacacacacacaccatggaatactactcagccctaaaaaggaatgaaataatggcattcacagcaacttggatggagatggagaccgctattctaagtgaggtaactccggaatagaaaaccaaacatcctatgttctcacttagaagtgggaactaagctatgcggatgtaaaggcataagaatgagacagcggactttggaggctcaaggggaagggtgggaggggggtgagggatacaagactacccactgggtacagtatacaccgcttgggtgatgggtgcaccaaattctcacaaaatcaccactaaagaacttatccatgtaaccaaacaccacatgttccccccagacctactgaaactaaaaacagcaacagcagcaacaacaaaactcatccctgggccccaccctgagcagtgtaattggaatctctaagggtggacccaggcattgtgtgttttaaaaacttctcacgtgcctctaatttgtagtcaagagtagaaccactgatctaagagtaggagtagaaaaaagagggtagtatggcaaggttggagagcttcaccagtgagccgggtttgggttgggaacactggcaggagtcatagtatggacgataataaagcatgttgttttgcaggtagctttgttcttaatttaaaaaaacaaaaacagaaactaacctaaaaaaagaacaaaacagatgaataccagctactctgatttaagtgagttaagggactaaatcctacccacaagctcttactcttccatcatcctttcacatgattccctgtcatgcctagagcttctggaagcagagttccgaaagcacccatctaggtgccagccactgtgctgggctgggaaggtgtcgggtggtttttgggaatcaaaacgcacgactgttaagtgcaactggcagctcataggatatgtgatgttaacttttgggaatggccaggtaagcttgaagagttcatccccaaaagataaaaccataaccagttgatggaaacaaggtatgtcttttattatataatattttgataattcctttgaacaacgacaacaacaactttttttttgagacagagtctcactctgtcacccaggctggagtgcattggtgcaacctcagctcactgcaacctctgcctcccaggttcaagagattctcctgcctcagcctcccaagcagctgggactacaggtatgtgccaccacacctggctaattttttgtatttttagtagaaatggggttttgccacgttgtccaggctggtctcgaacttctggcctcaagtgatccacctgcctcagccccacaaagtgctgggattataggcatgagccaccgcaccctgccaacaacaaaatcttctatcaccctaaagtaacaactttgaacagcttggtctgttcctttctaatgcctttgatattattttccctcctctatacctggggatttattataactacagttttccagcttgctcttttcacttgacacaatagcatgagcatggtttcatatccccacaaactcttcgtacatcatatttttaatatccctgaaagcttttcgtaagccattacagttgtgtagcttctacagagtgcttctcttatatggctgcatatttaaatttcttacattataaatcagttatttgtataattaatatatatcattatcatatgaaactttatacataaagtcctttttaaaatgtattaagtctactgtaggcttttaaatcaaaagttaggggcatttgtacctaatgtcctctcagtgaactgtcatattaaagaaccttggtaatgccttcttaactatctgagagttcttaacttgccaataactctgtgtcagtctattttctgttgtttataacagaatacctaaaaccaggtaatttataaagaaaataaatttatttcttacacttatggagattgagaagtccaaaattgagggggcatatttgctgaggaccttcttgctggtagggactctctacagagtcttgaggtggcaaagggtatcacatggccagggggctgagcatcctgccatactaactcagatctctcttcctcttcatgtagagccaccagttccttcccatgataacccattaaatgcatgaatggattaatccattcatgagtcagagccctcaagacccactcaccatttaaagacctcacctctcaatactgccacattgaagattaagtttcaacatgagttttggagggtatactcaaaccataataatctccgtccagaagaatttatactcccactgttttattgacattagaaattcttaatagtttcagtgtttgttaattttattattttaatatacatttctttattactagtgagttttaaaaacatgttttaaatttcaaaatgaaacaagccatatattttatttgattcattttcttatcatccaataatcattaagtaataatgtgtgtttttttttttcttgtgacagagtttcgctcttgttgcccaggctggagtgccgtggtgcgatctcagctcactgcaacctccacctcccgggttcaagcgattctcctgcctcagcctcccgagtagctggaattacaggcacgcaccaccatgcctggctaattttttgtatttttagtagagacggggtttcaacatgttggccagactggtctcaaactcctgacctcagatgatccccctgccttggcctcacaaagtgctgggattacaggtatgagccaccgtgcctggccaagtaataatgatttttaaaaaacatcttccccacacttctgcttacacacatacttctgtttagggtcagataactgaaaagtgaattcagttataatctcagttatatagcttgtaggaatgagaacataaaatttctttaaattaagaaataaaaaccacatcagataaaaatactgattaggatttgatagatactagtttataatttaccttataaatatgatggaattccagtcactattaatccttcacaggaattttgtactcttctcttactttagggtatttaacctaatttgggtatgttctatagtgctcaccatttttgatatcacagtgccaatattttcaattgtcattataaattaggcaaatgtgttccatgaagattctgtttaactttctttttgatgatctcaagcctgaatgttttgagctggaggtgtgcatgtggatcatttttttggcatgtctttaagcatgttcctcccagtgtaattcaaggtatatttgttattcaaaaataaatgttttacaatgttcatttacaaaaatcccattgttaaatgattgcattttctgaataagcttcagcctgtgaaaaaatgtgtcctgtatgttatataggttatcacattgagtaaacattacttgaaacagatcatggattatagattttaaaactggcccccatatcacttagcacaaactgtgagccataccacatgcttaatgaatatatgtactctggataaaaaagaaaggtgcaaacacttagcagtaccgtatggcaggaaatacataggaattaaaaatgcttaactttttgctccagttcagttaaagtgattgtgagaaattcattttaactctctaagccccatgattcttgccctaaccagcttagagtgctcttgaaagtagcaaattaaataatatataagaaaaaagtttccaactgtaaggcactatctaaatgcaagtaaatgcaaagtggatatatatatatatatatatataaatatatgtgtgtgtgtgtgtatatgtatatatttgttgttgctgttgttgtttgtttttgttttgtaaaggggtgagtgtggagctacagaggggagattcggaaagcgtctgtagcctgtgcttgctggttgcagagcacgtgtactctgcttgcgggtttaaaggcacttatgtgacatttgtttcagagttgattctcagagacctgatacatgagccttatattccactgtttttcagtggacatcctgaacttcgctgccattcctctagctccgctctgaggctgtgggcaaagctcagacagagaactcaggcaggtttctgaatttagaaaaaactccctcttcctacccgaacttaagcatgagtaggaataaaatttgtgtgatccaagtggttagttcagctgagtcttttggaaaaggaagaagttcaggcaaggaagaaaaggttggagcatgctttacattttctttgcctattatgactgagatcttgtgcttgtctttctcattaggtccctaacagtcaacagagtgttccctaactcccccctcccacaaggtagagttggttacctttcttctcacccaccaactcttctttgtaagtatttgcattatccccatatcgtaaatgtacttatgtctgttcatcctgcatgactcgaagactagattgatctagatcatctttgtagcttaaaagtctaacatgtctctcagtacatgaaaggtactcaatgagggttttttgaaggatgttgaatcaccttctgtctccttctctccctctcacacacacacgcacacacacaaacacacacacacacacacactaaacatacatgcaggaaagatttcttttcagattattaagaatttttcttaaaaggttgtacaagtataagcaatgccatattttaaccagtcagattaaagcacatacatcttcaaaactattttatttttccttctggaaaccatgcaaccattctaaatttgattctattattaatccactttaatatttgaatcaatgtatgcaatgtgcccaaagacaaggctcatgcagaatgatgccttgtttttgaagacaaaaaagattaaaatgtctggttcccatgggaatgtagccatagacatggaagcaatcaaataagattcacagttttgtaatgttgttactgcacagcattttccaaatcctttcattttgaatgtagcatcataacaaatgcgagttaaacaatttaagttgaccaacttatgtctcctaaataccaggcaattcttttgaaatgaaagagaatcagatgtaggaaatgccaaattttgttgccgttttatttagcattcacaacaagaattgaagctcaatttttagatctgatgagaagtttgctaacttaactaagttggtgaaatcgagcaactccagtatttgataatttaattctgaattgctatggaattctaggaattatgttacaaaaatagacaagatgaagtctctgcatgtattagcctgttttcacattgctgataaagacatactctagactgggaagaaaaagaggtttaattggactcacagttacacatagctggggaggcctcagaatcatggtgggaggtgaaaggcacttcttacatggtggtggcaagagaaaatgaggaagaggcaaaagcagaaacccctgataaacccattagatctcgttagacttattcactactgcaagaacagcataggagaaactgccccatgattcaaattatctcccactggatccctcccacaacacgtgggaattgtggggatacaattcaagatgagatttgggtggggacacagcgaaaccatatcattccacccctggcccctccaaatctcatgtcctcaaattttaaaaccaattgtgccttcccaacagtccctcaaagtcttaactcatttcagcattaacccaaaagtccacagtccaaagtcttatctgagacaaggcaaatcccttctgcctatgagcctgtaaaatcaaaagcaagctagttccttcctagatacagtgggggtacagttattgggtaaatacagccattccaaatgggaaaaattggctaaaacaaaggggttacaggctccattcaagtccaaaaacctgtgaggcaggcaaattttaaagttccaaattgatttcctttgactccaggtctcacatccaggtcacactgatgcaagaggtgggtttccatggtcttgggcagctctgcccctgtgactttgcagggtacagtccccttcctggctgctttcatgggctggcattgagtgtctgcagcttttccaggcacacagtgcaagctgtcggtagatctgccattctggggtctggagtagggtggccctcttctcacagctctactaggcagtgccccagtagggactctgtgtggggactccgaccccacatttcccttctgcacttcccaagcagaggttcttcatgagggccccacctctgcagcaaactttcgcctgggcatccaggcgtttccatacatcttctgaaatctagacagagattcccaaacctcagttcttgacttctgtgcacctgcaggctcaacaccacatggaagctgccaaggcttggggattccaccctctgaagccacagcccaagctttatgttggccacttttagccacagttggagtggctgcgacagagggcaccaagtctctagctgcacacagcacagggaccctgggcccagcccacaaaaccacttttttctccttggcctccaggcctgtgatgagaggggctgcagtgaagatctgtgacgtggcctggagacattttccccatggtcttggggattaacattaggctccttgctacttattcaaatttctgcagccagcttgaatttctcctcaaaaatgggtatttattttctattgcatcgtcagctgcaaattttctgacttttatgctgtttcccttttaaaacgaaatgcttttaacagtgcccaagtcaccttttgaacgcttttgctgtttaaaaatttcttccgccagatacctaaatcatctctctcaagttcaaagttccacaaatttctaggatgggggcaaaatgccaccagtctctttgctaaaatgtagcaagagtcacctttgttccagttcccaacaagttcctcatctccatctgagaccatctcagcctggaccttattgttcatatcactatcagcattgtagtcaaaaccattcaacaagtctctaggaggttccaaacttttccacattttcctgtcttcttctgaaccctacaaagtgttccagcctctgcctgttacccagttccaaagtcacttccacattttgggtatcttttcagcaacaccccactctactggtaccaatttactgtattagcacattttcacactgctgataaagacatagctgagactgggaagtaaaagaggtttagttggacttacagttctacatggctggggaggcctcagaatcatggtgggaggtgaaaggtacttcttacatgccagtggcaagagaaaatggggaagatgcaaaagcggaaacccctgataaaaccaacagatctcatgagacttattccctaccacgggaacagtatgggggaaactgcccccatgattcaaattatttcccactgggtccctcccacaacacatgggaattatgggagtataattcaagatgagatttgggtagggacacagccaaaccatatcactgcatgtgtggatttatgttataatctagaagagagtgcctagcttttgagtgtataggaatcatacattctcatagtactacctctattcactgcagtatggttgaactgagtctccaagatatttactaaacatctatatagctaaaccctgcagggtgtaattcttaccttgcagtccttatctgcaaagagttcatacataaaatgttctaggtggtggtatttaagtcatttcatttttttaacttttaaattatttttaaaaatttttgtggatacgtattaggagtatacatttatggggtaaatgagattttaaaataacttaaagaatcaaattagatcatttcacttattttaaaaatgtattcatcaatttttttctacaataagcctgtatcacatttataataaaaaagattaatctttggaaagtatttttaatgaggtattcaaaactatctaattgcaatgaaactccattctctagcctgcttgacagcaggctttgggctaagatatctctaagtctcagatgacctctgcctcttaattccaagtttggtcagtggcataacaaatttggttttccagtttcttttatacataatcctgaaagtagaaagaaatttttgataactgtgtaggtctaaaacataacaatacatttcgaattttagagcataattacatttcaaatattttctcttgtattcttcataaattgtgaaaatgtaatagacattaccatgtttttatcatctctcatattttgtcatatacccagaatagtgatacctaatgtatcaatcatcttttcagagtttaggtaatgtgagtcaggttgagttgataacatattatggacccaaaagaccagttactggctttaggggaccacctctgcaaggccccacttattaaccactttgcttctgtcttgagcatcccatgaactgtgtgaagtatgttttcatctttatgatttttaatgcatgtatgtggaattgtgtttgagggaccaatggaactgttgacatttggtatcatggaggcgtgtggttattctgaacatattctcagttacatctactaatattctgcagaaaatcttagaattatttatgatagaaacttaaagccatctaaatatgcagaagcatggtaaagactaagtgcattagagcaaatcattggaatattattcagttattgataatgttataaaaagtttataacaacacgtatgtttatatttagcatataatgttaaataaaaaagttataaaatgttatcattgcatctaatcccataaacacaataaactgtgtagagattaaagagatcctgtgtgcagaaggggccagccctgaccatctctctgtctaaatatatgatgttatcatttctattctgctgtaggtacaccatgttgatgcagagtttccttgcaactatttctcttcccagaattccacataagatttgggtccaaaggcttctgtactctcagtttcttcctgatcaagagtttcaatcttcttgtcatcaccccatctgagttgagaactagagtgacagagtcatcagaaacctaagaggctcagagagcttttgatcctcttcttgtcccctctccgaaacagtatttctcctccaaagagtttctatgtctgcattttatgtggtggaaactttctgtacatcatattattcttctttccaactctataggcttttaattttaggaagtaattgcccactcttttccaagcaataagtcttatggcttagctttgatgttagaagttcagtaaaagtaaatttctcaccagtaagagaaaatacattgagaattgggggagttttttaaaaaagtattctccccatttgaaattaataattaaaataattattagagaaagtggaaatattgtaaaaactgagatgtccaagcccacagacatccagaatagatgttgagccttgtaatgtccgtcttattgttgagctcacaattgattgtctggttatgtaccagacatcttctgaatgtgtcacctggcctgttctctagtgtgacacctttttctcctcagatctgtagtaattaacaatcagtatcattttaaatttttggtgaaattatcgctaatggttttgtgtcctttgtcattttctaaaactttctttgccgtgtgaaaagggctggaactatgtagtctgagaagtatgcctttgacaccttgctgtgtttctctccttgcaccatgtttatcagactacaaggtttaagccctttttaggtttatgaagtaagccttttattcctgaatttttttttctccttgtacttttcaattatttttccttattttagaagtatctctctttttgagtgcataacatttctagactgtatttgtaccagacactccccatgttcattttattctgctgacgaaacaggaaaatctttgtgtttttgataaggactgtggaaatagaacatgcaggcctttcttgttaagagagatgtaggctggcgcagtggctcatgcctgaaatcccagcactttgggaggccgaggtgggtggatcacgaggtcaggagattgagaccattctggctaacacggtgagaccccatctctactaaaatacaaaaaaattaaccaggcatggtggcacgcacctatagtcccagctactcaggaggctgaggcaggagaatcgcttgaacctgggaggtggaggctgcagtgagccaagattgcgtcactgcactgcagcctgggcgacagagctagactccatctcaaaaaacaaaacaaaaaaaaaaggagagaaatgtagatatacatctttaactttttgccaaattttgattagaaaggaaataatagaccaaaagtattgcatggagagaaagaaatatctttggtcctaaatatgtattatttacatagatattatacttattaaaaatacttcaagtttatagagaaataaagtttaaacccagattagttaaatttgatttaaacaaatggattttgctaactaactgatcaaggcaaagatcaatatgagcgtgaaattgggagactaatcccatgggtcttcatgctaggagagctgagcccaagccaagcaagagacatcccctcatcccccaataaaacaagcaaaagtgatcacagatcagtactaaatcctgacaaaaaaaatgcaaatattctctgaaggaaagcaaacatagttaatcattttctaataataccttaaagaattaaagtgtttttacttccattttggaattcagttccctaggagacaaatagatcctcagaatgtaaagatattagatagaatcagatatgaccttgaagttaaatgtgaccaaactctccaaattttttttttaaaaaggggggggcattcttaatgacccttcaagaaccaagaacttcatatattagaatggtcagtttcagaataatacagagctatgtataaaatattttaaaagtaaaatttataagtttagatatagaaggaacaaaagattttcaaatgtgatcaaattagtttcccaaaagaatcaaatacaacttttaaaagtgaaagatataattgaaattaaaaacccaatagatggtttggaagtatatcagacacagctaaaagaaagaataaatgaaaagggagacatatatgaagtgattacccaggtcataataatgcagagaaggaaggtagaaaatatgaaagaaaagttaactgatatggaggacacaataaatatctaagctagatccaactggagtcccagaacgaaaggacaaaggcagttgagaaaacaagtaactgaaaattgtctggaattatggaaagatacgcatcatagatacacaaagaaacaggcacattaggtaggttaataaaaaatatgcatgtatatacaataaaatatttgaatgtcaaagaaagtatagtgaagttttagaacaccaaagaaaaagagatcttaggagcagctagagagaaaagactgatcatctgcaagggaacaataattaggtaaagagaagacttctaaaaaatggaagctgaaagaccggagcaatactgtccacattttgacacaatcacggacaaggatgctgagtggagccacataggctgtgcactgaacaactccagaggggtgtgattcacataggatttagtttgtgtagtgttccctggagttggccaatgcagcataaaatagaattttgaactcaacaaaattatctttcaaatatgacctgtaatttttcaggaagtagaagaggaagcaatttcagcctcatatcatgagaccaatagaaccctgttactaaaacttgacaaaaatacttaagaaaattagtagagactatagcacgtaacacagagccacaaaaaatccataataaaacactgacaaatcaaatccattaatgtatcaaaaggagaataaattatggctaagtggagtttgtccttagaaaagaagtttggtttatcattaaaaactcaccaatctatgcaattcagcatattaacagaataaaggttaaaattcacatggtcaactcaacaaatacagaataaaaacatttaacaaaattaaacacccattcacaaaaaaatctcctagcaactgagaaatataaggatctttctcaatttgatagaaaatatgtaccaaaaaaacctatagcttacctcaaagtgaatggttaaatatcgatgcttttctgctataattgggaatacggcaaagatatccattttcattacttctattcaatattgcactggcgatccttaccaaagcaaacaggcaaggaaaagaaaaaaaaatctattaatgctgaaaatgtgaatactccataattatctattctactttaaggcaaacattctagctaaaactctttacgcatcaccaggagacacatgtaagaatgtttatagcagcaatgtttagcctagcaccagtctttacccaggttccgtcagtagcggaatgcataaataaattttagcaaattcacacaatgggctattatacagccatgaaataaattaactacagctatgcattactacataggtgaatcttagaaacaaattgttaagaagaaaactgttaagtgcaaaatcctaaatatatgtgatatttaccaggtcttgacatattcattgtgtctgggacttttagtagttttttaactttagtgatctcctaaaccctcaacatgacttatctttagtccattaaatacctaagggtctactaatcatcacaaacttatcttttaatatggcaacctcctgctcaatagtcataatgacatcaaataagttcctggtacagtaggctggtttcagttctcatggtttggccatagcaagccttttacaattttcctgttgtcaagaacaatgtattttatgctgtcagactggtaattctcacagttctcccattctttcagctgtctttaaatcttgtctcttgatacttacaatggcatagaacaaagagagtgttggaaagtcaggagacttggattctactcctgatcattctttatacctactgagttaacctgagaaattgttatgaagtgataaatatctatcattgggcactgtcaatgcagaaaccattgtgtttacactttgggtaaaaatcatatcaataaagtaattcttgtcccagagtaacttacagctccaagagaccaaggaagatacatatgtagtcaccatacaaagtagagcacagatcatgataagagaagcacagatcattctatgaggcttccagtgttggagaaatcacttttcattttgttagtggagactagccaaagcttcatgactgaggtgatattggaaatgagtgtcacacaaaggtgctgaggtgtgttgaacatatacaggaagctgtaaccaatggaaatgctttggaaaagggttctggcaactgaaataagtataggattgacacatagtttggtattttccactctattttaaatttgacaattagatacggaggctaaatgatctcttcactatcagaaattgatcaaagatggtggccagattggtactgtggattcttaatccatgaaactgttacatttttattcagattctaatattaggtgccaacttctctttctatactaagtgaatgactcttgatgattataaagagtaaagcatctttttgttcagttttgtttatttggatgaatcataacatgaatgcctgataacactgtggtcattgtaattgtatagtttatttcatcaaaagttaggatgttaatctactcagtatcctgtgttgagttttatttggtatcctatgttcggttctatctatgtttagtattactggtggcttcccaaatttgctacatgattaaaattggatatattgtcagtctccactttttgctccttaaaaggatctgcagacctatttctgtgtaatgggtagtcctggtttggtacatagtatgatatgatgcttttgtctttgagtctctaagaaaatgagttggaaggagattgctataaaatgacactgaggttattttattatattaggtgtttcttcccttcttctccagtagtttttattcctggaaagggtatcttggtgcagtgggaaaaatgggatttttagatttagaaggtcttggttttggtcttggctttgtctctgctactcttggatttcatcatcttgaaagatggtgtatcaattgtggtcaactcaggagacagaaacctcacagtaatttgaaaagtgagagtttaatataagaattattcattgtaatgtggattgaagtaacagaaaattggctagtaagaagtacaaagaattctataggatgcagcaatagtatatataaatatcagctgctgtcataaggctgagatacagtgtcaaggaggagccctctaaccccacctcaggctgagatccagactcccttggagagggcatgcccatggctgattatgaattattgaaaagtcatcaaagtgcctcacttctgagacttgctggaaacctgccttctggggtacagaaaagcaatccatagggaggtgttgccctcaagccttgctgcagagttgccagagtcagtgctgggtgcaaccgttttctgctgggcactgttggtcaccagatgctacaagaaccaagggatagagaagccttcgtctgtaggaatggggcgttggagaaactgcattctagaggggtccaatgcttaagaatgcataagccctgcaggaagtgagccctggcaggtgcacaggagcttacccgacagcagggtgctgtggaacctgggatgcatggtgtccacattgggagatccatggcaagatgatcactgagctgaaactggggacgcaagcttaccaaggggcttcacattctgggtctgtgagcaccacaatttgtgagtattcccctcacaaattagctgctgacggccatccaaaacaaataacaagaaaatcaatatagaagtaaactggaagcagggagagaaaccacttcctccagcaccctctagtgacaaagcttaatattgtgtttgctgcaaagaacagagacttaaagggttcaaggccattgttgccaagtaggtaatgaaggatggatttgaactgagacacaataaattgataacttgcatagaggaagggacagatccccgcaggtatcggaaggactgaatgagatttgattttaaaagcctttgtgtacactaaaacagaatacaaaaatatactgttgctatagttatgattcactgtaattaaacatgatactgacataaatgtacagtgccagagttggatcagactgattctgctgcagcaagtctgctgttcttgtttttagggaatttattttaagattatatttgggaaatattgcacctgaatttaaacttatttgggtcttctaagctaaactgtatggcatattggtggccattcatcagtataaaaaataatatttattgaaatctaatgatatgccagaatacatttactcatgctgatatttatattactggccctgtttttaaaatgaggagctgaggtaaagtagttttctaagaccatacagaaggaaataatccaggaatcagttccaggtttttcagattctacaacctgtgcctctaacttagaattgaagcatagtatcactcaagcctagtatactgtcaaagtgccgtcacttgggcaaaatgcatatttgctttggacctttcatgtctctgtcctgcttacagttctggtatattgttacccctccctcccaattttcagggggatgtttttcttttatatttagttgcttttcaataactcacacatttgacactaggagtaaataatagataagcagaaattgatttagagttggttgtctagctctaacatcagaaaatgaattttttgcagagtgcagaacaactaaggcatgttcaaaagaaaacagttttccacatccttggtagatttctgcagctcatttcattaagaggtgttttatgctaacagtatgactagactgaagcatggctaataacaggaactgaatttaatagctgcaaggtagaaataacccaagtgtccttccgtggcttggatggagtgtagtacatataaatgtgtgcttatatgtgtatgtgtatacacacatatatatatgaaaatactttgaagaaatgaaaatgaataaactacttatacaaaagcttggatgaatttcaaagacataacattgggcgaaagaagtcaggcaaaaagggctgtgaagttcagaaactggcgaaacgaatttatggtgctaaaagtcagaatgataattacctttgggggtattgcctgagaagggacatataggagactttgggatgctgctgtgtcaaatacttgatctgcgtggtagctatgtaagagtagacatttgtcagtttcatagagaaaagatttgtgtgcttgatctatgtaatattttcaataaaacatttatgggtaaaacttaagtttttaaaaatgggaaaatgataagtatactgtgtaatggtaaaatgatttaatgttaagtagtcattacgtaagtttactaaaaaattttacgtgatgagaaaagagtgcttaggttacagcgttgagaggaaacagattagagtccaagtctgaatgcactgtattattgccactatgtaaaccaaatgtctagaaaatttgtagaaaaaaatgcatcaaatgttagcagtactacagaaatgggtgatttttctttttacttcactaagttttttcagatttcctgcaataaacgtataaacacttttaataatcagctgtactaattattgaaaaaaaatgagtatttggagagcgtcttcatctttaaagaccccaatgtttcccattacctaatgctcaagtactctagaaaatggcaccaatctgagtctgtatcctggattctccctccttctacaaatattccctgtgccttgagcaaattgggttttctcttttgttgttgttaattcattaaacagttttcaagcatcggttatcagccaagcactctaggaacacagcaacaaatgagtggctgtgatttcctttcccttgattactatttcctctactggggaagacaataaataagcgattgtcttaaagactgattaggttgaagatgggaaaaaattaagagtattaggaaagtttatctacaagggagatcacatccaatctaaaggtgcagtattattgctgctaaagttttgtttaagcaaagactaaaaagatgaatagaaatctgccaaatgtaaaaggacaggacacgtgatggtggacgggagtgagaacgaaggattagggatctcaggaagactgaggaattgttgggaagtggtggaagaaaatactgtaggacaggagggaggtgagtcagagttggatgtttcagatgaagatttcagaggtggtgtatgtccatgtttgccttggatgcgagttgtgaggcaggatggaggaaaatattattcaaggtgaggatgccggtggtctgacggctggtgctggatgcgttacacatgtagatgctgacctcactggaaagacaatggagaggagtagaaaggaaagaccatctctgtttgctgactactgtcagactatgcatctttaaagacccacgggaagcagaacttctacgaggccatctgtgaattgcccaatttgatacatgttgtcattcttttaattccatagcatctaatggttcattgcataacttggtgctcaacgagcatttgcttaatttaatgcttccgtgatacatcactgttagaaacggatgtgttgagctaaatgaactgtgtgtttaacctgcatctattgttatgttccaacagttcaggcaaactgaattgccgattctgaaagcagttttgttgagagaataccaatctatgtttttcacttggtatacagccatatagtttagaaagaatttccctgtatttgtgctaaaagggtaaaactatagctttttaagtagtcacttaatgtttatatttctgttcagtgtctgggtatagtctcacttttctgtagataaacttgcaacttcaaatgacaggcatgaattcgagacagatgtctcccatgtctggaatcaagacaaattatatcacttggctgtcacaaagaatgcctcttttgacgttatggagcaatttgtttaatgacacaattgctaggctgtggaacagatgactgtctcctttgttgcttagaattcctggggcactgcagagagccaagcagttgcaaaatgattggtgtgtctggataactctgcagtcacggtgcctgagtggcagaggagaggaacaactctgttctactggtggcagctgttctgccactttagggaaggtgggaggtttgttttctggtggccgtgctgccaatctttttgcttggctaattatttgaatccataggattccaagagcaaactcataagagtttgggatgaactctttaaaccttgccacgtgcaaaacgctgctgcatgtattctgaaagcccatggaaagagaagcgtgagagacccccacctttcagaatttctaggtgaagatatggatctctgatgagctaaaataggaaggtggagtaaaacgacccctggataaggatgttcttggggtgaaggactcaggaaaaggcatctgtttgaattttctagaataaattgggaaagctttctagatgagatgctctaggaagctgggctataaaaaactagtaatagtgtaatttgcaagaacaatggcaattctattcctaaattgcttaattcctggattcaatgaagaaagcagtggggtctctaactggagcgcacagtgtgcaagagaatcaactagatgctaacctcaaatgccccttcctgggattcagccccagaaattctaattcagttgatgttgggtagggcctaagaagctgcacttacaacaaaaaagtataggttatttcaatgcaaatgtctataaatcacactcctctgtgaattgctggtgttaaatatgaaaaggtaacttgtttttgcaaaatggatggtagtttcaaagatagaagagattcttcaggaaagatttaatggaagagtagtaattagtgctctgctttaaagcatggtggaatttactgcccagatactatgtaaattttaacttgaatgcaatctgcataattagtgctcttttttctttctttaaatttctgttacaaatcttttatttaaagaagcgaagctactgttgtccttcaccttaaattttacctgaggacggattcaccgtacagatatttctcctgctactcagagaatccctaagatagagaattcatgaattcaggcttcgcttcactgactggaaggtgttcaagccatttaaaaatacaattctcttaaacgtgttttgagagctaagccgaaacacagtctaattcgcagagggaagcaatttccctcatgtccacgaggtggcgctcgcccaccactcctggcctcctgtgcgtagcaagcagggctgtgatggtgtctagaagctgagagaatctggggagatcctgtcagcattatggcataggcttgtttgaattattcttagaacatagaatgacaatatactctgcttttttccccactggttccagtcttgtctaatgctgaaggtcacattatcttgttccagaagcaatgttaggatcaattggctaactagaagaaacaaagacagtttcacagaaaggcaagataaaaaaaaagacaaaaggaacaaacaaagagggctgagtcaaaagcatggaatccttctaataaacctactgaatgggaaatgttggaaggtgtgaagagagaaggaaattgtggcggatgatgaattcaggtttgaaaaaaagtgagctcaaatctttcttctccttttttcaaggtcagctgtcaaggtcagaccggagagaactggaggggatatgggtgatgtcacacactgtggcaggctgggcgttggttttagggcttggctacggaactcaaggcggccagactgatggtcattttcctatttcttcctcacaatcaactcgttaaagtccatgcaaatgtctgtggtttggtgaagaattattactttattatggcactatagggacttccggaactctgagaatccatggtcctgagttgagaggaggtctgtaagtcctggataagcccagtgcctgacattgggccagcattgcaccttgcagcgccagtgcttctcagccactctgtttgagctctcttgttgctacctgccccacctgctattctcctggttcccataagctacagaaccttgtgtgtgcatcatggagcagaacttgaccatgatggggaatttccatcctggcttattttgtgtgaagcaaataaataattgtgaaaagggtaaagcaaagtccaaatgaaaatgcagattttgctgagctggaaatcatctttaaatttttttgcttgttttcataacttataaggtatattgagagacattttgaactcaggtcttaaccgaaatgttattttaaatattgagccaaaacaaaattattagctgtaagttttgaagcagaatgctgattatgttgcaactgcttttcaaaatcttcaatggcctgaaagatacagttaaatactaacctaggtattcaaagctctccaacaacctttccagccctacttattactactgtcctgcaatacttaagttatttatatttttataaaatatctatcttctatattattatccacatttaaaatctgtatgtaagagcagaaaagaatattccattctatcacaactcagttgtggatataggagctacagtgacacaattgtacaaagcagtgaaaacctcacttaaggttatctctgaatactatgatgtttacgtattttccaaagaggatggatatgcttgaaaatgtctgaatttctctgtgttgtatcaactgaaatccagtcttcccaaataaaactccttctttcagcttaatcaaagatcttgttaataaagatggaagacacggccgggcacggtgactcacgcctgtaatctcagcactttaggaggttgaggcaaagtggatcatgaggtcaggagttcaagaccagcctggccaagatggtgaaaccccgtctctactaaaaatacaaaaaattagccgggcatggtggcaggcacctgtaatcccagctactagggaggctgaggcaggagaatcgcttgaactcggagggcggaggttgcagtgagccgagactgcgccactgcactccatcctgggtgacagaatgagactctgtctcaaaaaaaaaaaaaaaaagatagaatacatgtggctcccatttctctatctgaaaacaataacaggttctttagctagggctcatctcagttaccaggcagcattattttggtaccatctgaataaaagaattcatgtaaatactgagattttgggtttactgaaggttaattcagaattgattacatacaccagtgtgatgatattcacatttctttatcatcttctctccaaagaaaaacatgtgtgtaatcttgacttcttttctctgtcccagatagacagtacatctgtaacttgtttgggcatcttcagattcttttccctctggcacctaaaacttatagaatccaactagactcaccaacatcttagtctgtcttgagtctattatcttttcttttataatattgctgatttcacttaattgtctcatgcatttattcaattaataatcagtagatgtccatactgtgccaagcccagtgctatactggaagcagctttcatccacaaaccattgtttttcactatatagtcagtgcgcaatgcagtgtagtaaacactggatatatatcagcccaatgaatgcacagacatacagaggtgaacaagagacatgtgttccctgcccactgagcttgaatacaagggtcatgtcacagacttctttgaatcattcacctctggcagtttattttgcactacaggtcctctgtcctctgtctctagttggtcgtcctgtgggcaaaagaaagtctcactcaacaatgctctaattttgatctatatagttactgtaaatcaaaattaggcttctaaaatgtatgtacaattgttggcattaaagtgagtcagcagcaatagcagttttattattgtcgttctaagggaaacttaagctataatgagttcatctaacctagagagtaaaattctggtacaagtatggaccttgggattacaaacaggaaaattctgtaatggatgaaattgttcactgggaaaccaggccagtctttgagaggtaattggtacctttccgtatctgctcacaagattctggccttagaattgctaaggactcacttgttaaacaattgtgtttcctaaagtggaatttctcttgctatctcttggacaagaagaaaataatccagacaatcttaggggtgaaactaagtgctgacgtttctcatttgaaggagtcttttcatactggaaatgaacagtgctttcagtttattgcttctttcttcatcctcaaataattgagtaaagaggttctttctgtggctccctgggtctaggctgtgacaataggatgtcagaaaaaaacgtgcaacatcactgggagaggcgttacagggaaggaaactgaggcacagaaggagaagaggctgaccccagatcagagagtcagtggctgaactggggctagaaccctggtttcatgactacctaactaatactttttctactggctaaatcctccctcagattcccccagtcaaagattcatttgctcatgcctttatttatccaacatttactcagaaaaagataaggaaagctgtcctaatttctgtgatgaatgctgttgctttaaagtatactatctcatttcactgaatcttcaatatttataatggaggcagttgaagcccaagaaagtgaaataatttgcccagttttacgtagctagttaagtggcaatactggcattaggactcaactccacaaaataagtctctttttattatgccataaaccattgccggtgcccaaaacagtgttagggattgggaaatgaacagtatttaatttatcagattgaagtcctttatcctagagcattttctacaatgtaagatggggttcctgctgtcattgagcttgcactcaacttggagagaaattctatatcctttaaaatgtaagtaaaactgcaagttaagtgtcatcaccagattggtatatatgatgggacagagaaaagttaccagcctcatgggatgcttacagggactgaagagttagattgtgtggctgacacatagggcatcaattgttttactttcaatttgttgagtgattaatatgtcttagaagagtaaagagagttaggttttcaaatgtggcagatgtgtgaaaacctcttaccatctgcaaaacaagattttaagagatgtcgcctgatatccttgtagctaggaaaaagcggagggttagtgaaggaaaatcgtgaagctcaacacatcaaaattcaaatgtatgattttattgctcacagtgtgtctgttggcagtatcgctacattccgtggatggtatcacactatacatttattccagaaacgttgacacattgttgctctcccccaaatcccatctgactaatcactgattgccccactgccaccgctgttgtcttgtgtctttcacctgagctgctggaaaatactcccgtccacccttctgtgctaaatgctccctttgcttgaaaatttcccagaccacagtcagagtgacgttttcaaaatgcagtgtttttcatttatctcactaattctgcaaaaccattcaatagatttcctgttgctcttataacaaataaaaattgtttttaatggtctacaaagaccatttttttccagtctttgaaaaataacttcctcttatcctttacactctttcacatggcagtcttcctacatgctgttcccaatacctgaaaaagtattcacctgggtacctccactcagcccctggacctcaattcaacatttacttcttccataaagctcccctgactttcctctccttatattatgcttttttttttttttttccatatggagtcttgctctgtcacctaggctggaatgcagtggcgcgatctcagctcactgcagcctctgcctcccgggttcaagcagttctctgcctcagcctcccaagtagctgggattacaggcgcccaccaccacacccggctaaattttttgtatttttagtagagacggggtttcaccatctttgccaggctggtcttgaactcctgaccttgtgattcacccaccttggcctcccaaagtgctgggattacaggcgtgagccaccacgcctggccatgttatgcttttatacaacatgtacctctctggctcacagatgcaatttcccatttaacttacatgatttattcccacctgtctctcccaccactagattgtaagctcagttgaggcaagaaccaggtctgcttttgctcaccattgtatccccaagccagtgaaatgctcagcacatagaaggaaactgctaagtatttgttgaatgattgatccaagaaaaatgggacgattctgattctaggaagggaagattaaggtgtggctttaaaaggacctttataggagttgcattacatggagaaaagtttgatgttcttttcagctcccctgaggatgggtaaaagagctctgcattgtgttggacataaagaaatattgggatgaattaccagtagatgctctaaaatctatataaagaatactgatagtgtcagaatgtaggttgacaggagagaataaaggctaggtcagtgaatttctgaaggggccattgtagtaaacaaagttactattttaataaaagctttaggcaattttaaattcctgcttgagtctttgacttaaatctgaatctgattgccttttgtaatattccataagaatgtgaaaaaggcagtcgatctcatgttggtgatacaatgtcttgggtaattttcagagacccgctgcaaactgcaaaccagtatatgcaactaggtccatagagttagcgttgcagttcaggacaaggtgggggcttacccacacttcatgactcccacatagaaactcttgttttacattcagccctgtagaggtgcttctctcaagccaacctgttctgtttcagttcttttgaaaccggggggctttgtaaagccagagagcctgagagactaagaggctttgacatgttgaagcgcatgcaaactgactttcttggtcacaccaaaagactccactcctactggtcaagcacaaacgttgttattggaatactcacaaatcatcaatctttgacatgaatgtttccttccttagtggagtctgcctgattacagcagcaaacctggtctcctgtctgggtacccttccctggcttttacccttcagaggctgaagcagaaagaggcttattaattagtgatttcactgcactggcaccaggaaatacgaagagcaggaatccttagttctgcctctggactggataagaggagccaaatctattttcctgcatccctgaagatggcttcttctagattggctataagtttccagaaggcttaacatcagacttttgtatccatttataccttctccaattaatttaaaagatgataagtgcaagccttaagtctcacacatgcaaacactgcatactctttgttcttaatgattttaacatctggatgagaggtaagagtagagggtcatgagctatcgttgtaaagttagaggaaggaagaagaaccaaaggtgggaataatactcagttagaatcagagatgcttttatagcacatgtgagattttttaaaggacaataggatctcatcaacgggtgaaaatgagtaaaatcatatccttcagtttcaggtgtctatgtggttggtaacttgtaaaatatgtacaaaaggcaattgaaaatgagagactcaagctcagtatatttgcagatgttcgaggaaaaaagttggattcatcactatagaaaggacttttttagtcagttgaggggatatgactgccaaagaagaacagaattcagagaacacgtttattcagggacaaaagaaggaaggagaggcaggaaatgaagctatacaagggagtgggcaaagagtaggaggcaggccctgatgcccaaggaagctggagactttaagtgagagggattctccaataaagcttccagattacaaagagactgaaggaatagatttggaactgggggttactagcaagtaatttgctcactgtttttttttttgtttgtttgttttgttgttgttgttttttgagatggagtcttgctttgtcgcccaggctggagtgcagtggtgtgatcttggctcactgcaacctccgcctcctgggttcaagcagttctctgcctcagcttcctgagtaggtgggattacaggcacccaccaccacacccggctaatggtttgtatttttagtagagatggggtttcaccatcttggtcaggctggttttgaactcctgaccttgtgatccacccaccttgacctcccaaagtgctgggattacaggcgtgagccacggcgcctggccagtttgctcactcttacacattccactgacttccttaaaccttctggctaaaaggcgatgctacctctcaactagttctctacacaaatagcattttttgttagctccttgtatttgatgaacttctttaacaaagatgatagtatttctattttcctaatgattttgagagtggtattgttagtatttttttgtagtctgcaatcctatcacaggcacttcctctagtcgctagccttttatttcctccattttcccagagttctccctgctcccctgtgcttacttaactatgccccttctacccggcttctcttgctgcaagaccttttaaggaattatacactattcattcataagatgcaattcagactatatcactctcgtccttaaacacctccatagcctctaatttttagaaagaaaagcctgagtttcttggcacagcatagagtgagcactcaagaaattttttacgtagataatttcatacattaatctttgtgtcctttcatatcttcccacctttgtgttctccagcactggaacacagtctgtgttgggagacagcagtttgcgtatagtcagctacccaaaaaagggggatgcgttctagttttttctgggaatgccaccttaagcataacttcacctagaatttcaatctacagggcaagaaattgttgatcagacaggctactcagaaacatgtataatcttaaaagtatcttgaacatgcagttattttgggaaactgacattgtgcaatctaacccagtggctgtccagcctggatacaccttagaaacacctggagagctttgtaaaactaccgaagtcaaagccttgctccagacaaattagcttattcatgattgctcgtttacaacggaggttttccaattgtgggccccacatcagcagcatcggcagcacccaggagctcactagtactaaaatctcttgactccttttgaattggaaatctggaagtaaggcccagcgatccgtgttttactaagccctccacttgattctgctgtgtatgactatttgagaacccctaatttacagcagtaagctctgattctcagtaccactgtatcccagaggcaaagctaggcgcaaaggaaggtgaatgttcctctctggtatggtactgctctacaacaaagtatctaatttttggcccaggaggcttctcatctttattaatttaagtgggatcaccatctacaatgggagtgagcttcttgtagacatggactatgacagtattgtcctgaggtcacgttcttctgtttccttcagagctccaacccctagcacgaggcctggcgtgaagtgagtgttcaataaagacgaggagaaaactttgagaattgcttgggctaactgagagaagtagacgtattcgctgtggtgtgttggtttcctcaaattgtgttgtttcaaaaaatattcttcaaaataaatattctttttaaaaatgccagggaattgtaaaagctggttaagcaaatgttatttatcatttatgcttctgaaaatgtgataacaaggcttagcatggtaacacattgaaaattactctgcactgggaaaacgacagaagcagattgtatcctcagagcccaaacagaagaacaggagaagaaatgcttattttgatttaggcttgatatactttatcagaaaagcaaagctgtttcatccttcagagtaacttgccttttagaaaacagaatttctgagagagaaagacctaaggaagttactaggtacagaggagaaaagtaaggcccaggaggctcatgtatagcctgctggccgaacaatgctgttctgggaccagaaattgggtttccagtacattatctgtgataccacatggtcaaaatggatcgccaacttcccgaaacttgcaagttcaggacatcaccaagcctggggattatcacagtgagcagtcctgggagtaagaagccagatggccaggctcttttagaggcttttgctaagctctcctgtctcttttaagtagttttcaatttcagaattaaaattttcactgtatttcctttagcagtaattacaaattcattcttcatttagcagtcaaagaaatgaagtttttttaaaaaaaactagtgttgcactaaatgaaaaagatctgagataaacccagaatattcccccaacttcacagcctggaatgttcttctaaagctttctgatttgtggtttaaagtagaaaatagagactttatgctttatagatcatagaacattggaacagctgtaaaatcacttaccctgttgaggaaaatgagaccaagacggggataggagctggagttgtccaaagtgtcaaagatggaataattgtgaaaatgggacctaaggccagttctcctgactttttcttcagtgctctttaaacccttcaatggctaagacagcaccactgagaaacatgcgcatagacctgaaaagcggttggataaatgtactgctaaccgcaattaaatggatagagaagccatcatgagttagattatctttcttgttttttttttaatatcctgatcataggggttttaaactaataaacagcattctgggggaaatgctttgagattggctttgcaaccacgacagagtcaaactgtatttcgagtagcacaactgctccttatggtactttaaaatcaactctatgacccaattttattcctaaagactctaactgtaatcaaggagaacaaacaagaactcaaaaaagtcaactccatatgaagattgatcacagaacacttctttcctttcctctctgccaggtacatacacatgcacacacacacatacatgtatacctgcacatgtacacatatgcctgcacacacacatgcacaatctcaagcttactcctatggcagtctgtgtagcacactggtaaaaagtgtgaaggcagcattcaggcttcctgagttcaactttacctgtacactttactggctatgagactgggaagttatgtaacctttccatgccttgtttttcttattccacaaagagcttgatctgtctcagtttttcaaggaaaagctgatgtccttcacttccgctgaacagaggctaatcaaaccacagcttcatcagttcctcactttcctcacttgcacagccccttccaagttctgggaggggctcccggagggtgttcacatgtgttttgttttctgggtttttttatttgcaaaagtgagaattttttttccacaattggttaaggttgctatctttttccactcggccatttgctttatcagtttttctctgtttaagggtggtggattcgtcattgccagttttggctctggctaaggagaagttgaactggggatacatttagcttggttttggtaggattatcatttatgtttacagtcacttactagtaaatcattgccagccctcctgatgtcgaaatggccagaaatactgaaactgcccactgtgctgactcagtgtggggcatggcacaaaagtgcatggcaagagattgaattgtgttgtgaacataccccatggggaggtgaagtgtacaggaattaatcgtgggaaattctcccacgtttcttagctcatatgtgaaatatttgagaaatcaaggaaactgagtttgttttaaaatcaaatttgatactagtctaaatatttacatgacgttagcaataatgagtggtaaagctgaatttaacaattcttaactttcacaattaaaaataagttagtcacattggaggtgagactgatcatctgttttacagaaaatattgttaacatttatgttacaggatgaaaacatttacagacaaaaattataaagaaaaggtattaaagctgtgtctgaattttgtgatgttaatttttcaaatgcgcaatttggtctaaattctttttcttatatttagtaaatatttgcttggtaagtaatttgatatttgtaaatttgtattattttctttaaggagagtttcccaagttatataagcttcaggccacacaaaacttgtttgtccttctgcagttgactatttgtaggaggtgaaagaagacactttgggcctgttttcatctaaaatgaggatcaggagaagattactcccaaatatctttaaggatcattctatatctaaagtactgtgattctgttttctcagcacaatgactggggtgccagggtccctgggggtgccctcaaagacaatgaatctaaaaatgatgaatcaatgccctttctaggaattccctggatagaacatatgtgtgcgttggagcgagggggtgggaggagattgatgacagctggattctcacgtttgacgatctgaagggtaccattccctagaaattgtgtgggaaatcagatgatatggtaccctcagggagttcaccaatgctacagaccaccccgactcacttcatttagggaaggtgtaatagttctctcatgctgcataacaaattattactcaaaacaacacatgctcatatctcagtttcggtgggtcagtaaaccggacacagcttcactgggtcctctactcaggttctcacaaaactgccaagtgtttgccgtgctgttggttctcacatggagctcagatcctcttgcaagttctttcgggctgctggcagaattcaattccttgtgtttgcaagactgacatcctttcttttcttttctttctttctttctttcttttttttttttttttttttttgccagatgtcagcaatgctctctcagttcctacaggaccttgccccatggcccttcccacaggcggttcacaacatgacaatttctcctttaaggccattaggactctctctctgatctgctaaggaggggtcttacacaacacaatccagagagtgatatctcatcatattcatggtctcctacttatgtcgaaggggagtggattatatagggtatgcattttaggggacgagaatcttgttgtgtttttggaatgtctcttattctttaaggtctggccttaccgtcattccttccatcatatgaatcaatactcccacaacactttgaacaagattgtatttggtttattctgacctgtagtacacttatttattaggttgtgttacctccattagactctcagctacttaaaggcaaaagtcatcattcatttttgcatctttgttagtacttaggacagctcctgggacataactggtgtcagtaaacattgaaagatggtggttgaaataagtcccttgaagaatgggaattaagagggagatgccacaggtaagcagacctgatctatgtggtgctgccgaggtgaacggtgatggaatgcctggataaagggctgccagtgggaacagaaaaaagacaacaaagagacattgtggaaacagcatagtgtacatgtgtattgatatgtgtgtgctgtgcttggggtacatgaaggagaggctgtagtcagagaggatgccctgtgcttcctattaaatgacctggtgaaggttaatgctgttatcccagctgttatctgataagcaatgggacaagttaggctgatttgacatgttgagtttagtatttcaacaacatttctagataatagaaagcttacataagtctaagtctagatacaagtctattatacactttatgataatacaagtcatcattggagaaacgcttggtacttgagttgggcaacttgaccttccaaccctaggattctgtgattctatcagaattgttttctgttgagcaggttttgtattttgaactgattttccacttctccctgtcatttttcattacaggaagtagaataacagtataaaaagagtctcttggttttctttagttttctagtcacattggcaatagaaatacaagaataaagtgctatatgctttttaaattctccttcacacgttttctttttaatacagctttaccatcagggactccagctattttgtttctcccctttagctaagatctaatcagctcctttctattttgatttccaagaaaatcaacctgatacaaactttaaatggaaaggtttcacctacaactgcttacaggtaccgctgaagtttctcttttcagaacccagctcctgtgtaagtagggcgagcttatctctgggattcattgtgggtggtaaaggccgtttttgcctttgttagagtgatccaagtaatttctccattcagatctcatttatgttggagttctcaagataactcatatcatctgttccttcattcctttggcttacaggatatcttcaaaataatatctggtgcttggagaaagtgggtggactccattgtgacttgaggttaacatgaaaacctcaggtatctcttgaaatagagaagtgttcagtggaatttaaaaactgttgatattgagcatagacccaattgtttgaaaaactcaaaggttgagaaattccaataacaattatgctcccaatacactggttatagtacagaagcaggttgttgtattccgtatcaacaggagtcatgtctttccttacctgtggtcactaagacccacccaagactaccctcttcatggtggcgaaatgccttccctcattccccctttcaccctagggccaaactcattacttcaggcataataggaccccaataaatgaattgaatgtcttctagccaacttgattattactttgagaaatatttgtacattgtgtggtaactatttagagagtggtaatcaaaacctaaatggcaggggtgaggttgaaataattgcaggcattttgtttcaaagaagatccagttctttatttttcattgagataaaacagataaactttaccatctttactatttttaagtgtacagtttagtaatattaagtacaccgctgtgcaatggatctccaaaactttttcatcttgcagaaccgaaactatacccaccgaacagctattccccattttccccttatccagctcctggaaaccaccaccctactttattcttctgtggatatgatactttaaatacctcatacaagaagaataatacagtgtttgcctttttgtggctggttgatttcatgtggcataatgccctcaagttcatccatagtgacagaattcccttttttttttaaggctgaataatattccattgttggtacataccacatttggtttattgatttttccatcaatggacattgagttgcttccactttttagctattgtgaatatgctgctatgaacatatgcaagcaaagagaaggccaaattcttaaggtaattataatacttccaaaatgagattatcttaaaattgctaatgctatttaactaaaatagaatagtggcaacagagacaagcattttattaccattgaaaatctactctgtgtggctttgaagaaagcatctggtatatctatacagaagtgtatttgtttgttgcaaaaaaatatcttaagggccttttaccttattgtttttccttgagagtattttctagcaaaatacaccagctgcattttttttccagaatggcgttaagagatatcttctcaaatctataaatattgttacctaccttacctcatttgccaagataaacaagcaccaatgtatagtacaacccccacaaaaagtaacatacattgtggtttaaacacaagtgcattaatatctaaccagctttcttttttcttatttttcatggcagccatcacgaagtacacttggccttttgggtaaagtgtaggcacatagttctagagaaggagtaatgcatgtagaaagcagagagattttgtagtattttaaggatatgactatcaatactttatgcaaaggagaaagaggaggagcacataaaggaagacaaggagaaataagagaaaaatgttggagggggaagttaggaaaagaaagaaaggactgcatttttctcagtccacttctttttccaaaatactgcagtatagaggacaagctcctccttccattccatcaaaatatggcctgttctttgagtgatccttcacaagccagtctttaagtggtgccagtgtgctttacagtttaaaattattaatctgcgagggctgttataaacaagagtcagatgtcttaagcttcgtgaagaggtaagttgatgctgtcctcttccctcatctcttccagtgaacttaaatatttcaactcaatattaatttgtgaagtactctttttttcaggcattgtgctaggtgtttggggtgagtagggtaaacatagtttttgcccaaaataaattcatgatctaattgagaaagccaacatatatcagtgtataaataaaagtatttaaaagtgatccatgggtctttaagaaggatgaataaactgactggaggaatgagagaaggtttcaaggaaaagacggcaatggaggtgggtcaaacacagcagaagtaattccagacagaaggattgccatatgcagactcacagagctttcaaagcctatgaaatacttaaaggaacaacctcatatccttcatctaaagctaaggtgctggaataattgattcataaaatccctccttctttctgttagtttgtaaaatatacaggttttttttctctcatattttactgtttcaaagtctgacattgtccccagtctggggaagtacgggattatgcccagatttggacttccttctaccatcttccgaagcattgcccaattatgagaacccaagagaagagtcactgtcaagttttagatcatttatatattaataacattccaagcagtgttttttcttttttcttttttaagacccagatactctaatttatttttcagatggaaccttctcataattatctgtttgacaagtcaggagtataaaaatcaacatcattattagagtggctgctttcagacatagtaatttatttcccttattttcatacatgtgaactgtttcccccttcccttcttcctctcctgattcttccctctaacacacctttaattaaactgactgtttctaaaaggaggaatttagactccctgccttctaggaaatcatggtcgagtagaggagatagacacaattgagacacaaatcaatgtaatgcaaggtaggaagctgcctttcctttggcaaaaccagaaagtgcttttgacattcagacttgggtggcggagggggatcctgttaggagaccacaagaaagttgcaattgagaaagatcttgaagggcttgaataagaaaagcattttctacctgacccaacttgctacacaatattaacatcctttggctttggttggcaaagcacagttgaagttctaagacattctcagtggcaggttatgtgagtgccttgagtctgcactctgatctaagcaaacacaaaatcaagagggatattgtttcagatgccagcaggcatgagaagaggctgtgtcccccatacctacttctctgctggtggctgcagtaagtggctgtctctgtgtttcttggaagtcacacagatgagtgctgctccctgctgccaagtcttagtgacattgatgctctctcagaatggtaccagggaatgcacttcaagagcctctcagtatctgctcttgaaaaaattgtctctttacacatctttccagaaacacatactactgggcactaaatgaaatgatgtgagaaccactctactgctatttgtatttatttactaaatgaaataaatgcctaccatattgattagaattaacgtcagattgtcctatccagataatgcaaatcacatgtcaaagtgttcatgctaatttaaaaattcatctgtgttttatgttcattgagaacctagagtatgtttggcactactacgtacatcatgagaaagtgttaaacaacttacactcttctacttctactctttttttttttttttcagagacggagtcctgctctgtcgcccaggctgaagtgcaatggcagtctcagctcactgcaacctctgcctcctgggttcaagcgattctcttgcctcagcctcctgagtagctgggattatgggcgcttgccaccacatccggctaatttttgtatttttagtagagacggggtttcaccatgttggtcaggctggtctcgaactcctgacctcgtgatctacccgcctctgcctcccaaagtgctgggattacaggtgtgagccaccatgcccagcctacactcttctactcttatagtgctctacaaacgttattgaaaagtcccaggaaaaaaagctagcatttattcagcacatactgcgtgccataaaccatgccaagtaattactataatgtatttttgtatacctcaaaataatcgtatcagtaagtatttttatttccgtttcaaagatgactaccaaactaagagacagtaaattagtaattaacctacgtttctaccgttatttacttaaataattaaaatttaaaatcaagattttggttacaagtcaaatactcttctactcttgagacatttggttcttttaaatcctgatactacttatgtaagtgtctctctttcaaacatagctaaggataaaagtaaatgtgctcacagtctctctagctcttaatatagttactgggatgtcaccatctttcttttgtattacactttttatctcctacaactctcaagtaatttaggaagttgatgaagaatattattatacatactggattgccatcatctaaaatggggtcatctctggggtaaaatataacatctgtttgaagagctacacagatttccaaatttgaagcctaatatattttcaaaagtagcattaaacataatgcaatgttcccttgtagcttcctgcctcatttttcactttatacctgtatttgttcaattttaggtgagtaaagaaaaggatgtgatatttttccctctgacaatactatgaggctcatcactccctagccctctgctgtgctaagtgtggaaactaacagaggccattccagagaccacattggaatcacagactatcagagctaaagcagaccatggagggcaccatttcccccctccttttatagattagggaactggagcctagcaaggggaggaaaagcccaggatcttagaccaagttaatggtaataacaacaccaaatccaggtcttacactactagtccatgctgtgtgttatgtatagccgtgggagagtttgtggatatttatatgtgtttttctacttatgaaaacagataacttttcaataacatttgtaaagagctataaacttggtgagagtaagtgtaacacctatgaacttgatctcttggagctttgtctcaagtgctatttatatccatttaagaaagttgtagtaagacagttccatccccatgtaattttaatgtattgaaatttagtttaatactatttaattttaatgtaatgaatgaatctgattactactctgttgtaccacatttaaaccaattattttcattaaaagctacaatagtacatgactttatagattaaattctatcacagttctcttaaaaaactttcaatagctctctgttgcctttaggatgaggcacaaattccacagcaatgcattctattcgctagtgatttattatgatttctatcatatatctccatatatcttattttcttgacccaataagctggtaacactctccaaacactgttcattcatttattgttttgtttgattgatttaattttattaatcatgagtttgacatatgagaaatgatagtagacacataggatcgctgccctggaggacttccacagcctgacataaccttgatgtttgacacctttgtgcttttcctttcctgtctgtttagaaggcctttctcagacttattcctgggagactgcatcccacttttccttaagtgggcagttctcatgtcactccatggtgaaaccttgtaaggacccttgtaattgagaagagtgtccttctctcctgaacatcccagcacagagcccacctttcatttgtgtttgcttcattctgctattacataaaatatcaggtccatccactagacagtacgttctaaggagagaaattatgttttatttctttatgtctcccatgtgataagcagtttggcatgtggtaagtgcccaatgactgagggatggatgtaaaaggaaaagcacataaatgctttggtagaaaaagttggcaggagaccgcttttcttcctctccttcaccagttcttaccttagcattttaaaattttatacacacatatatgcagtatacatataaaacaacaaatatgtgtatgcatgacaactcaccttgtatgcatcttgtatgtaggatgtatcatattttataaacatatgtatattgtatatgcataaaattataaaatgctgaggcaagaagactggtgaagggataaaaaacatggcctattgcaaagttttattataggtaaacaaagaaattggtaagatgtaaagatacgtgtgtgtgtttgtgtgtgtgtctctctgtgtgtacggtgaatcattgctaagaataaacgttgtttatagactctcctcctgtggcatgtgattcaaattatatatattcaggacaagggcaaattcatatcttcatgaaattttccctagactatagttgttttaaaagataacttgcaggttaatgaatactctagcactgagttgcaagttttgtgtttaattgaatccttgaagccaagatgcacaaggggtgaactaattaaagaaattagttatgtgactatcagatgctgcaacatctaacacatatattaaaggcaatgcctgtcttgaaattacctggtggagaagatcctgaggcaaagtttgcatcctgcctttcagctcctatgtatttttggcatggtgcaccagatgttttgcaaacagcactacctggtgaagaaaattctcattagcattacaaataattctgtattttgatgatacttctatggttacaaaaagaattatgactctcttttcctatgcaataaaccagtgtgagaaattcctactgttctaaggaatcctgttttatttgaaaatagatgtcagatgaacaggatctggggaagtggccagtgaagaaatgcttagcttatatgctaactggggacgttttggggaaagcattaatagtctttttttttttgaagactttataattcatttgatctgacgtgaaacaaatttaaagagggcggggtgaagaaaaggtccgaagaagaaaataaatttcaaatttcggagatcagagctagaatgctagtgtgaccttggaccacttcctcagcagcctgagcttctctttatgcatctataaattaggcatatagtgagtgttgataataactagtaactgtcttactgagtggttgtgaggcttgaatgggaagcttctataaactgtgtcattttgtacctactagcttttgttagaacttttttaaaaagcctaaaatatagtctttaatagaaaaattaaaccttataccagagaaaccactgatcgtagaatcaggaggcctaggctgtgtttctgcttaagctaccaagaactgtgtgacctaaagcatgttgcacctttcttggtcttcaatttcataatctttaaaatgagggcataagcctgaataattcttaaagttctttccattccaagtattgtatgtggtgattccatatctaaatctttgcacgtaaatctttgtcatgagagtctgttgtattcattttggaaatgatcttaagaaacaaaaagtttaagctgtttgcccaggctctctcaataagctaacagcagttatacattagaatgaaaaacccgagaatttagcgacttaatgctgtgttaagtcgctcttctagatacatacttataaaatggctccctaagatggaacactccaaaaagaaaatcagaggttggtattttatgccaatataatttctaaaacactcacacattttagtggctctaggagaattgcttagcaaagctatacatactttaattacacaaattatgcaacagggggctctctaacaaaaaagaaaattagtgagccacacatttaggcctgattctgcttcagaagcaggattaagtcttacccacaattttcaaggaagtagaagtgagatgctatgctattacagggctcagttaggattataaactcacggagctgtcatatcaaggcttacttagaagattttccggtatttggaaggggaaagcatgggcttgctcccaactcttatagctgagagcattcttcacatcaggttttcccaccctgcccagccacatgttttctttgcatatagaacaaaaaagaagagctatcatagccatcactagcaccagaactagcacccttcctctcctactacactgggaccacataactgaaatgtgattcatcaattactaagaggctgaacccaaacttgctgagttcaaatcatggtcattccctttgacagctgtataaccttagccaagttacttttttttgttcctctgtttacgtgttgacaataatacccatttaatagggtggttgtgataataagttgatacatataaagtgcttagaccagttcctggtaaatgataagcacttgaaaaatgttagctttaaataatattgcctttatccagagttatagagaagggctttgtggcacaagattaatgagtcaggtttagttcttctggggactgagggaatctagccaatggcctggggaaagaaggataaccaatgctcttttcactttagttaactactctgaagttactttggaagatgacagaaaatgcttcctactttgttttgtttaagtaatatgatgtcggtgagcactatatttagagtcatagaattttagagtagaaagagaccttagcaatcatctggttaatctcattttaagaataaggaaatagagaccaaaaaagaggaataatttgttcaaagttccgtactgagtaagtaacatcagaataaaaattcagctcaggctagaaacaaatccattagaatgtatttcctctgttgactctcctcactatagaattatctctgtcttttatccaaattattacaaaactgttcaccaacagttatctaagatttcttatctatatagaaattgtacacaggaaaaaaaaataccaaaagccaaaaaaaaataaactaaagcaaaaacctttgaagtccaactatgacagggacagctttatgttgttttgggccatctccccagttaatagacatcttcatatttctttccttcaccaccaccaccacttattcagagatagaggaattcagtttgaactaaaattgggagaacttagcagcttcaagagagtttcgttgagatgagtcatttactctttttttttttattatactttaagttctggggtacatgtgcagaatgtgcaggtttgttacataggtatacacatgccatggtggtttgctgcacccatcaacccgtcacctacattaggtatttctcctgatgctatccttcccctggccctccatcccctgacaggtcctgatgtgtgatgttcccctctctatgtccatgttttcttattgttcaactcccactcataagtgagaacatgtggtgtttggttttctgttcttgtgatagtttgctgagaatgatgctttccagcttcatccatgtccctccaaaggacatgaactcatccttttttatggctgcatagtgttccatgctgacaatctttgctacagctactaaagccattttttttttttcaagtaagcagtcacattgaaaatatttgggtactctagactatatacttttttttcttattgtttagactctctaaaactgagtgtcacacatggttccagaacccttccaaaagtaatcttcattaaaggacttaaatcataaagatcatcagttattcttttaacaatttctcattttatggatgagtaaattgatgtacagaggttaagtgacctttctatggtcacacaactttctcacctactggtggaacacatgcttactttctaattttaaagataatactgtgcatggagtcagttaaacattgtcaagcaggaaatgggatggttgccttttaaagctcctaacttcatgcatgtagtggccactgtcgattctcgtcgaatatctctccacccccttcattgtgttttgtagcattttattgataaaacattttgtaagactttttttttccaatttgtagtcagttttctccaattggttttgagtttttccaaattgtgattcttgtttttcttcctgacaaatgaaatcaaagatactatatgatgagctgtgagtgtgtactgagatttacgtatttctttctttttgccaataattaagtgtagcagcccatttgatgttgctaaaaacaaatacctgaggttgggcatttataaagaaaagaggtttatttggcttgtgattctgtagattgtataagaagcatggcaccagcatctgtctctggtgagagcttcaagaagctttcactcacagcagaaggcgaagggggaacagctagtgccacatggctagagagggagcaagagagagagggggtacaccccagactgtttttaacaattaactctcacatgaactaacagagtgagaactcactcattaccgtggagagggcaccaagccatttatgaggaatctgctcccatgacccaaacacctcccaccaggtcccacctccaacattggtgatcatatttcaacataagagttggaggggattaacatctgaactacatcattgagtctccagatttctctgtgattacttttagtggaattggtagatctcgtgggaaataaccatgactgcaacttaaagtaagtatttccttttcacactctctaatatgagcctaacacttaacctgcagaaggcctgatgtgagggaaccatagcagagctcctaatagcacgatttccacccccgaccattttcctttggttctgtgctcacctttaagctcatcggcttttggttattttgaggtgccttaccccaaactgggatctttcctacacaagaatccaaaagagtcaatgaccatcttccatagaatccactgtagttttgacgaacaacctagtagctttttaccctggcctttccaggggagctttcctcacatacaacttaataggttaatatgttttctttttcttattctcaaataccacaactcagaggaacattatcatttaggttttcaaccatgtgttaaaaatctacttatttaatcaattatgccagcctttacaatacacatttgatgccatatagaagtgtttagctctgtgctttctttccgggttagtaaagatgtgctttccgtgactatctccttgaatcttccatccttctgtcatttctcccacatccccagcaatcagtttcattgttgattcatgattccttattttcccttttttatgtcctttaaaatgaacaaaagttttcccaagtattgccttggatgcagcctataatgattttgattcactctccacccccagcaatgctgaccttaatcattttatagaatacctgtctgatttcttgaaacccacttcccatggtattgctcctgatcttgagtggaaagtctctgatggtgggaaaaccacttcctcattttgcgatgtaatctattccatgggtggaagagaggcatccaagtttgcctctacacacacaggatatcttgttcttagtgtgaatctcttgcacacacacaatactcaagttcttcaaacacttgaacataggcctcactttcctcagtttctctttccccagctctatttgttaactagtatttcaaatggggtcatgatcaacaaggaacaaacagcagggatgcccctgacttagactgtgggtggccctaaatgatgttatcttacctgtttttaacacttcaagaatatgaattgtcctcataagttcattttgtggattcatcatcctaaaaaaagtcatgaagagagctttggatttggagtgagctaaactagatttgaattctggacctgaccccatatttcagacaattaatcaactttctatgacttttagctttcccactgtaacatgtgaataacagtgttggccttgccagggttattgtgaggattaggtaaaataacctgtgtagggcccaggactgtgcatggtatgtagaaggtgtctaataaatcttaatgtccatattagtctgttcttgccttgctataaagaactgcctgagactggataatttgtagagaaaagaggtttaattggctcacggttctgcagactgtacaggaagcgtagcttgggagacctctggaaacttaagatcatggtgtaaggcaaagaggaaggagtcacatcttacatggctggagcaagagcaagagagtgaggggggatgtgccatatacttttaaacagtcagatctcatgagaactcactgtcacaagaacagcaagagggaagtctgcccccatgatccaatcacctccaacctggcgcctcctcaaacactgggattacaattcaacatgagatttgggcacggacacagattcaaaccagatcaatgtcccttctattccctaccctatccttcgtgtccctcaaacacttttaacctataattggaacgcagagttttttgatatttttctgtggttcaaaggatttgcctgaaattatataaggacttggtaaggaaaacccaacaacttcttgactgacatcatactgttaattctccatagtctgtgttgaacgagtgtcttgtagtgaggactaactcaccccagagatacagcttggagactctaattaattatgtttgttatttctatggtgctgcgtagtatgtagctcctggcctaagcattgacatattaacttttttattaattaccggcagcaaaagagagactgaataggaacattaacataagactttattgaaagccagtgtgtaacaaagaaaattacaatgtggagagtaatttgcatctaacatctacataacttgatatagttcactctttggagtccacaactccagactaatatcttaaaataatccctatgagattgttttcctgtgcagttcctggcttaattctgcttggtagaggatttcttcctttgtctgtcagcacaaccataaacatgggcaaattattcaaaatccaggcacaaaagaacaaggcacatcctcttttttgagtttaaatgcaccttccaaggctcagatctcttagctgttgcctgaaactatgatgtttccctcacttagggcataacctttcccttccctagagtggtgtgggtttaccttagggttttatcagggttgcagcagggttttatcaagggttcagtatctgctagatgtacaaaggagataagggaaactctcctagattaaaaccatttgttttttaccatatttatcaaacatttatttcttgttttaatagccactacttaactgatgctatcagagatcaaaggtgattccactattaataaaagcatgcctagggttttgcttaaggtgacattgagattattcttattcatcctgaacatttattatttttaagtcaaagttaaaaatcaacacatgcttacagtgtctatcttatattccaaacactatactacgttcttacaggaggaacaaaaattctaagtcagattcttacccttaaattctgtgtctactcttatacacagatcatttttagcatttttttttttttttggtaatgaattctacttctcttggcatgaagtcaacattctttccctgccttttgtccttacaaaataataaacgcttttggttacttatcttttaaaggccagttacggctatttcctggtcatggccttttaaagaaatgagagaaagaactgtcaaaatgcaatgaggatcatgctgtttttccattgccatgccattagcatactcaaccaaccaggagacaatttccagcctacttttaaataaatctcctctcttaaactgttgctagcttactacaatgtgtatacattacctagagtaggctgatgacctcatgagatcccttgcagttaacactgcaagtttaaatatgattatcctgtccaaaacattggaaaaatattgtttcttcctgctgcaaatactgtttaaagaaatattcttatacattatcttatacctgcttttctggatagctgagcaccaaaatgcatacctatctatatctatctgtctgtctgttttggctgtagacttcgcagacacacagacatctacatcaatgcctccttgatgtcatgttgcaggttggattagtggctaatactaggcacaggggaatattgttttatgtaaaaattacttttaagtgagtgacggatttttattacatgctttcatgtactatcctagaattcttcaatgtttttaatctgctaacaagctctccacatcttgttaaatttttattgggagcaatttcgcttagcctaacaatgctaatttagggatatttaaatgaaatatgctgtatttcctccatacaaacatctgtccactcatctgctgatctgttcattcatttattcattcacactttttctcatttcacaaatcagtgccataatttcaacctattattttcaccaatttaggtcctataatgtagttgtttcacaggcaaataaacttcaactcaggcagacgaagtagctttatgtaaggacaacttatctactctaaattgcatactctttgtacttaacattttactcttagagaattctacaaaattaggacaagaaatgtcctattggtcaccttgtccaaacttccatttgatcctctgacagattttttctaatcagttagtatatttcagttatctccagtaaaatcttactcaacatcagatacctgtgaatgcaggatcagtgagatctctcattaattgtctcttactttcacagtgtctggtgctgtgtgcatgcagaggacaaaaatatgaatttattgtggttttaatagtatattttgagtgtcagtcatgtgctgggtgctgtaagagactgctatttcaacaagatccattccctgaaaatttggaatctaaatttagaaatgagagcaactaggaatggcccatggagaaagaatctcagtgaacatgggtgacagtatgaatgtgaagattattaaaccattttaaggtcattttagtcatattctgagattttaaagttgcctactcattttacctgatgtctgtggctctctgtttgccttattatattccttttcttctgtgaacatgagtgtgtgtgtgtgtgtgtgtgtgtgtgtgtgtgtgtgtgtgtgtgagagagagagagaagagaagtatcagaactgaaaatataggcctagatatggggatgggggtgatcagagcagaaacctaggtaccatgtaccctctgaggatatcagatttaatatttaggcagagaattttagggagtgttgataaaacaaaacaatcaactttggaaatgtggaggctacccttgagttacctgagcttatttcctgatacaaagagttgataccccattcttcactttgggatgacccatgcatctatttggctcaaaaatctgggtggatggattgatgaattaattcatttatttgagtattttttgagtatctggctatgtgcaaagattattttaagcactagagataagaaagtaaacaaaatagacaatggccctgtccttatgggtattacattcaaatagggatcttctagccgagtttctctttgaaaaggaaaaggtgccactgggttagtgacagtgggacttagagtagggctaaaatgatgggcggtctgttgtgacaggtctttcagcatccttaacccagctatgaaggaaaataaccaagtatcaaccatctcctaggtggtataagccaaaccaatgtacatttttaaggaatgaaaatggaggaaatttatatttttccccttataagcttctttactttctgttttaacttagtttccctttgattttcttattgagctcgacttgaattactaaactaagaaggagagtgtttcaagaccaccctcctagaaccaaagaaaacatagtaccctatcttggccaacaatagtaaaaccaggagtagcttcctcatctagaaaaaggaaagagcttcacggggagagaattggggatacttgtttcctctcccttccaacacaaaatgatctcttcaaggtcattcacaagatgtgaaaccatgttagaagctagtgaatggaagtacatttggcattctcatttttcccctccaggttactttagttagggcagtagtcacattgaggttaaaaggcctggattaaactcatagatcttcactcattgattgtatgaccttgggcgatcacattacttattggagtctcagcttgtgaaactgaattattattttccctttagcttccatcataagattgttgaagagtctcagtgagataatacatgagaagatgatttgtaattagtaaagagttacataaatgtatgtgatctgcacattcttattttattgactttattacatgattgtaattattcatggtgttttgtttttgttgacatgcgtatagcacagaggtaaaagggaaactctggaaataaattatatgggtgtgaatctgaactctggcaattcttagctgggtgaccttggttaaacaacttaacctctctgtcctggtttcttcatttataaaatggcgatatgacagaacttacctcatagagttgttgtaaggattcaatgtgtcaataattgtaatgcacttataagtgtgtagggcacttctcattggctcacattaattacatctatgtttcttatcaaaatacctattctccagaacattgaaaatttccctttttgggcaatgataccacccttcatctatgtcataaagaggaattaaatctgttctcttttctgttttggaagatgatcaaaaccagatggacatataacatgtagtaattcagttgtcgaattgttgaataaagcaccatgaataaatttgctatataaaggaatttacaaattattagaaagtagttctttatattgcttttgtcagcctactgtaactgacaatatgtcagaaaaaagcaagtggaaatacagctactttatataataaaattcatggagaaaaggtcttcttccatttgctgtggcagagcccagtgagctcatattcacccgactttgagtcaggggcctgatctcagagcaagatgatgtatgagcagagctagacttctttgtgttctcaagacaaggacactgacaatattccactaatgaaattctgtttgccatgacaatgtcaaggttaatcattcatttcaagtaaattttcagcctttgttaaatacattccaagagtgaatgatgatgtgtatgaatcataaggtgtgttttcctgttttaggaaatctgtattttatggcagggacttaatttaaatggagattttaataacagcatggtcattctcatactttacgttattatcacatcttctttgagtctttcaagagcctagttaggtactgctagtattattatgtatctattttgcagatgtagtttagagaggttgaataacgtgtccaacagcatacagctagtgggcgattaaaacaagagccaagaaagttcataatgtcatgaactggaagcttgttgagggcagagagaatgtggaagtgtctggaatttcacggtaactgacagagccctggatgtaatctgtggacaatgcaatgtttaaaatgaatgtgtaaactagccctaatagtagatttggaagttgaaagacttggcctatgaataagcaaaagaccaaaaagcctctgtttttccttttaaaatgtggagataattaagactgcccatgtttttatttgtttgactagagcccaaaaacatagactatatatatataactaaatataactacataattatcattttgatgtgcatttgacaattttcttcaaagtaattaaaacttcttccactcataatgtcttcagaataggaataagaaattcttaagttgttcaaagaaagcataaaaatcaaagtattggtatccctgggacataaccctttaaatacctggttgttagtttaacctaaatcatcagtaggttggcttaatttcattcctgatcccaaaatgcaaagatattggaaatgtacgagtaactgtggagaaagacttatgagatttagtggcccaggtaggaaacctacgaatttctatatataaaataaattgatttaagcattgcttctgagctcaatatccatatatttaggtcttagctaacttcttaaatttctttatactcacctcttctcactggggaaatggagtaaattatgctgatgatgacttaaaaagccaaaaagctctctgacaatagctgcaggagtgcgagggaaaaagtagtctttgttgtccgattgaatccaaaacactacattcttttaatagagatctaaacacagaaagaatgttgctcccagaaagctgacattgtttttgttctgttctttaaatgcctaacttgatgttgtcaggttaagacagagaggagaacttcaaacagcaacagctacctgccttttcatctttcctcataacttccttctctcctgtgcctctgtattcgttaccttctgcaccagcacaccctcatatctcataaacctacagaaaaaaatcagcaacacaaagactaaagaatacacatcctctttccaggccttttatagggggcgcagggtggcggtgcacaggactgcagttctggagaaatgtactatattttacttttgtcttctagtattatttatgttgcaaacatacattaaactctgacactttgacacctggagaaattgtgaagaattcagattcccaggctctacccatacagacttccacttcgtgttttgagagaccatcaggaatcagcatgttaacaagcatttcagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttgaaaaaaataaaaaagaaacttcaacactatgggacactggctcttttagcatgaaatgacttgagcttttgtagtgatgatacacatacacactcatcagtaaaacgatggtttcataaataacacaattgatgcaaatcataaaaatcaattacaattatgatttcatgacaaaatatatttaattaagtttgttatgaaaaaaatagagatatgaatcactaacaaaattcctccattttcagtggctattcatcatttatcatctagactcacatttgtctccttcctgatagcagttaagaaaaaattctaaccacacaatttgtatattgtttttctccgtattatgttaagcaaatgttcactgcagtaaaatgttttggaaattagctttgtcttatttccagtttagttcagagaattaattggaaacctgatttcttttacacataaacctgacaaaaaatgtagcttagagcaaagggtgaatgtttgcttaactcctgcttacttctcaagtacatgaaaactttaatagaatatgccagtattcactgagtttttaaaaatattaccatgtgtaaacatataatatccaacttcatccaaaaatatggttgagtttaagtactttgtttttcaggcttatttcaagtataataattctttgattttcattgttctgatttctgggtcttcaattcattcgtcacttttcctttttaagtaaaataagcttttttttttttttttttttttttttggagttgcattgggatttttcccaggaaaaaatatggcttttagtaatgctttgcaattggctacgcagatataaattaagatatgtttattctgagttcttattggaataagtttcaaaatcaacgagcttaagaatgaaaacaaaacttttgagagtctcacaaaatagctttctggtcaatacaccttacttgatttttaagctcgcagaataaagtatagaaacaaatggagctgaagttccatttgctaattcagagacttttgtgcttccgcaaattggagggcagcaagccatcctattctcatagtaatcgttttggctttgaaatttacatacaatttaatagcacatttttagccattatggattggcgcaataaagagatatcaatgtaatgcaatgtgatgctttatgggcctcattctaattcagaaagcttgtttaaaagaactaagactcttctgtttaataaaatagcaacaatctaatatctagattggtagtcctgcggtgccactagtgggagatgagagtattaagacaagagtaaggacaaggaaagacttaaaggttgcatattgaaaagtttggaattcctaatttgggagcactgatttcttggtgaagaagtaagtatgactacgttgccagtaattttttaaaaacatagacccagaaatagcaaatcgatttcaccctcataccttagtctacaaggccttgctcttgagaaggttttccatgatattgcttaatttcatctgcacaagatgagacacaaacataaaaattccctgctcattttaataccataaaaggctgaggttatttctctgtcataaaattgtaaatagcattttttaagtcaaaattacatttaaaacagtggattgttctacaaatatatatgtgtatatatacatatgcttctgaaataaggatatattatatgagtttttatttgatttgtggtctttagtcataggtaatcaaaaataaagagatttgaatgcaaaactttatacattaatgtacatttctaatgatggtacaaattgccactttataataaaaaagaaacaggtgggaataataatcaaagcacgtgttccttcagtactttggtgatttttaatcccccttgtgatgcacaggaaattattttttagttacaaaaagttatcttagaaatctatacttcccaatacagatttcatgttaagtcatatcaaattgagaatttgtggtgaaagaataggaaaaggatgctagatgctgatctttctttttcaggatttttcctggagcccaagttaaaaattcaatacttaaatctaagttaagtgaaaattaataatgttcagaatgatgtattgagctttagtaacagacggaagcaaaaaaaaataagaatatttaacattatgataatagccttaaaataatgtaataaaaattgcatcattaaatgttctattagttggaaagaatgagctgatgtttctttgtctttgctccaagtacaatttaaagacagtgacattcattttacttaaaattgttcaaaaagtccaaaacatactcccatggctagaattggtattagctccaatacaaggttaaatgttacaatcttaagaaattattgacactgaaatgtttagtaaacatgttgtatgagaaactaaacaaattaatgtttcatttttccattaaagcacagattattcaaatcattgttttctgagctcagatttgtaaaacgtttatacatcattaccctcctggaattaaaaacaattaaaatcctgagatgctcatgcacgtagacgaaatactggcacttttttttaaacattaaacttctttgagaagtctacctttttttttttagtgtgtttatcctatattgctgaaaaagcgctgtgtctttttaagaaaaagatcaaaaattgatttacagatgggaaagatgtctaattttgtagaagagttgaaagaaaagtaaatgtttctttgtaattacgtagctacttgtctcaacctgacatcttgctttcaaggattaagaactaaagtacgttcatttattcttttattcataacataccaactagaggctcagttgagtttaggcatcatacactgaattgcaatctcaaaacaacaacaacaaaggcagacacataaataaataatgcaatacctaaaagtatgtgctatgataaatgcaaaaaagattttatataccactgaggaggcaacaaaggcatcatcagggattagaggcaagacagcgattgaaaaagaacagatatttgctgagtgataaagggggacgacaaaggcctctcaagtagaggaaatcatttgaatgaaagatggatacttggaaaacagggcttggttgggaagaatgttcagaaaaggaggtggaagaaaaactgagttgagatcaataaaaacgaaaagttactcaaaggttttcaatacagcctttgtatttgtttgaacatctgtatctgctaggatgcttctggttgctcagacagaatccccaaaccaaactggcgcttcatctcgaatatctaggtacacagcatcaccatcgaggcttactttgtagttctctcagctctgtccacctccatgtataacttctcccttagaggcagaatttcctttagtagtttcagaacctgcatgcttatatcatctattctctattagaatcccccagacgacatcttacatttcgttggcctgatttagatcatctgtccacacttcagtgactgaccatggccagagacttgagatatgttgactagtgtaagtcaaccaagacctggaggttggattgtcccccaagatacaagtctgcatggttgaggagtaaatatttgaatgcaattcagatcccttttatcaagaggaaatgtaaatgaagagcaaaaagtagcaaatctccattactaatgaatagatgtattttctatcacaagtcattggctattctaaaaatccgcagagaaatgcaaatattgattaattaaagctactgccataaaccataagaacaaacaaaaacattgacaattcaattccctaagcattattaagtgactgctatgaagaaggcactgtgcaggtcactgatgaagagataaacagctgcaattttaaagaaaagtggtacatttgacaataactcgatatatctgatatgttcaatgcttttagatgactctcatggagggggttagaaaatgcagcttgcttattctagatcagaggttcatatcatacctacttttattcatacccatgcaagcactgctaggattaggccattagaaaatgctgcacttcaaaatcacctgcaacaaccgtgcatgtctttctttcttttttttttctttttcttttctttttttttttttttgagacggagcctcgctctgtcgcccaggctggagtgcagtggcgcgatctcggctcactgcaagctccgcctcccgggttcacgccattctcctgcctcagcctcccgagtagctgggactacaggcgcccgccacctcgcccggctaattttttgtatttttagtagagacagggtttcaccctgttagccaggatcgtctcaatctcctgacttcgtgatccgctcacctcggcctcccaaagtgttgggattgcaggcaccccacctcgcccgaacgcgtgcctttcttgaatctcctctacagaacatagcacgtgttttgaacactttgaatgacactaagtgtattaacaatccaaactaccctattccatttgtgagaagtattggttttatatttatattggcatcaaaaccttgggttaccatctttcaaaaaaagtcttgattttccactgactttcaggtttgtttttttgagaggattgaatacattttatttaaaagtaaagtgcatcttctgagcacatactttcacaattgtttttcttatgagtataaaataatattgctgttgtcacattatttttctaattcattttgacaaccttatctgaaagacaatgtatcttaatttctgtgctatgtctcttatatattatacctacttgtgtattaaccttgcctacccactgcaatttgctgtcttgaaaaatatgttcctgacccagagaggcacacaaagacatacacaagaagaacattgcaggaggagtatttaatatatgaattgcatgtcagtcatgctatgacttgtctctgatgtcattttccttgcctgtttcatctttttgtttcttatatgcattttcggttgtaccactgcttcattgactgacttaactctgaatttgttgatgatatttttccctagtgttttgagtaattattttctatgctgacggcttcacctcataagcataccctcataatagatctgattggtactttacctttacaaccaagaaaatagtggctaaattaaattggaaggttgtgggtttgtttgctttttgtgtgtgtgtgtaatgataagcctgaatacaggcattccacatgttatttggaccattcaaagacatcatgaccgaagtctctgcaattcaatgtactttttcttcaaagtaccatttattcacagtccaaaatggctgctccagttgtaggcatcatgctcacatctaggacacagaaaaaaggaagacagggaggtggaaatatgtggtacctctaacatggaaacatcttttccagaaacccccagcataggtctcactggccagaactggaggttcgtgggtaaggaagaaaaaggaattgaaattgggtaaggaattagacacttctatcacaaaatgtgaactgccctcgaggtttgtactgggcatattcacaacctcttccattgtctagtacgtcctcctgctgaaggtactaacaccaacaggctataaggtctaggttaacgatgtttttgtggtccaggatacttgtttctctggcaagttgagccactgtcatttctgatctcctgtacgacaaggaaaataactaactaacctacatgctgtctgggtgttccctataagaaatcaaagagaggcacactggatgtatgaggagatgagttctttctttgaacagtgtggattagagtagcaatattctctaaatcgtataccaagaaatcttggtcagatcaccctagaatgatagagcatagatgctattacttcaccatatctagttcactaggagaatgatcatcacaacaccgcaatttgggggtctcactgaattagaaacttgcccacactactagcagatgacctgtgctgggacatctcagcccaaaggtgaactaatcatggaattatggacaagagtgatatgaatctgctttactaactcactctccatcttaaatgccagagctatttctaacctggctcgaaacaagtgactgtgacctgttagaatatagccagcataattgtccatggacttggag

SEQ ID NO: 2563 - DNA, 1455 bp, Homo sapiens
ggaaattattacaaagttcagctggaagtctccttctccctgtggaccttccccaattccactggctgccctcctcaaggacccctgtgagataaattcagaaatggctatccttggcttccctggggaacaagagtgcctgcagttcttttcccacttcttttacttttctatttcactgggctctctaaattcatttcagctctaggtaaggttaaactcttctcccgtcttctggattttcaggttctccagggccgatgtatgtttggagatggatttccccctctcacacttcaggcactcagttttttggcagtctcatggagttttcagtggcaagccgcttatttcaaatgggatttggaaaggattccgtgatggttaatattgagtgtcaacttgattggattgaaggatgcaaagtattgttcctgggtgtgtctgtgagggtgtcaccaaaggagatgaacatttgaatcagtgagctgggagacacaaacccatactcaatcttgggggacaccatctaatcagctgccagtgcaactaggataaaatcaggcagagaaatttggaaagactagactggctgagtcttctggccttcatctttctcccatgctagatgcttcctgacctcgaatatcagactccaagttctttagcttttggactcttggacctttggccacagacggaaggctgcacttttgaagttttgggacttggactggcttccttgctcctcagcttacagatggcctattgtgggacttcaccttgtgattgtgatttcaaaccttctgggtttcttcccagcgctaaatcctgtcgactggattcactaggatgaatagagaaagaagtgttacattttaagataatttcttttctaaacacacagaaaggtaataattctggcattttacaaagcatgtcaattagctttctcaatgctttttttttcaattgtttgctcaccagttttgttttagtcttttgctttcttgcatatttagtttttaattattgggagtcatgaactcattggaaagagtacactcagaattagggagttgggtacatctttgcatggggcaaatatgaaaaacatgaacagcaatgacacttatgattagtgtgctctacagtgaacttcctatcatgctcccaggaaggaggcttagcctctcctggagttcagtgttatactaccaagtctagcacattgctttgcttttccaaaatagcaaatgtcttagcacttacctaatgatgatctaaggaaaagtactagggaaatggcattattctgaagactttgttgacagctgcaaaccataggctatgatagcattagggaaatggcattattctgaagactctgttgacagctgcaaaccataggctatgacagcattgcgggaaagcaagagaagacacacctcttcc

SEQ ID NO: 2564 - DNA, 414 bp, Homo sapiens
caggaaccattgatggccaaggtgatggttgtggtgctggcttgggaactataatctgagaattacatgctataaaaaattttgacatggatggttctaacatggactggtactgaaaatcaaggtaaagtcgtatggtattggagaagaggaagatatgacttctcattgtaaaggaatcatagtaagtctttcttgatgagatggcattggagcaagagctcgaaaggtaagtaaagatggggaattcagatatggaattagagcttattagtggcacatagttcaattttgcttgaaggtagatgaactcaaggtagagagttcatgtaaggtgacatagaaagtgttatcaattagtgctgtctaactgaaatataatgtaagctacatacataatttgcaatcttctag

SEQ ID NO: 2565 - DNA, 3609 bp, Homo sapiens
tgatatttcactgaacacgctcgttcttagattagaaaattcctggagtcgtcgcatatccagcataaggaggtgaaactatccagaggagaaaacaaacttacaaaatgaggatcccttggttactctgcttccatgctatgaggactcagcaacacagaagagccacatgcggatgctctggtgcacattccccgctgagcaccgccttagattcatcccagctcaggtgccagacataagggtgaggaagcttccacatgattccaagtcactgtcattccaatgaagcccagcagaggccccagatatcacggagcagagacaagacatctcactgaatcctgtctgaattcctgaaccacaagatcttcgaggaaaacaacatgattataattatttgaacaaggtctgaggtgctttatttatgccatcatggtaaatgaaatggaattggggatctagaaatgaagtaccaccaaaacaaaacctaaaacaggtggaatttgtttttaggattgtgtgtcagacagatgtccaaaaagccttgtagtaggctaaaaaatgcccttcaaaagatgtccacatcatcacccaggaaactgtgaatgttatcttttttaaggttctttccaagtgtgatcaaagtattctgtgatagggagatttccctggattatccaggtgggccttaagtgcaatcacaaatgtccttataaggcaaaggcagagggagatttgaccgcacccagagacaaagacaaagtaaaaacagaggcagagattggagtgatgcagctaccagaggctgggagaggtgaggaacagattctgccctagaatttttcagagggattgggaggccgaggcaggtggatcacctgaggtcaggagttcaagatccgcctggccaacatggtgaaaccccatctctactaaaaatacaaaaaattagccgggtgtggtggtgggtgtctgtaattccagctacccaggaggctgaggcgggagaatcgcttgaactcaggaggcggaggttgcagtgagccgagatctcgccattgcactccagcctgggtgatgagtgaaattccatctcaaaaaaaaaaaaagaattttcagagggagcatggccctgccaatatcttgaccttccccaatgaaactgatttttgacctgtcctctggaactgtgagagaataaatttctgttggtttaaactacccagcttgtggtactttgttgtagcttccacagaaaagtaacacagtcctcaaaaagggagtcagtgaaagtgtgaaagagactgaggagattgttattggaagctagaggaaggaaacttgtatatataatggtagaaagcttgtcaacacagttaccaccagtaatacggaaaataagaaatatgctaatgaacttaatcaaggtaaggaggtttttggaagaagagtgtaaggtgcattgtggtttcttctagccagctatagtagaatgtgagagcagagagaaattaactaaaaaataaactcttccttttcaagaacaactatcaagggtttaggagagtctttccagacagaaaaggcttctcaattaagaaagagtcattgattcaaatattaaatccagagagctagcagaaaaacattgtcttggaatcaagatgaaaccttagatgtgactacaaaaccctttatgcagacctcggaaaaatttatgtttgtgccctgtagacacactgagatggaccaaaagctttcaaaccatcttcagggcatgtctctgttaagaaaaatattaaggcttctaaaggtcttaagaatgttattccaggttgggtgtggtggctcatgcctgtaatcccagcactttgggaggccgaggtgggcagatcacctgaggtgaggaatccgagaccagcctggccaaaatagtgaaaccctgtctctactaaaaatacaaaaattagctgggcctggtgacgggcacctgtaatcccagctacttcggaggctgaggcaggagaatctctcaaacccagaagtggaggttgcagtgagccaagattggctctgcactccagcctgggtgacagagtgagactccctctcaaaatgttagacttataaattgacatacaacaaacccacaacatttttaaagaaattatatcagatgggaataaaagggacagagacagtatcaaatgaaaaaaggcttttgaactccaaaacttttactggcaagatacatgatttaaaaaataaagaaacagacaaatacaaatctgcttagctgtagacatggactactccttataaaaaggaaaaatgactcgggtggaacaaagagcccaggatgaatataagagctgcggagaagaactctcaggttgtgggtctaagccttatcaaggaactggtaacatgttccctgctggatttcagaattgctatgaaacagtgattatattttcgaatagcagtggttatcctatatcggtttgactattgtatgttcagtgttttggagaaagataacctctctcttacattcacaggtcagattgcaagaaatacttgaggaactgcactcgaggtgtcttatttacatatcacccatttgattgattgactgattgagatggggtctcactctgtcactcaggctggagtacggtggagcaatcacagctcactgcagcctaggcctcccaggctcaagtgacctcccacctcagcctcctgagtagttgggactataggcatgccgccacgctcacttaggtttgttttttgtttgtttgttttttgcagagacgaggtctcattaagctgcccaggatggtttcaaactcctgagcttaagtgatcctcctgtctgggcctcctaaagtgctgggattacaggcatgagtcggcacacccagccccatatcacccaatttagatgataagattctggaccttgagtctaaaatgaaagtcaaaatggagacttttgggggtcttgggagagggtgtttttattttgcatgtcagtgggatacaaattgttgtagccctagggcagattgtggcatgctgcattttctaaagatggccaccaaatagatcccattcaaaatatttctctaaaatgtgcgttgctactctcccctcaaaaagtgtagcctatgtctccttctcttgcacctgggtggacttgtagttgtttcaaccaatagagtacaactacatgtgcaaatgctgctatgtgacctttaataccagatcataagtatcataatgcatttatggttgggatgtttgagaccctcactctttggacatcgccccttggtatgtttctcacagaacctagctacaggtctgggtgggttcagaactagcctggaacctagccataactgtggaacacctacctgcagcctgtccagtgggtaaatatcctaacccagttccagtcaacatttccagctgagtccagcctttgtttttgttctgtttttttgagacggagtttcactctgtcacccaggctgggtgtacacacagtcctgggtgtaactgttctagggttcttaatggctttagagcttagcc

SEQ ID NO: 2566 - DNA, 3659 bp, Homo sapiens
tatgatcatcaacaaaattagtttcttataaaaagtggcatttacatcaacaactttgcagaaaactaatttatggctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatgggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggtaagtgaagtttacatttgcacttgggttgaattgggaatgatctgttaacccaggcggaaaatgccaaatgaaaattattacaagaaattgtatgccttgaaatcgaaactgtggtctcatttcaaaaaagtgagaatcccagccaggtatctaagtcacctcgttgtgagtgattttctttttagtgtgatggctactgtctgtgctcattgttttcagtggacttattgtggttaatgttcaaaaaaaatgtctgaggactcacacttagttgtgaaatcggtttcacattttccttttaaattgggctatttttcttggatttgtccctggatctacttttgaaatgttaaactagatttagtagaatttactttgaagaataagaggaaaatttatgaagctattttacaagacggatactggataaatgaaactaaatttgcttgggatagttaaatttctcattcacttctcatacagtaatcattttgcaaggctgtagtttctcttgtgagcaacacataccattttgtaaccttgttcattttggagaaggatgaatgttaccctaacacttttgttctacggtttttccctatttttgctcttttaaggatcccatgtataactttgtacagttcctcatatcatataccccttgctacaggtgattccagggaagtagtaattggtatttttatcacatatctattaattcactcagaaagtatacttgcaaatatatcatgtcacattatatattactgggagctttgaagaatagctggttagtaaaagagaggtattgctgactgggccttgataggtagcatggttaccatgttttttataaatgtaacagccaggcacagtaatcaccccgccactgtcttatctgtttccaagagctttaaaaatctcagggattggtataatttttattttttgaggaaaacatatcactaatttaggaattaccactaaatcaaatggaatttcacattagtctgaagattcattcaaagaaagacaaatatgttattctcaaagatattaataagcacacttaaaaaagagtagaatacagttccatggtcaaataaacccattggttgatgaagcaataagctaaacaaagttaagtagatgtctttactataggacttccctgaacctctaatatagtaatttaaatggtggttcatttatagtacggaaaatatatagtgtgtttcatttccaaacttatttgatatggttttaatagaatagctattgatatttttgtgggacagatttgaggaaacactggtctacactatggagaagactttaaaatatgttcctcttaggttttgacctttcaatttgctttatttggattgctgtctcaacttgcttctgaattgaagaacaaataatatagccacaccaaaaatgtttaaaaaaataaacaaaaacttagagggaggtgtgcttttgtatatttgtgtatatttgtgtgtataattatttctaaactaaatattcttaccctttttggtggagcatttttttcatacattgctgggagaagtgtgaaatgtttgaccactttggagaactttggcagtatccactaaagctaaatatgtataaatgattcagcagtccttctagctatacacctaagataaatgaagtcatatgcccataaaaagacacacacacacaaaatcttcgtattggttttattcatagtagctaaaagttgaaaaaaattcagtaagaaaggaaacaaatccaatattatactattggggcattaaaaataaatgaagtatggatacacacaaatatgaaacaatcttcaaaaccttacattcataaaaacaagccagacatcaataatgaatgctagcaaggatgtggagaaaagagaacccttgtactctgtttgtgggaaagtaaactagtacagccactgtggagaacagtatcgaggtttctcaaaaaactaaaaatacaactactgtgtaatccagcaatcccactgctgagtatatttctgaaataaaggaaatcagtatattgaaaagctatctgcattcccatgtttgttgcagcattattcacaatagccaagatatggaatcaacctaagtgtccatcaatggatgaatggataaagaaaatgtggtacatatatacaatggtgtattactcagccataaaaatgatatcctgccatttgcaacagcatggatggaactggaagatattaagtgaaataagtcaggaacaaaaagacaaatatcacatgttctcagtcatatgtgggagccaaagacaagtggatatcatggagataaagagtagaatgctggttaaccatagtctgagtagggcagtggagaggctgggatgaagagtggttgttaatgggcacaaaaacaccaatagaaggaataaggtctaatgttcaatagtataacagggcaactgtagttagcagtaattcatggcatatttcaaaacaactagaagagtggaattggaatgttcctaacacaaagaaatgacacatacttgaggtgtgatagatatcccaattaccctgatttgatcattacacattgtatacttatatcaaaatatcacatgtatcccataaatatatacaactattatgtatccacaacaattaaaaacaaaaaaaattaaaagaagccagatatataaagaaatactgtatttcacttatatgaagttcaagaataagcaaaactaatctatgtttatagaagtcagaatagcagttactagaaggtgtaggtacaactaagcatgagggaattttttgggcaaatgtcctatatcttaatctgggtgctggttacatatataactaggtgctatatagatagatacaaatttaattaactgcat

SEQ ID NO: 2567 - DNA, 1194 bp, Homo sapiens
ttggcacattttactcttctggcagctggagagagctctgacctgtgtctcatcagtgaatgctggttgtgacaataatgaatttctaatggcaattaacacagtgacagggtttataaattatagattatgacaacactccctgcgatctggttttttcctttgaagaccacctggctaccaataacggtctcaccagccaaatcctgtatttgtgggccaagacagaagaagaacaacaatgaaaaaaagctggaaatcttagagcagactcacatcttaactaggagaatacgtgctggcccaagtgccccaggactgaagcaaatcagacataggggaggagggagaatgttagaatgaggcacacctgattcagccgctaaatagtctggttggctaagaatcacaatcgaggcattttgcctttctagttttctttggtgaagatctgtgagcatccaaatgatatgaagagcaatatggctaatctgcactacttcggaagcctgggaggaatacttcctctttgctggatgtggcgtctgcgtgtaccatctggaattgctgtagccaacttacaaatacagacgaaagctttatcaacctgctgagcacagcagaatggaaagatgcaaagcaccctgctcttgggaactggccaccttcagacttcttgctacatcaggttttatctactacaaaggatatcacttgggaaggaatttcttgaaactgctcccaagagagccattggaccatgtggtaaacaactcctagctgatggattattgggaatattaacatcatccagaatgctatggggagaagacaactggaagctccgtgtggacaaacctcctggactctgccccacatatctcttcccttggctgatttgaatttgtatcctttcactgtgataaaccacaaccagattattacagctttagaagctgacagctgacacgcccttcctttgtgcattttatcctgggacaaaatgagaagacatccttcagttcccgtaagtactattcttttagtaggaaatcaaacacaccccctaactggagtactatttattctattccatctgtttcacataagagcagtaaagtgattggaggtgaaatgaaaagaaagaaaatggcaagacatggtgcacaaataactttcaaagactcataaatt

SEQ ID NO: 2568 - DNA, 495 bp, Homo sapiens
caggtgcgcagtgacccccggaccctccctcctcaggcgctcgccgatcccgggcctccccctcctcagatttgccaagttgtttctcattaaacctaaaccaactcttcagccgcgccgcctcggggaccgtaagccccgctctggtggacgcctggagtcgccgcctcccgagagtccacaccccatcttgtctccagcctgcgctgggaagaagctgaggtctggaggtcttcctctgaaggagcacagtccagggagccacagaaggctgccttgaggagtggaactgcttcagggatcaatgcaaagtgtcccctgtcaggagaaaaaccactcagaggagagatgggacctcagtatgtttgccatgctggtatccagcttctggcctcaagtgatcctcccgactcagccttctaaagtggcaggattacaggcatgaaccaacatgcccagcccagagaaatcaactcctgtgtgccaagattaggt

SEQ ID NO: 2569 - DNA, 794 bp, Homo sapiens
tcgtgacaaagcaaattgtctggtatcatgaatttggaacaccattccagaccaaaattgaaaaaatggttgacctcacccaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 2570 - DNA, 53690 bp, Homo sapiens
gtaatgtacttgagttataaagtttatatttatataactcaaatataaatattaaaaatatataaatataatttatatacatatcttttatttatataaataatgtataatatttatattatatatttggtattataaaagcatatgaggattctgagaagatggcaaagtaggaagtacaggaaatctgcctccccacccagacaacaattacattggcagaatctgtctgatgtaactgttttggaactctggagtctattgaaggcttacaacttcctggggagggtgaggatagcaaattgtagttaattttggtcaatttcccctcttagcacctccaaggagcagctacccatcccccagtccccagtcccacagcaggcagctgtgtgcattcctagagcaatctgaacacaacttgcaggagctggagtgagtaaaaggactctgtcttccaaatgtcaaggatctgtgctccactcctgttacttcttcttatcacagaggtacagaaaaagaggcaccgatgttccacctcctccctatgttgttccccctcctgctcatcctgaagtaacttccacaggattgaaaggccaatgcctttttctttcaacctctttcatttttttctcttttgggaggtagacatcaaagattaggacattcaactgcaaccatatatatggggtagattagaaattcggagcacatgttcaagagaacatctctactaaagatacaaaaaaaaaaaaaaaattaaccaggcacggtggtgtgcacctgtaatcccagctacctgggaggctgagacaggagaatcgcttgaacctgggaggcagaggttgcagtgagccaagatcacgccactgtactccagcctgggcgacagggtgagacttgtctcaaaaaaaagaagaaagaagaaagaaggaagaaggaggggaaggagaaagaagaaagaagaagaaagaacaaagaagaaagaagaaagaagaagaagactgaagaaaagtaaacagagctctaagggacttgtgggacaccatcaggtcaaccagcaatacactgcggtagtcccagaggaagagggaaaaaggtagagagaatatatgaagaaataatggccaaaaatccccatttggtgaaaaacatgaatataaacatccaagaagcagggagataggatgagcacggaagcaggatgaactcaaagaggcccacaccaagaaacagtataatcaaactgttaaaagacagagataattttgaaagcagtaagacataaatggttacatactagggatcctcaataagattatcagcagatttcacatcagaaacattggaggccagaaggcagtgggttgatatagtcaatgtgataaaagaaaaaaaactgtcaaccaagagttcttataaggatgcagcagaaaaaaacaaaatgtttttcctctgcttaaccactcacagtctacacaacacagaatatttcatctctgactaccaaattgtggggagatttctctctaccagcaaccaatcaattcttcagcagacactaaatgggtatccttcaattccattctgatactgtctacctggaaatagcatcacatcccacaggctgaggcttacttagtcccataagactggttcccatatcagatgccagttgccaagtactaggttgtcacatatacttctgactgagggttcatgatatcctccttgggttttgattaatttgctagattaattaacaaattagagtggctcacaaaactcagtacaaaaaatacatatgaatagccagatggaagagatgtatagggtgaggtaagggagaaggggtacagaacttccatgtcctctttgggccagccaacctctaggcatctccatgtgttcagctatccagaaactccctgagaccagtccttttggacttttatggagatttcattatacaaacatgactgatttaatcattagtcactggtgatcaaactcaacctttggcccttctcccctgcccagaggctgcagggtaggactgaaagtcccaacctcctgatgaagccttggtcattcgggtgaccagacaccatcctgaagctatctaaggggccaccagccacttgtcatctcattaacatgcaaaagaccctcttatcgctcaggagattccaaggattttaggagctatatgccagtaaacagggacaatgaccacatatatatttcacaatatcacaattctatatctggcgaaactgtcctttaaaagtgaggagaaattaagatattcccaaataaaagttgagggagtttgttcctaatcaacagacatgccctgcgagaaatgctaaaaggagggcaggttgaaacgaaaggacattagacagtaacttgaagccatatgaagaaataaagatctcagtaaaggtagtaacatgggcaattataaaagctagtattactgtaaccatgatgcataactcaactttttgttttctatgggacttaagagtctaatacaattttttaaaagcaattattagtctaaaagctagttttatcataactttggttggtaactcattttttcctacatatttaagagactaatacattacaaaattattagtttatgtttttggacacacaacaaataaagacgtaattttgtaacatcaacaacagaaagtggtagaaacaaagctgttaaaggagcagagattttgtatgttattgaagtttaactagcataaatttaaattagagtgttataactttaggatgttaaatgtaatctcaatggtaatctcaaaattactatagaaaatacacaaaaggaaatgagaaggaaattaaaatgttttactaaaaaaaaaatcacctaaacacaaagaagatagtaatgcaagaagtgaaggacagaaatcctataaggcatatagaaaacaaataacaaaatggcagaactcagtccttccttatcagtaattactttaaattcaatggattaaactctccaatcaaaagagactgacagaatggataaaaaacaaaaacatgatccaactatacgctgcctacaagagactcactttaaatccaaggacacaaataggttgaaagtgaaaggatagaaaaatatgttctatgcaaacagtaaccaaaagagagcagaactggctatactaccacaaaataaactttagatcaaaaaaagttataagagacaaagaaggacattatagtagtccccccttatttgtggggaatacattcctatattcccagtgaatgcctgaaaccactgtttttgcaacgtgataactgagatggctactaagtgactaataagtgggtagtgcacacagtatagatatgctggacaaagggatggttctgacgtgggtggaacaaagtgggacagtgtgagatttcactgcgctattcagaagggcatacaataattaaaacctatgaattgtttatttctgaaagtgtccatttaatattttcggaccttggttgaagtaggtaattgaaacctcggaaagcaaaatcatggataaaggggcctactgtatatattatattaatgaaaagtaagggggactattgtatatattaataaaaagtgttggccgggtacggtggctcacatctgtaatcccagcactttggaaggtcaaggcgggcgcatcacctgagatcaggagcctggccaaaatggtgaaaccccgtctctactaaaaatacaaaaattagccaggtgtgtggcggatgcctgtaatcccagctactcgggaagctaaggcgggataattgcttgaactcgggaggcggaagttgcagtgagccaagaccgtgccattgcactccagcctgggtgacaacagtgaaactgtctcaaaaaacaaaaaaataaagcgtgatacagaaggaagatatatataacaattataaacatttaaacatctaataacagaccatcaaatatataagcaaaaactgatggaactgaagaaagaaatcattctatagtaatagttggagactttgataccccattcttaataacctacaggaaacccagacagaagataagtaaagaatagagagcttgaacaacacaataaaccaattagatttatacagagtactctacccaataacagaattcacattcttttcaagtgcacatgggaaattttccaacctagacatatactagaccacaaattaagcttcaatagattttaaaagacagattacaaattttcttctcttactacaaccagacgacattagaaatcagtaacagaaggaaagtgaaaattcaaaaatgtgtggaaattaaacagcacactcttaaacaaccaacaaatcaaaaaagaaatcacaagggaaattagaaaataaatagagacaaaaaaaataaaaatacaacataacaagacttagggaataaacaaaagcagtgccaaagggcaaatttgtagccatatgtgcttacaataaaaaacatgaaagatcttaaatcaacaacctaatgttacaatttaaggaacttgaatgagaagaacaaattaaacccaaaactaatacaggaaggaaacagtaaagggtagagcagagtacaggaaggaaataaagaataagaaaataatagagaaaatcaataaaaccaaaagctgtttctttgtaaagatcaacaaattgactaacatttagctggaggagacacacttcctaatttcaagacttactccaaatccccagtaatcaaatcagtgtggtactgcaaaaagatagacatacagactcatgaagtagaataaataatccaaaagtaaacccttacatttatggtcaaatgattttaacaaggtgccatgactattcaatggggggagggaaatcatttcaacaaatgattcttcgaaaactggatatttccatgtgaaacaacaaagttgggcctttacctaacatcatatacaaaagttaattcaaaatggatcaaacatctaaatgtaaaacctaaaaccataaagctcttagaagaaaacaggacaaaagcttcaccacattggatttggcaatgatttcttagatatgacactgaaagcacagacaataaaagaaaatctgaggacttctgaaaattttaaaaatttgtatatcaaaaaccattaccaacagattaaaaggcaacccacagaatgagagaaaatatttgcaaattgcatatctgataagggattaatatccagaatacacagaaaactcctgaaactcaataacaaaaaacaaacaataccattcaaaaacaggcaaaggactggaggagacggatctccaaagaagaatacaaatggcaataatcatatgaaaacatgctcaacctcactaatcattatgaaaattaaatcaaacctataatgagatagcacctcgcaaccattagtatggctactattaagaaaaaaaaaaacacaaaataacaagtgttgtcaagaatgtggagaacctggaacccttgtgcacttgtgaaaatgtaaaatggtacagctgttacggaaaacagtatggcagctccccaaaaaattaaaaatagaattaccacatcatctagcaattctacttctggatatatactcaaaagaactgaaagcagggtcctaaaaagatatttgtatatttgtacccccaggttcacagtggtattaactgcagtagctaaaatgtggaagcaaccaaaatgtccattcacaaatggataaacaaaatatggtctatgcatacaaaggaatattattcagacttaaaaagaatggaaattctaacagatgttacaacattaatgaaccctgaggacattatataagtgaaataagtcagtcacaaaaacacaaatactgtatgattccaattatatgaggtatctagagtggtcacattcattgagacagaaagcagaattgtggtttccaggggctggagggttgggggaaatgcagagttgttgtttaatgggtacagagtttcagttctgtggatgggtggtggtgatggttgcacaacaatgtgaatgtacttactgccactgaactgtacacttcatcgttaagatgccaaattttgtcgtgtgtattctaccacaataacaaacatgggaaaaaaagctatagaaagcttaattaggtttttgaatgcaatgacagtaatttatagaagaatttgaagagaacaggaatctgcataatgttgagtcacccaggatcaggctgtatctctccaggttaagttctattccttcagtaaagattttactttatcccataaaaaaagaaaagtatatgtatgtgtatatacaccatgcacatgcactcacacagacacaagtatatgaaacgtactcattccagagttctggggtcatgtcaatatttgggctgaaacctggctgtactacttcccagcagtgtcatcttgggaggtcatttaactgctctgcttctcatcagtaaaatggagcaaataatacctacctcacagacttgtggtcaagatttttaaaatgggaaatcagcactaaatgctagtgcagcaccacaacacgtaaggattcaatcaaaatcatgtcatcatcaacgtctctggatggtagaattagggatgactttcatttgatactgggaacaaactggtgttttccaaactctccacagtgagcatgtgttgcttttgtgatgaaataagacaactaaacattgtttaaagccatctagagggatggctaagccaagtggaggtgagcaggaagccaggcttctttagctaaagagtgcagcctctcatctttcacagcattaatccctgtagctcccagcaggcttggaccagccgttgatgctgacctacagatgtctcaggctgtcctgtttccttgtggaaaaagacaatgcctctgccccaccattgccatggccatgtgaaggcagctgtctgcccacgccaagtcctcctgagctgggcctcaatggcccccacctgctgtctgggatctgttggcagcactggctgctgtctcaggggtaacatcattccagccaggaggtaaccagggcatctctaagttagctgtctcatatccagtatgtcatagtggtcaagacaatcagcttttgagtcagtaagactgggattcaaaacaaggttctgtcaatctccaaaacctctagggctcagcttctcttaactacaaactaaggatgacagctacctctatgactataaagagattagctcaaggcctggcatgtcataagaaggtaagaggactttaaaacatcatgatgcttctctgttcaaggcatccccatgatagacacaaggagtatcattttagaccagtggaaaaattgacccattgaatcttctgtcaattccattcaacacctatgtgaggacctcctgagtgccatacacagctgaaggcacttgggatacatcagtgaataaaagggatgaggatctctcccttcctggagcagagggagatgaatgataatcaatatcaatacacataaaaataaataggctggttgcagtagttcacgcctgtaatcccagtactttggggggctgaggcaggcggatcacgcggtcaaaagattgagaccatcctggccaacatgctgaaaccccgtctctactaaaaatacaaaaattagctgggtatggtggtgcatgcctgtagtcccagctacttgggaggctgaggcaggagaatcacttgaacgcaggaggtggaggttgcagtgagccaagatcacaccattgcactccggcctggcaacagagcaaggctccatctcaaaaataaataaaataaataaataaataaatgtgtagaaattgaatacacataatgaataagtgtgctagaggtgaaaagtgcaagaaaaaaatagaagagggctgagtgtgcaggggcagaaggcaaaggttgtcatgtcattaatgtgggcagttgagcaggcctcactgggaaggtgagattgggcaaaggctagaaggaagaattatctgggacaagcatttcaggtctcgagcaagggtgagcccggtgcctgggcagaaggaagagcgaggaggctggagtggcttgagcagagtgaggaggggaagcaaaggaagggtcagggaagaatgggaccagataacatggggctgtggtgtccagtataataaggacttgggctttattctgagtcaaagaaagagctggagattttggagtggagagaaatttgatctgagttaaacgtgttaattaatgacatactcaaaatctacacatattcttgctcccttcagtaaggatatccaaggcatgaccaaatcctctctcttcttggactcactccattctgtcctccatatgaccaagacaaaccctaaccttgctctttcaaagctcttggctataaagcactctgaaaacacaaagggtgaaggctccatgacagcaatgattgacaaacagcagtaaggcctccccagtaccgagaaaggtcttggggtttcacctaagtgtaaaaataaaactaatcctcaatgttctgaccttaatggaccaagaaccctcacctcaccctgcccccaccattcttttttgaagagagactattttctgcttcatgatgacagcccaagcccaacagtgcacaccatactgaagtaccaaggctgcccctgagaaccagcatgctgggcacaggcagttcctcaccagccatgactcattttgttgtcctttcactcacaatcacgtatcatcacctaaaataaaaagtcatctttagaactgattcctcctatcattacacattctatgcatgtaacaaaacatcacacgtaccccataaatatgaacaaatatatcaataaaaaaaactacaaagtaaaaataagtttgaaaatggaaagaaaacagtcatctttactaaataggctgaacctctttgtttaaacaacaatgatatgaagaagacaaggtagatttgcttgggaaacatattctaagtggaaagatcaccctccagtcttttgcacagggaatccaaccttcgggaaaggttgccatcatgagcccaaatgttcgttttataaatgcaattatgaaaaaaagaccagcatacagaatctggactctggcccaatgacagaaatacagaattacagttctctcaaataacagagctaaatgacagccagtcctttctgaatctggaatgtcattccggatggggaaaaaaaaaaaaaaaaaagactgccaggggaaaacagttccattccaatacctgaatatatgagtaatcatagtactaaatatttataaaccagagaaagtgcacagagtgtccgcaattccacagaaatgcacttgccaccacatttagagaaatctaaagaaatgttctacaaggcccgacatttagggcaatggtttgaactaaacctttgttttatcatttacaatttccttttaaactagggtcatcctttgatgcacaatataaaggcatcaaagatgaaggttttcctcattatcttattttttatgtaatcaccgaatacatttagactttgttcagttttatatatatgaaacacccaggcattgatcaaaacacccagacatggatcaaaactgaaagtaggcacagagtgaggaatacagttgaaggcaacctggcattttttttatgtttgaattaacaacatgagtgacacatggctagcatcaaaaattttaaataatgattagaagataaagaaaaaaactaaaattaccccaaatgccaccattcataaatattcactgttgactttgggaaattatatttttcatccttgctcatgtaaagattgccagttctttatttcccttttcattgaggtgtataattcaccttccgtaagattttcaaaatcatgttattgacatttaatgtatatgcactcacattttctggtatttataatgcgaaataatcctgaagacctcttttgcccatcctttcctctccttcctgtcgccatctgagtccctctgcatcatctgtctctgggcgattcctaaccggtttcctctccttgagtttcaccttctctaacccactccctttgccgcctattatgtggtctttaattcataaatccaactcactcctcattgaacattattttctggtcccgctgcatgtcttcacggcctgagaaaggcctgcctgcccagcagtggcccaggaggtctaatcccatctcgctgctgcaatgtgtcatgcctctacaaattcacatggctattctgtctgtctgtcccacctgcaaactcaactgatccttcaaatttgtctcttcttctactgccttctttgatgtctcaaacttagacacctttctaatacattcaattcctctgtacgcacctccattacgcatcacatcaacatttgcttcaacactgatctcaccagcctgcagctctggaaaagcagggataggttcttttcaggtttgtacgtatagcactttgcgaggtatgtgccatacccccaaaattcaataaacatctgttgaatacactaatctgtaaaaccacgctgcttagcaggaaaaatggaagtattcaatattaactaagctatgggacaagcacatggagaaatgtggctcctgccagtgagcagctatcggatcagaggagaatcagggcaagcggggcccggtgcagccatgtgcaagctgtgagaggctgcagtcagccctgtccagagacagaatcagcagaatatgaaacacacacatgcacagagatttcaaaaaatgagattacccaattatgggggctgacaaagccaaaatccactgtgcaagcctacagggtggaaacttgggggcaggagctgatgttgcagtcttgaggcacaatttctttctcttcagggaagcctcagttttgctctttaaggcctttgaaatgattggatgaggctcacccaggctaaagaagataacttctttttcttaaagtcagcaaattatagatgttaaggacatctacaacatacctccatggtaacatctagattcacatccaagtgaataagtgggtactctggcctaaatgagtgtccagtgaataactgggtactcaggcctagccatgttgacacagaaaactgaccaacccagaggggaaatccagggagtgtggaaggacaggacagagacctctcactcacacttgggcagggggagggggcatgatatcaggtaaggatctctggaggaagtgctactaaagctaaggttttaaggctgaagaacaagttaggtggtgtgggagcagctcaatggctggggccaggagcaggtgagcaagacgcatgtgggtacacaagagacacccaggagcccagacggagagggcacccaagacagcacctggggcagaggctggtgatcagagcactgaacactgactgagcactgaccacatgcccaccactgtccagtgtgctttacatgcattttctctttaatcctcacaatcgccctgtgatatgggtaccattaaccacatgtgctgatgagaaaactggtgtacaaagtggccagtgaactttccaaggtctcccagctcctgagtagagacgcaggaccccaacataggcattctaaggtcttcaggttgtaggatgaagtagagcaggggtgtccaatatgtagcttccctgggccacattgaaagaagaattgtcttgggccacacataaaatatactaacaacagctgatgagctaaaatttaaaaaaaaaaatcacaaaaaaatctcataaggttttaagaaagtttacgaatttatgttgggtcacattcaaacccatcctgggctgcatggagccaggaggttgcaggttggacaagctcgaagtaaagggcagagatgaagaaattactttagctttggatagaaacaggaaagcagagctaaagacaggtagagcgagaggggtaagtggcagtaaaatgggaattctgtagtgtggtggaggtttggagtagccactgtggaaaatgaggcgagaaatgaaagaatgggaaatacggctgtaggttagcacagagaacaaagatttcagaggctgacaaggcacaggatgtgactacacgtatgaactcttcacatgggattgaaggttactgcagtcatagaggtaaggaactgaaaagacctcctccccgtgggttctcagtaaagggcaggagttaagggaaagaggaagtgcaggtatgaggacagcccaccaacctcatttttggtatatggagaagttaaatgcgtgtcaaagtagttcacatacatagctatattcctctcctcactgtctactccagatagtctgttaaagacagtgaacacagcagtctgagtagaatatacagttcttgcttcagaagaaaagagaatccccaattatggctatcctttggccaatccagtggaatcatttcaattttgtacatttgccactgactttatttctgtggatcacagaattcagtaaggggatgcctcaaacagaaagctgtctcatttaagtctgttctgtggctctgtgcaggaagtgaactgagtaatctaactattgtctttgtttgctaagtttaaccaaaaagaagtcctctgggtttaaaaaatcatcatgaaataaagagtttgccttttaacaacttcattttactgagtgatttttataacttcccaggtaaagctattagttttcagagtgtaaatcctgcggcaggttgcctctgggctcttgaaaaacctaaggtgctttggctaagaaaacaaaacacaggagtggctgcatgaaaccgttcatgtagaaacagcacagcatattcttgacaaagtgttcatattattcaataaagtagctagaaatgaaaacatttagattcaacgtttcttctttcattttaggagatacgaaattaatgttagatttgcttctgttgacagcagtcatgttgcttggcaaccttaagtgtttcttgggttgaattgcaaacgactcaagcagctactcattttaaaccaaggaagctgctcaagaagttcaatgtgatgcctatcacataccccatcactcacactgatgcaagagatttatttgtaagatgctaccactattggatgtaaacacctacaccccattggccctacaagctgtcctatagttatcaaagtgacattttagcccacttgatttagttttctatttctttattaacaactaaataattggctgacattggacatttaaaatttattttctaactgtggtaaaattcacataatataattttactatttttaagtgtaaagttcagtggtattaagtacatttacattgttgtgcaacaattacaaccatccatctccagaatttttgcatcttcccaaagtgacactctatacctgttaaacagtaacttcccattcctccttctctttagcccctgacaaccccattttactttccgtctctatgaatctgagtactccaggtacctcctattagtggaatcatgcagtatttatttgtcctttgtgtctggcttatttcactcagcacaatgtactcaaggttcacccatgttgtagcatgtgtcagaatttcttttccttttaaggctgaattgtcttctgctatatggataaatgacattttgtttatccattcatccatcaatggttacttggtctgttaccacctcttgactgttgtgaataatacaactaggaacatggatacataaatatctcttcacaagcctgctttcacatttttggggtatatatccagtagtggaattgctgggtgacacagtaattctacttttaattttttgaggaattgtcatcttgttttctatagtgggtacaccattctagtccaatcggcaatgcatgagggttccaatgtcttcacatcctcaccaacacttgttattttctgggctttttaaaaaaaatagtagccaacttaatggcaaccagattttatgtgttttattttttcatatctctacttctttaagtattatactatattgtaataatttacattcaattaaattacactatattgtaatgatttacattaaattagaatatcagtatcctcctccactaatctatgacctgtaatggaaagaaccaagtcttcttcatcttaaataccctctaattcaaacaggcaacaacatgcctagtcctaaaatagaagtttcctgaatatctgttccattcctcattaccaatggaataatgaggcttcgggtaagaagttcagggtagactgagaaaaatcctgaatgccaagctaatgtgtttaccttattaacaagggagagaattatttgtcatttctgtaaaaggatgacatagtcaaatatttggcaatggtgtgttgacctaagcaactagagtcacagagtccacttacctggctggacaataccccctggaatgagggcagtgggcatctgcagggggatggcagcctagggaatgaggcgggaggcccggggacactaccaccatgttctgagaacacttgggttttaccctttaaggagactcccagtttatccagggctctcaatacatcattcagaaaaatatgtttttcaagtgtgtgtgtgtatgcgtgtgtgtgtgtgtgtttgttttgagacgactctcactctgttgcccagactggagaacaatggcatgatcttggctcctccactcccaggtgtaagcgattctcctgcctcagcctcctgagtagcagggattacagaaatgcaccaccatgcccagctaatttttgtatttttagtagagacaaggtttcaccatgttggccagggtggtctcaaactcctgacctcaagtggtccgctattctcggcctcccaaaatgctaggattacaggagtgagccactgcacccacccaaaggtttgtgttttaaatattaaaatagaaatatcaatgtggtaagtcaacaaatgaagatgaaatgtaaatgaaaattacattctcagagaagaaaaaatttaaatgaaaattataaacacaatgaatcacagagtatttaaactacctatgaaaaatgaaaaaaataaaatcagtagctactataaacagaaaacaataatttaaaaaaagaacagtgaaaggaagcaaaagggatactatttagagaaactaaaacaagtgctgattgtaaatgaataaaaatttcaagtattgagagaatattaatgcaaaacaggaagcttttttaaaatctgaagcatagaaacgtcagggataaagaaaaggaaacatgctagaaatttaaattttgctctttaccatagtttttaaattatttccaattattaaacactttctagcacctggtatagaccaggcatggaactaggcactggggacaatatagatagtggctgatcattagaaattgtccacaaaagctacattttaaaaattccctcctggaatgatctatttttctgacagagtttaaaaggattgaaggagagagccagtgatacggacagggatgtgaatttatttaaataaagtagcaccatttagtctttttttctgtttctgatcaagaaggtagaaatttcaattcctataagaatctctaaaaggtaatcaaacagtcataggtggtgatagaacccacagggtgagggctgatttagacagatagtgacttggtcccagtggaatgctctccccatctgacatgatttggctgtatccccactcaaatctcatcttgaattgtagttcccacaattcccacatgtcatgggagggccccagtgagaggtaactgaatcatggggatggttatcctcatgctgttctcatgatagtgagtgagttctcacgagatctgatggttttgtaaggggcttttccccctttgcttggcacttcttgctgcctccatgtgaaagaggcggtgcttgcttccccttccgctataattgtaagtttcctgaggcctctccagccacgtggaactgtgagtcaattaaacctctttcctttataaatgacccagtcttgggtatttcttcatagcagcatgagaacagactaatacagcatcatttccaccaacccaaagcctcctgtcttttaaggcccaagtgaaacttagccccttctccctcctcaaagcttcaactgcttacctaggatatcagacccctactcaggggactcaatccaggggctgtttttgcatcagtaaagagtacaactttctgctcaagatttagttatacaacaagtatacctacttgtactacacttgataacctttagcctacaaggaacctcaattacatgtttttattctgacaatacagcgagaagtgaggtttttagaagtgaaaaagtgggccgggtgtggtggctcacacctgtactcccagcacgttgggaggccgaggagggcggatcacctcaggttgggaggtcaagaccaacctgaccaacatggagaaaccctgtctctactaaaaaaaaatacaaaattagctgggtgtgctggtacatgcctgtaaccccacctactcggaaggctgaggcaggagaattgcttgaagccgggaggcggaggttgcggtgagccgcgatcatgccattgcgctccagccagggtaacaagagcaaagctctgtatcaaaaaaaaaaaaaaaagtgaaaaagtgaaagtgtgagtgactagcagagcagggatttgaacttaggccttctctctggaagttctgtgctctttcctggcattcaccagaaaaggctttgcatggaactcaatttcattattatatatctttttaaaattccccatatctatctacatgacactgcctgtgctcactcactctatctcttgcatgtgtgtgtgtgtgtgtgtgtgtatttcattacataaaattaatttgatatagggaaataaggagtcttttttcttaagcaatataaagtaagctctttaacgcccagatcttcatcatccatgtttgtttctgccttgttactcaagtgtccagcacagaataaaagcaataaagcaatgggctcttaattaatatttctgtagttattcttagtatgagagcaatcaaagacattttcagggatccatgcctaatgacatctgttgagctcatcctaagatagtttccttagggataagtgagatttatttcttatagctgtcccataaaatgtctatattgttacctctaaaaaagtaataaggacttacggggaattttatgaccactgaaataacactcccttgagaaattcaggaagatggcaaaatttcaaatgctcttacactttgttaggggagtgctgtggcattttgttccatgtactgtcaattttaaaacatgacatgacttataaaagtggcttttatcaaaatcttttctgaacataagcaggttctgctttttcttgctatatcaatgattttatacaaccttctttcatcttttaatttttgtcagaatgttgtagagattgtttcagcctgactttgatctccactgcaagaatgaactgaattcaataatagagggaattgcaatgcacatcggaccccaaggggatcagcccatcctttagtggagggctcctgcctcacttcacactgaaatttaaactccttctctggtccctggtaactacagtgtccacaaggtccagcaacaaaacaaactatatgaaagcaatataaccttaccactatttagattgttaaaattagttttggggaatttattcctcagttaatcaggtccaatgtgtatctatgtactgagattcaggattttatcctgttagcactaccataagagtttagatttccttaaatgagaaaaatgcaatatgtgtatgttttagatatatagctctgcaattatgaatttctatcaataatattatacatagaaaacgtatcttgtatgtcctccaattgtgatcagagaaaaacgtacaagaaatattaggagccttttccttagagtttctgaataaaaacatgagaagaagcaaacttgtgttcgaggggtgctaaaacatcctgcaaatcttcagctctggagtcacaggaccagacaactgggatccatgaaggcatctcaggactcaccgtccactccctcacttcccagggaggacactggtcacccacagggattatgtgatttgtccaaggtgacagcacaagtcagtgtcaagatgcccactctcctatagtcctagtcactgtcctgcccagcttgctgcctctcttgagactttgagaaggagcacaaggccatgccaatttccatgctcagcacaaacactcacaccacccccactgctctccagggatcactcacacagaacctcagccagtacctacacactgctaacagactcccacaaatgtgaggcagctgaactcagcttcccacgagcactcagcagagggaagaccataggaaactgtgagagtctagttggctgccaatttattaatatgttgtaggacttcaacaatagaatctcatcctcagactcaagctacacatggatgcctccctccaataagccatggtgctacattcagtgcctcttaccctgctgtgcatcacgggatgaggacatcagagccaggttccagcccagtgtccatcactaacctcaccctggaagagtaataagaatcatctcacctctcctggcatccatctcctcccctgtggaatgttatgtggtcacctggataatatctagggtgccagtatcactattctaggcttccgtgatggtaaacaagggcttgggaagaaggaagctagtgatgactatgaagacagcccaagagatacacaggactctctcaaggcaacgtacatttcctgggtgagaaaccaggctccaggcagagaacacatcttttccttaattgtaataaaaaccagggagacgtggtctatttttcatgcaccttcaaagccactggtgcacacaaaactaatagcacctgcttcaaacagcagcagctctttgacctccagcctaattagcgcatttctccagtgaaaccatctggacagggtccgccctggctcatttccttcattaacaaatcttccaagtggcaacagaagtctcctgtgttggcgccaaccttacaggcacacctcacggctgacagggcccgaagtgtggtggcatttttcattttctaatcaaaggggtcagcgtaaatgggtgttggcagttgacggctgcagctgtctgatgtgtcaactccttgccacacagagtttctaataaatggtgctggaaaaataattcacccctcagctttctgtcacagcggctatggtgggagatccttgggtggccgctttcctgtcccacttatttgtgcaagaggtggggagtgtgtacatgtagacacagttacatccatgcataaacactcatgcacaggaatgggatggaggagccctgcattactgtggtcgtgtttttagtactcaaccctgaaaaccaaggagagtgggtggggagggacaccagcatctgctaatacttaacgcgagcatggaagccactaaaagatgtggaggagggcagctcttgaagctgctggtggccctctgtcctcatgcacaggtgataagaatgacaggggtccagcacctggtcaggccagggcagggcatgcttaactggaagtccacatgggtcgcagaaggcagggagacacaaaatgctgtggctgcagcatccagagaagcccatccatcttaacctcagatccaagctgaggggctatcaagaaaggaaaggattgtaaaatagctcattctttgctcacagaacctcagcacacaaagagagaaccaagtactcaaactagagaaagtatcatgaacacggtaaagaaatactcccaaagaaggagaagggcctgagttaatctttcagaacttcttggaagaagtaaccctacctagcaatgctgggaagaaacactatacttgcagtcaacttgaaattagtacagtagtccccccttatccatggttttagttacccagggtcaactgtagtccaaaaatattaagtgaaaaattccagaaacaaacaatttataagttttaaattgcataacattctgagtagcaagatgaaatctcatgcttcattgttcagtcccatccaggatgggaatcatcccttggtctgggagattcacactgtaagccctgcctacctaccctgagtcacttaatagccatctcagtgatcagatggactgtggcggcgtcttagtgcctgtgttcaaggaacccttatgttacttaagaatggccccaaagtgcaagaagagtgacgggctggcatattattacaattatctattttattattattgttcttaatctcttgctgtgtctaatttgtaagtcatacttgatcctaggtatgtatgtataggaaaaaacacggtatatgtatcctttggtaccatccaaggtttcagacatccactgggggtcttggaactcatccctaggaatggataaggaagaattgatgtacataatagaaccatagactaagtcccctgatataagaaagtaaaatctcaatgtcttggctatagtgagaaaaagttctcaccagttccttaggaagaactagacaaaacctaccacacataatctaaatttattgcatatatttagggtaaaaataatacatagtaaatacatctaattctatcttatggatttagttattctcaatttatcccttttgtcttcataaagttctgacttgcttgacagatatctgaattgaaccccatatagcccctagcacaatagagaacatggggcctaggggccaggcatggaagcagatttatggaagctgactcatattttacttatgtctcggtatgctccaggttaaaacagcacattattcacagatatctacatgccaacacagtaaagactcagcaacaatcctataatgcctggttggtctagttgatatcatgctctgttatggccccaccacccttaagtagaataaacacacacattctgtaattcagcttaacatgtgtaagacttctttttaaagaatcagttggagggaacactgaatatcactgagttcaaatgcttccttttactgatgaagaacctgaggcccaaacaagtaaattaattagcttgcctacggccacccagccagttagttttaagagggcccagtggtcctggctaccagtccacctctccttccttaggtttcactaccttgtgaagttaaaggaaaccaataaattacattttcgtatgtaattatgaatgacttattagatacaaagatacgttatctttaatgcatacaatctttacaatatttaaatcagttatctttttcttatgatttttgacaagatgaactaagtctaaatgaaaataagaaacaacaatgcctagtctttagtgagtctggttattggttactccagaatatgtggctggctgacatatggcctggtcaaaatcacccttaacaactagccagaaaggaaccttcagatcccaatgccaaattcacacatgcacataggactccttgatattcaaactccagttgggaaagctattttattgacatcgccaaaggagccaaaactgtctcacaaatgtacgacctgcatatattcaaccgcataagaacattcaacagaatacatcagcttagcattgacaacttaccacattcacctagtctgttggcagactagacatattcatggcagttatcgcattaatgggatctagacattcttaatcacaatgtctgtaatatttcattttaatagtacctgccagcagataaaaaaaatctacatttcatttcatttatcctgtacatttctctcacatcttgcattactttctattcaggtggctctggctcaagaatatgcaatgcaggtgcctacagtaatttaatagctctatcatctgcatggcaaattcatgggggtaagatgtgtatgccacagaaataaagttacctttttatctaagcacctacttaaaaaatttttctgtttaaacagtatttcagaagtaatctggcattgcccttaattgaaaatacaaatttccacaccttaagagatcccaagaactgcctcaagctgaggcgttagctctgaccctcattgcatccctgcctggggagggcagggcaagcgagcagctggacaggaggtcttcaagaaaaccaggaagaggataatagtgcaccaatggctccttattcccttctcagttattccctaccatggccatcttactatctgcacctcaagcccctcacttcccttccttacttcctccatctttcctttgatttaatatatttctctccccctcctacttttccttctagttttgatactgtccacctttacctacatagagtgaaactattatatttagacactatgaaggtatcttgaacaaaatgtcaaattacatctgctctgctgctcttacatatgaggatggatatggctctgatcacaatggatgatttattccatcttctatgaactagtcttctgatcaacagtatgaacttgtaaaataaacaagtggggataaagacagcatctatggtcttagaaaagcatccccagtcccaactcctatacaaagctttaaagtgaaaacgtgagatcttcattagctctatgtcaccaactgtattagtctgttctcatattgctataaagaagtacctgggactgggtaatttatttaaaaaaaaaaaggtttaatcagctcatgtttctgcaagctgtacaggaagcatagtggcttctgcttctagggagggcctcaggaagcttccaatcatggcagaaggtgaagggggagcaggtatctcacacagtccgaacaagagcataagagagacagggggaggtgtcacacattttgaaatgaccagacctcgggggaactcacttgctatcacaaggacataccaaaggggatggtgcgaagccatttaagaaaaccgcccccattatctaatcacctcacaccaggccccacctccaacactggggattacatttcaatatgagatttaggtagggacacacatccaaaccgtatcaccaacccaggaccctaaagttccagtctttaggaattcatgtggtgcagctccacatgaaggaagaaataactgccattgtgaatcttgaagatgctgctgtaagaagtattgttatatctttaaaaaaaaaatccaaaccgataatccagtctagaactgtactatccaataagggaactactagccacacatggcaacacaaagtcattaacattaaataagatttagaactcagctcctcagttatgccagccccatttcaatggctcattagctccatgtgactagtggctaccgtatcaagagcaaagatgaacactgcagaaatttcgattgggcacagctgatctaaagagacaggagggccctattacaaaccagcaataagaaaatgcctttcttggcaatttgactatagtagcgaattctgtctctaattcttgaggcaagtgggcatacctgccctaaagccagcaattttcaactgtgctccatggagtcccttagtggctggtgcaggtagaaaggacaggaaagggaaaggcagacagagcaggctcagggctgcatacatccctcttcaaccagcacctctgcttccatagagttgtatgtatcacttgactccaagctcctgagaaacattatatattcactttggagttttaattgctataaattatcatgcatggggaaaaaaattggagagacgtgggatctaccaccacatcactggagacggccctaaaatccatcagattgtttccggtataaaatcatgttttccaacctcacatgggccttctgtgcaactctgcaattcccccatgcacctcttactgactcagtgtattactcaaagaaccattacctgcctctttatgtaatcccatgtccaattccatcatggttactctctgcaaaaactctacttcttaattacctgggacaaatgaggcgacctgatatgacctccttgaagtcttttcttctctgtccaaaatttctcagcactcatcccttatgcctttgtttctgtcttcatggctgtacctccacttgtatattaaatagcattccctcctatttgccccaggaattgctccatctactattctcacttgctttcatcttcaatctctccctggttactggatctttctcctcagagcataagcattcttatgtgcttaaaaaaaagagcaaacacataacaaaccaacttctcctgctacggttctttcccttttcctcaccaaacttctcaacagtagtagacactctccacctttaccttccttacccccttgtaacctgatttctgccttcatacattttgttaaactcacttcaaagctaccagtgacatcttaatgacagtctgcagacccattctcctcaatatcaaaacatctcagccccacagcacagatggcttgaccagccatctctttccaggaacctctctccctcagctttggtgatgctggtcgtgtctgacactcctctgcctcgctgaccaagccttctccggctgtctcctatctcctgcccctgcaacctagacagatactccctacacaatgtgtcagcttccctcttcccatttcattctgcatgcactccctcaatgatgtcagtcacaattccaaacatcacttattttccatggctgttctccttattttcagcccaaatctgctggatgtagttataggaagggaagtatgctgctgtggatgtacttataggaatggatgtatgatgtagttataggatggatgtctgctggatgtagttataggaatgcttctcaacatgaccaaacccaaactcatcaaagcctcacaaataagcttctcttcctgtacacagtgtggaatggcactttcttactttatcattcccactgtaaccccctagtttgggctcccattaactctctcctgctaattgctgcctgttacaggagcccaaaaaaccctctgacataaccatataaattattttatttctccttgcaaaaaaaaaaatatatcaatctcttcgctctgtctactgcctttggaaaaataccacaagggtttttgcgaaccttcccagaagatggcctatgcatgttacaacaatgcaagaaagcacatactgttggcaaagttcccatgagaagcaagattcatctagaagctatgtttgcttgctttttgatattctcactctgccatagtctcaagtgaaattagagttgtgacaaaatgtgacctctgacctagagtttctgctaagataaaagcaacaaaatgtatgaaaatgtttcctcctcctcttcctttccacctccttgcatctcctcatctttgttctggtactggactaataatccaagatgctcggcattagagagagggtaagagcaagaaaataactcccaagcatctcatagctctgcattttacagaaaaaagcaaggcagtaaaacctttgcactgttctctgttattgttctaaaatttttatcttattaagacagagaaaaaataacagaagtaaagtctggcccagagggaaagcatcattaattttggaagaaccaagatgtctcatgcccagtttcccttctccaaactactttattcaccattatcatattaattttccttgaacacaattctactattccttacttaagaccataagtggttccattttttatacagaataaagtcatagaataccagctcttgagagcccaaattggtcaattcatttaatccaatccctctgaactttatgataaaaatcttagtccagcgaggttaactgactttcccaaagatcattccattattgaaaatgctgggtttatgcatattatacatgctaatatgtcatatttcttttctaaaatacgatttccatagctccaggtatcttttcttcattaaacatattgaatgggctagaacatcctagaatatggcacttataaactttataaacctctagagaaacaatatgatttctaagttagatccagatatctgagttaaggtggataaactaggagttactgaagcaatcaagaaaatattttcacttaaaggcaatgctcaaaaacactcagaaaaaaaaatgttctcctttgtaaatgtgtgggaaggaagcaaagaaaagaggaaagagaaagaactgaatgtgtgggaataattgggaagattaacagcaagattcactaaaaatgattccattttttttcttgtaaagaatactttaaatttcataattacagattccagggaactagatacttaaatccattagtgacatttgtttgacttccgcatttccagaggaaatcagaagcttattttagtttttgttctcactcttctctttttcacccacccaaattgggttgagatgtttgacaaagtaagccctagtacaatggaaattaggctctagcaaaatgagaagctgtgcaaagccctttaagtactgtgaaatcaaatgttcccattcttccaacagatattgaaaaggcacagaaataaaatcagatccaactctcactttctattttgagcagagggtttaaatgccatcagcttagattaatgtattagtcacctcgcataagtatgtttcatttacagggaagccaagtgaatatattaactaaaatgataatgtgctgaaggcacgccatagcctttttaaataaagaaatcatgattttccttgtctgtattttgtaaatgtccaaaccaccacaagtttacaactcaaaagaaagagattgccatgaaaatcaaatgatcaacctccactttcatgtctcaaaaacgatatgtttttagcttaacactcactcagaaggttattcaccatatatgtgtgaggttgttataaaaattcaaaactagaatatatgtcgtctgcctgactcagatgtcagcagaagcactttctttactccatcacagatacattaatccatcatggtcatcttttaactgagtttctgaatccttacacacatggccaatggatggaaatgcccacagaaacatcattattattgggcaaatctcctttctaagtactttgcagatattaattccatctgatgctcccatcgaccctattgatggtttaacttattttaatcattattaatattattattattttacaatgaggaaacagagaaaaattaagcaacttgcccaaagtcacaaagctagcaaactgcagaggtgggatgtgagcccaggcaatgtatctccagagtctgtactcttcaccactactgtgtcatctcatcagtatggggaggtattggttaaagggttcaaagtttcaggtattcaggaggagtaagttctggagatctaatatacagcatggggttgattattaataacactatattgtatacttgaaatttgcaaagaagatagatcttaaatgttcttaccacacatacacacacacacatatacacagaagaggtaactatgtgaggtgatggatatgttaattaacttgattgtagtaatcatttcacaatgcatatgtatatcaaaacatcataatgtaaatatacacaatctttatttgtctgttatacttcaaaaaggttagaagaagaacggttgtctaagagctttctagggaccactaaatgtaaaaataaaataaaacaaaaaataaataaaaactaatacagagagaaggtggggttttaaccttctatggaaatgttcaaacatacacaacaagtgaagtagtacaatgaatcttcatggttccatcatccagcttcaaatattttcaaatatttgtcaatcttttttcacctatcttctcccacctctagttgtttttcctcccctttggtggagtattttataagcaaattcagaaggttgtcaattacctaaaaccaatgtggaagaattccatctgaagacataatgcagtagtgctgagccagcctggagaggacctgcagggcatgaggtctttcttcacctcactcaggatgcatggatacttcccccttcctgtgcctcctccctcccctgcccaccaaatgctgtgtggtcttcaatcatagccatgctaacatttccctgcatggctttatgtgcataatcctgtctccccattccctgcaagtgtgagtgaggactcacccttgtccaggtcatggcagccctggcgctgagcttatgcttaccacatagaatatgctgaaagaatgtagaatcgggaaagggtaagcagataatctaatcttcataaaacaagccagccaagaacactgaagcagttcaactagacattatttgtactataaataaaaatgttccccaaaccttcagtttatcttataaccagaaatggtcaacatccttaaaaataaaacaaaacatgcttgcaatctaatcctatctctgggtgcaactcatcattgtctgagtgcttctgaagagaatgaacaaagacatcattaagagtaacatcaaacaggcaatagcttctctgaagtctgacctcacaagccacctttggctgctttttccatgaataaaaaatgactctctcattgccgatgaacatgagatgggttaatggctgtttctgtaagttattaataacatttcttgtcaaccctgatcttatttaaaatgcatgtcagacgtagaaaatcaaatgtgttatgtatgtaaatgtattttatagtattcatcagtgtaaaccctaaagttaacattgcaaaaagctttcatattaaccctcattttcattgattaaccttccaaaaggctagcagttttccacttcagataattatccccagaacccaaatcctattcaataattaaaagaacatttacttattttatatattaaaacaagaaataaaactctagaatttaataagaatatctatacttgatcttagccaaaaggctgagaagtgattaatgagaatatctaacctcctcaaaacgagacatctaagtttggaaactttgaaattctctcacgaatagcctcaaaggtagggttttagcccaattctttaaaaacaattaagtatatccaaggagatatataggttactggatacttgtgagactactaagtcagtctttatgatgtttatctctgaatatatttagagttcaaagggttttctactctttggcttatgtaaattatctctatgtataccacagtcaataaaaataacattttagaggtcctagaagaatgtgagagccataattatgagcttcatcaactatgaaaatccatgcataaagtaaaaatatgttcccaatacaaaatactctcaaagatacctaagttactctcaaaaatctttttccatacccttacataagagaaaaagtttctattgggagataacttcccttaaaattctactattgtaaaggacagtgtcctttagtgtgagagatactaaaattattaagaggcatagcccccaccccctaagagcttatagtctgtaggggagagaggacataaaaacaaataactacaagaactagtaggtaataaaagtgatacaagccaagagccctaggggtttccaggaacaaaaaaatcacattgagggatttttagaggaagtaaaatttgaaatgtacctaaaagtgatagaatctgcagagagagatggcaggtggtgcgggtagggatagaaggccgggggaggtgtattccagagatgaatggtttaaatcaaaaccaaaaggcaggaaagcacaaagccctcatagaaaaatgtgagcaacacatttttgttactcacatttggctagttgggagtatatgtcaggatggtatgcagggaaggtgggagggccaggtcatggaagacctgggaagtctgacaggtgaagcaggcataggggcaccatgcagcaattgaaacggggtcaaagggaaaattaccaaggaccatgtgcttgtggattagaaagcactgccacagttttaacagagatgaggagagagaagaatgaggatgtggtaagtgccagagagaaagaattcaccagaaatgatgagtgaacagaaaagaaggcaaaaagcagccatgacatggccaggcacggtggctcatgcctgtaatcccagcactttgggaggccgaggcaggtggatcacaaggtcaggagttcaagaccagcctggccaagatggtgaaaccccatctactaaaaatacaaaaactagctaggtgtggtagcacatgcctgtatttccaactactcaggaggctgaggcagagaattgcttaagcccaagagacagaggctgcagtgagacgagatcatgccactgcactccaggtaacagagcaagactccgtctccaaaaaatcagcaggcatgacataatgctgattttgaaattcccaacctgggttgccaggtgatcacagatatcattaaaagatagagcaacttccagagaaggttttggtttgtactaaaaaacgaagaatttgttttctgaaaaagtgttcagtttgcagtgagctgggccatcgggttagagatacttgatggctcatttgaaatgcaggtgagtagttctagagggacatcggagctagagatacagatatgagcattgtgtccaaactgttaagggctgaaactgtagatcagatgacaaggtgaagactaggagacctgaacagacacattctgagaacaaatcttggggagctcaaatatgtaggcttagcacccaggagacaaacagcgccacgatgaagtggcaggctgcaccaggaatggcaactcctcagattcaggaagttttctgaatgcaccaacagcaccgctcccctaccaaagatctcctagagttcatctccaccttccaaaaggctgtctggcttacaatcccttctgagaaacaacctgatatcctcatcagaaattaaccctccacttcatgacacttttcaggctccgaaaacatacatcctttgccaggattatttatgcgaacgtcagcctctctgcccacctccccagctgtatccctacttccctatcatctgaatacttctgtgcaccaggaaaaaaagaaaaaaacaggagaaaaacttctaattttttttttacttgttttttaaattctttgccccatgatttctgttcttaggttatcccatggagaaaacatggcagtatttgaaaagagaggaagaagaggagaaactggaaaggaaagctgcaaatatcatattcttcatgtacttctttgatagctattttctgtttcttgggcacccagtaaatgaagtgctattcagaatacataatgacataggatcttccacataaattattctatccttgggcgatatgatctattttcattaatgattaatttatgaaacctaagtcatcctattttccctccgcacatgttcctaaagattttgactttaagtcgcatctgcctacccacttggaaaatcaagtctatacctaattactgattaatgtgataacgaagtacaggttgagtatcccttatccaaaattcttgggaccagaattgttttgaactttggaatttttcagatcttggaatatttttattataccagttgagcaactcaaaccccaaaatccaaaatccaaaatgctccagtgactatttcccatgggcatcgtgtcagtgttcaaaataattttgggttttggagcatttcgaatttcagattttctgatttgggatgcacaacctatacacattaggtaatagtatgtttccgacactaaattctatagtacggtcattatttttatcagtaagtttctatcacctaaagtatatttgggatctttttttcatctctgaacattataaaagaactaaggagccacatcctgggtcagaccgatatgttaagtttacgcttaatttctaagttagaaaattacgttccctctttcaatgtaaatatttttttgaaaagctatgggtcactaatttgaggctctaaatgggccaaccttgtaatcttcatgtgacgaactggtaagggaatgaagggagctgcctagggctatcctggaggcacgatacacatgcaggtgctgtgtgagtccacaggaactgtggctacttgttgaagattacaaggaggcaatctgaactcatagagagcacttcctaaggagagcctcagaggtggcttctgcgtaaagcggaaccctctctagctcttaagagcattcccgcaggggctggctgacaacctgggaagcctgaggggcctctcaagtcagctctgactctaagatttgctttactaatagaaagaaaatatattcaaatcatgcatatatcttccctgtatatggcagctttaagaaggaaatagagtagaaagaacaccagcccaggacccagggcaagtcaacctgatctcagtttgctcagctgtaaaatgggtggtaaactggatggtaagataccttcaagttctgaggacctatgaacataattcatttccctgtgcctgtcttgtttgccacaaccttgtggaaaaggtaaaaagacatagaagagcacctgacttagaaagcctctgctcaatggggttgggctaatggcctgaagcctgagcccagggtggatgcggactctatgtggaacagctgagaccccaaatggtcctgccatctcatgtccagggggatgcatggggctcccgtttccacattcatcatcacttgcccctcaggacccagggaaacagcaaggaagagtctcagtagagccaggctagcctaggaaacactcataaattcataatgagtcacttaaaagtgtcccaatatagcatgccacagtcagtgtggacattgtttagactgttaatatgcacaaacatctaaaaatatgaattatactttgcaaataccatatgcaccacataacgatgcttcagtcaacaacagaacacatataggacagtggtcctgtaagattataaatgagctgaaaagttcctattgcctagtgacgtcttagccaccgtaatgtcatagcacaacacattactcacgtttgtggtgttgctggtgtaaaccaggcctccaggatagccctggtttatcacataaaagtgtacaatgatgtcctagaccttcatattcattcacaactcattctctgactcaccaagagcaccttccactcctgcaagcttcattcgtgcttacgtaccctatacaggaacagcatttttagtttttaaaccatagctttactatacttcttctatgtttagatattgttacatataccaatacgcactattgtgttataattgccgacagtatttagtacagtaaatgctctataggtttgcagcctaggagccaaggctataccatattgcctaggtgtgtagtaggctatgtcatctaggtttgtgcaagtacactctatgatgtttgcgccacgatgacactgcctaacaacatacttctcagaacatatccccgtcattaagcaatgtgtgactatagattcttatcatgctcatgtttcagattttgaaacatctactctgcatgacataatccctaattacagcagtattccttaaatgaatcctatgtgaaaataatgtctgcaaaaagaccagctttccaagaagaagaaaaaaggaccgattctgataccacattggctgtttccatgagctgaaccagcaaagctttgctccagcaaagctttccacacaccatctctgtaaactcaagaaagaacagagaatgaacaagcttggagaagaaagctttgttggaaagatatataccatatgagaagttgatctaaggacttttagctctctcaagagcttcatattttatttattccctgtcatcaaagcatcatctcttcgctaaagaacagaaacaaaatatttattgacattacatctaataacaagtataggtataatgattagtagtacttagacaaatcaaattcatggggggtttttctgtgatttattggtgaagtaaaaattacatatatagtaggtagcagataattaaaaatcaattctaacatatgtttcttaaaatagaaaacaattctggatagacattcatataaaagtgtgacttttagtatgaagtctttaaactgggagttattttctctggcacatacagctcttatcccctgggtgctcaggggtccctctctagtatcctctgaagcagaggtgagaagaaatgtcctaagcgcacctgcaattattctgtccagacctgtcagctctctgtcagcaaaagctgctgtcatgtggacatggctcatcttgccttgaggttaattttttttaagacatcaaaatcttaactcctttgttggaaagatatatatcatatgataagtttttccttcatactactttctctaaaaaagaaacacgtcatcaggaattttattaataaaaatgatgataaatagttgctcctgtattttcaaatcatcagactgctaatatgcacatgcatatctcaaaacatgaattacacatttgcaaacagttctttattacattcatgtttcagattttgagacccctactgtgtaatgatgtaatcactaattacagtgatattccttaaatgtatcctgtgtgaaagcaggcctcagctacggcaccttcaggaaaccaacagagcaaataaaacacccttagaaactgcttacaaacacatcaagacaaagggaaatgtaatgtattacttttataaataactaggtagaccaaaatttagaactacgcaaatgttccacacatcatctctgtaaacacaagaaagaacagagaataaacaagcttggacaagaaattgacaaaataacaaatcaatcgatctctctctctctctttcgaattattccagcttgattcaacttctataaccccttcaaaacagctctctacgtggaaacctctaagactttcctgggcccctggcaaggtcttgaaaacaacatctgagatgtcatggtttcccatccaataacattgactttgaagtggtgactgagatggggtttggtcatcaaaggcacagctgaatgggcaacctccagatcttcctcagggacagcagctgttgtaacatgctctgcaggttattcattcatactttaaaatgcagtctacaataccagtctcaggaaatgggcctgcaacagcaccatctcagctaatggagatcttcctgggcatggacttgaagaagcttggcagtgctttgctacttttaacatcatttatttaactttcagaaatccagtcaagtgctctggcagtgtgaaggcattactggtaatcacaggcgactaaatgattctttcagctaatattaaatatctagtatgtttcatgacagcacaatgtaggtaacacctttcttggatctttctttgacttcttacctagaatctgcaaagcaaagggctgctggaatctgtctctggataagtcattttctacatcctaagaggtggttacaatctttttttcctggcacactaactccccataactgatggtgtcaaatgggctatttttcttcagtagatgaataacacaacaatgggaagctaagggaggtgatgcaaattcttaaataatcatgcaaagaaaatgacacacagttacacaggcgcgccggttttaattcagtgaaggcaccccaccctgccccaccccacttacgggtggctggccggccctgctctggctgtgcactgtccccggactgggtgctggagactgaggagacgctggagctccggacaaagccaaatgccgccagtttggctgccgggagacgtgagtatccgggaggacggagaccagatttcgggagattggattttgcagcatttgaactggaagctttctttaaatctgctaaaacgaacccaaataaaattaaaaaattattctcagttcataatgagataatgaattctacagattatgaattcgaacccagttctatcataaacagactaaaattaatcttgcaaggtttgattcaacacatctaaaatggaccttggaagagaaaggccccttatattgtgggtcaggtgcctcagagaactcagagaggaggtggtgcagccccagcctggacaaatttaccgtctacttaggcagatgaattgaggaagacaaataactctattttaaggctataagaaaaggtatcaagtgcttaagacaatgagtgaaagcgaatagttattgttgcatgttaccccagattcgtgaaattgagatacaccttaaattttgacatacaatgggcaaagaaccattggggtgaacattcactagtaattttaagcagtttgtaataagtcttatgaaaaatatgtacaaagaatcatctaaccttctgttgggtgcaggaatgaggaggagatagtgcagactgtggaactagccaggctggaatatcagctctcccaatgacgagctgtgtaacctcaagcccttgtcctaacacttaaagccacagtttcctttcatgtgaagactgggaatgataacactgactttgcaaatctagtataaatattactgcttataccacaagaacttgatatgtgctcaaactgatgttagatttcttttctcctttttacactatctgttatgttagtccaaacttcagaattagttcccagatatgtgcaaagtcagcttgttttgaaataataaaacatcaagttataaatctagcatctcagcatccccatactctaagtctgagccaggctccagcaatagcaactgcaatgattatcacaacactatgagaaggcgctcagcaccagagagaatcacaatattgtcaatatacaaatgctctttaataggaaatctaaaaggcccaagcttcctcacgtgctgtagtgctgtataactgtcctcattgattcctttaacaacgttcaccagcaggcatatttaccatgagtgcctatatactgcccattcagtggcattcttatgctagtcaagtcttcattatccagtaaaatattaaccaggtttcagagtaaacgaggatttagattaaatgacccatttgaaaaaaaaattccacgtctataaatccatgaagaaaccacatattagaaagcatctatgtgtgggaataagagagcagcaataaatgatacactgggtctaaatggtacatagaaaagtacctcttcctctgccagcagctcccccgaaagtgaggctatggagagccgtgtgtccagtaaaggcagaagctgcacagctgtgggttcctgatgcctgagtcaggactaggatggggaggaaccgagtaagtgcaaaaggaaaaagaagcaaagagctggggctgcaaatattcccaactcaagcctgtcctagtgcttgggaaaagcacaaaaaacaaaaaacaaaacctcaactatgaaaaagaagaaacaatacactaacaagtggtaatggcccgtttgtatcagcaatttatgccacgtttaatgacttcacattgttgttctcacattattttgaatacttttagttcatatccccagaacagtgaaaatatccctatatatcagatatcatgttcacagtgaatttacgacaaattgattgtggacgatgtctgtagaacaggaaaagagttgctaaacatcagatgtaatttcaacaataagtatactctaaatccattacactttgatactattttaagttatctatcacctcctttctaacctagttaatcaataattatgcaaaatcgagtgaggagaatatgaacaaaataatttttctgaaaaacaaactatattttggaagaaaagttaaactcagaatttttaacagagtacctaggcatgcagtaagcatttactacttagtcaagaatgaaaactaagtttgttaaatcattatataagacaagccactgaacatgttcaaaaagaaatttatcttattctgcacttacttatattccattattgttgatttcatcagtagaaaagtagcactggaacatgtagagacggggaggacaagcagcacaagatcccaagcacacaggaagccagtctctaaattgttttctaggtttccctttcccatagtccagatctttattttaataaagacacacatgggctgtgtgtttgtgtgtgtgtgcatgcacgcacatgtgtgtgtgtgtgtgtgtgtttagatgacttgcaaaagtataccttgccccaactctctgcgcatacaatttttgtaaatctaatggtacctatatcatacactaagttactatataatggtctttccttctagcagattaagctcatgaatatcatacacgccttcagggtttgcagaagcaagtcttattccttttataccaccagctcctagcacaatggtttccacaatgtatttgataaatatttagttgaagtttacattagccaagcttgtaccacacaaatttagcccacagtataagtcaaatatctcaactagtctctgcatgagagttggtctggagtagagctcaagagtctgctttttaaacaatcacgtcagtgattctgattcaggtggtccctggatctttgaaaacttcaacagaatacgccaactcaccctgtgaaataactgcattcagctcttctgactgaatgtatcttaatttaatcttagtgtctcataagaaagacatatttataaaaatatatagtacttactatttctcaaacaagtccagtgttatggatggactgaatgtctgtctcccccaaccccaaaatcacaggtttaaatcctaacttccaatgtgatgatattcagaggtgggacctttaggaggtaattaggttataagaatggagcccttgtgaatgggattagtgcctaagtgcccatatgaaaagaagctggaaacagagctccctctgtttccaccatgtgaagatataatgagaagatggtggtctgcaaccctgatctcagaccttcagccacaagaactgtgagaaatacatttctgtttttatacgctacactgtctatggtactttgttatacggctggaactaagacatttagcatgttagaggaatatatgtttccaagtacttagtgttcttggactattcaagaatatagactttgacagaaatacaaatgttacaagtgcataataagccttcaataaacaaatgatagctataaatattacaggaaagctgaggtggcacataaaaaagacaacttccaaaatggtgacatgaggctttccatggacactcttcccagtgaaacaaacataactggtaaaataacatttaaaataacaaccaccatttaaagtttccagaaattgttctatgaacatgtagcacttaaagaaacatttatataagaaactctactaaatccagtaagaacagtgaaagtcagtggcacttgaaccacaatccactctcttcctcccctactatcatcacaatatatgaaagctctactctggatgtgtgtggccaaaaggatgggtttcctctcctagagtcaaggactatagtatcttcctgggatgggcaggccaccaccaattctcactccaaccccacccccagttccatgttgtagaggctgaattacatgagagagtggtcaaaaggtcagggaaccttccttcacttggcccaaacatataagacagaggtactaccccaggcacagcaagccaaacaatactggggccccaatcaccatttcccaatcacctatggctcaccataggctagaagttcaacacttgagagaaaaagggagaagactagaagctactgtccctacctcgcacctcgcttataaaccaggagtgtcaatccaagagaagcagtccactgtccccaaccccagcttcagaatggtgactgagagattttgcccaatcatagaggcaggccataagaacagagatctccagagtcctctacaaaggaattaactttgtttggaacaaactgtgagggaagtttgggcctaacggcaatctcaaaaacaataaagattttgatggtaagcaattaggaggaggctggtagctccatgaagcaaaataataaaccatagacaaggtagtttattagagagagccaaggaaataactgaaaagagctatccaggggtcagaactaacctcaaagagtggctttaaaaactacccttgaaaaggagcttgaatttaactggatcagactgtggaataatgtatgccccaggacactgtagaaaattatagagcaatcagtcagtaattagtggaacctgacagctgaatgtgataccaaagggaggaagacaatgtaacacagatccgggagagacagccctgctaaaacattcttagtgtgattgtgtacatgcccaaggctatgtcttctgtggagcaacattagtgaattcacagtgcaagggaaataggcttcattaaagtagatcaaccaagttgttaaacaaataaataagcaaacaacaagccccagagaggaagagagataattagtagtcaaggatgctacataattatctaaaagtttcattacaacaaaaataaaatgagacacacaaaagaaaaaaatacagaaaagggtgattcagatactagaaaaaagcaggcaacagaaactgcctatgaaaagacccagcagtcaaaaacttcaaaagagctattataaatataataaaataactaaggaaactatgcttaaagaagtaaaggagctatgacgacaatatttcatcaaatagaaaataacaataaagagagaaattataaaaaccaaatggaaagtttagtgttaaaaaagcaaaataactaaaatgaaatattaactaaaggggctctacaacagatttgcagtggcaggaaaaaaaaagtgaacttgaagatagatcaatacatactacacaatccaaggaacacagcacaaagaaatgaagaaaaataagtggagcctcagagagatgtggaccatcattaagtgcaacatcatacagagaatggatgtttcagaagcagaaaaaaaatttacatagtccaaatctttgaaaatttatttaaattattaatgtatacatcagaagatcaaggaaaaccaaataaggtaaatgtaaagagatccacacctagatacaccatagtaagaagtgtagaaaggtaaagagaaaaacaactgtcaacccagaatgaagagggatagttcacaatgataaaaaggtcaatgcattaggaagatacaataattataaacgtatatacacctaacaacagatacccaaattacatcaagcaaaaatgaacagaattgacaggagaaataaacaattcaaaataatagttcgagacttcaatacctcactttcaataatagaacaatgaggcagaagataaacaagaaaatagaagatctgaacactaactaaacctaacagacctctataaaacattccacccaagagaagcagaatacatatttttctcaagtgcacatagaatattctccaggataaactatatcttaggccataaaacaagcattaataaattaaaaaggattgaaatgatataaagtatgttctgtggtcataacagaatgaaattaaaaatcaataacaaggaaatttgggtaattctcaaatatatgaacacacataaataaccactgggtcaaagataaaattgaaaggggaattagaaaatactaagatgaataaaaatgaatgacataccaaagcttacgggaagcagctaaagcaatgcttaaaaggaaaattataactgtaaatgcctacattaaaaaagaagatagatgtcaattcaataaagtaatttttgactttaaaacactgaagaaagaagagcaaactaaacttaaaccaaaagaagaaaagaaataataaagattacagtgaaaataaataaaacagagaatagaaaaacaggagagaaagccaatgaaaacaaaatcctagttctttgaattatcaataaatttgacaaacctttagctgagccagccaagaaaaacagaaggctcaaattactaaaattaggaatgaaagagggaacatcaccacttattttgcaggatcatatgggaatattgtactatgaacaactgcatctcaacaaattagacaacctagtgaaatggacaaattccacagaaatacaaactataaaagctgaatcaagaagaaatagaaactctgaaaatctaaaagagagattgaattagaaataaaaaaaaaaattcccacaaagaaaaatccaggcacagatgtcattagtgaattctatcaaacatttaaagaagaattaatatgaattattcacaaattacaccccccacccaaaaaaagaagagggaatacttctaaactcattctataagtccagtataatcttgatgctaaaaccagataaagacatctcaagaaaactataaatcaataactcttatagattcaaaatcctcaccaagatactgcgcactgaagctggcaacatatacaaaatattatataccatgatcaagtgatatttatgctaggaatgcaagatcggttttacatacataattaatccatgtactataccatattaataaagaaaaaccatatgatcttcttaattgattcagataaaccacatgataaaaacatttaaactggtaattaaagaaaatatattcaatcttataagggcttattggaaaaacctacagctaatacagtaaaagactgaatccttcccctctaagattaaaaacaagaaaaggttgtctgctctcacaatttctgtttaacattgtatggaaggtgctagccagagaaattaggcaagaaaataaaataagaaatgtacagattggaaacaaaaaggaaaactttctctttgcagatgacatgatcttatatatagaaaatcccaagaaatccactaaaaaactattataactaataaatgagtttagcaagtttacagaatacaattcaacatacagaaatcaactgtatttctacacattcacaataaatcatcaaaaaataaaattaagataacaatttgtatttacagtagaccaaaaggaataaaatacttaggaattatcataaacgatcagactccatagttttttgttttctgtttttttgagatggagtgttgctctgtcgccaggctggagagcagtggcatgatctcggctcactgcaacttccacctcctaggttcaagtgattctcctacctcagcctctcgaatagctgggattacaggcatgcaccaccacgcccagctaatttttgtatttttagtagagatggggtttcaccatgttggccaggatggtctcaatctcttgacctcgtgatctgcccgtcttagtctcccaaagtgctggaattacaggcatgagctacagcacccagccaatactccatagttttttgtttgtttgtttgttttcactttgactgctaacagcttttagcctcaatccccactcctttggccccatatcggggaaagctgttaagaaagcccaatgcaccctcttttgatgctaggaagtgggacaggagtgagggtggtaatttagatcaaaacctcacaaactccgtcccacttccatgagaacacttacacttgccccactccataatgataataaaaatcctgagccagcattctttccttgtgctctcaagccatttcaaatgtatgagaggccagtcctctcttcccagagacttcaattatgtaagtcataaaacttttcaaaccctcttgctttgtgtgtggaataattgatacatgatttttctgtcactttgccagccagagacctccatggccaatgacgtctctgcccagggcctcacttggccctgggcctgttgcagaaggtgccccatccactcgtctggcggggccatgcctggcttgtgcaccagcctggatcccatgctcagcctacaactgggccaggtgtgcccctggcccagctcgtacccgcattcagaggttccgaagttcttgtcccacatccaagatgaataaggttactctgacaatcgaagggtgaggtgggtgaagaagaattttattgagtgaaagaatagctctcagcagagaggggatgcgagggtggtccctacccaaagtcaagtggtcacccacccagcgtggctgggtctgggacttgtatgggcttagaatgggtgagtacatgctgattggtttgttagtatgcaaaaaaaaggctaaaacaaaggcaccatgtaaaggtgggcatgacagtgtaaaaaaacaattagggaagagtaggaatatgtaaaatgggtgaagggttagaatcaatcagaggaacgcacaccaaacagaaagagaggttctcagtccattccatgggtttgacttgtagcttggctttcaggctttaaattggctttggcttgaaggtgtggtttcactgggaacccaaccctatctgcctaggcatttgactgcctcctgctgctatcataatcactcttgacatctaaaccaaatttttggctgaggttcatcttacctcttcagggtggctacaacaacaggtgccggatcaggatgctgagacaatgaccacctccaccggggtctttcctcaggctttggcttgttaacaggctctgctgccttctagcaagcatgtactctgcactgttccttcttggcttcttgtgctttgagctgtgctgctctgtgctgcactgttgagtcctacagagcttctgttacagataatgctgaactaaattggaagattcaatgattaattgattttggaataagattatgagattggggtagggctttcttaagctggccctaggcatgtgtctcagtctggacctatctgtatttctaagaatgaagttgtgacttatgctaggctcaaggaaagattaccctgtgacaactggttatgtgtctcaactaggtattggctccagatctatagagcactaaggggaagactggatcatgtgaagatataagcctactgggcaaaagctcatgaaagagtggtcattaatggaaaaaaaggaaaaagaaacaaaggccataatgtggagtactgagatcggcattccttagaagcagacaactccacaggaccttaaatatcttagttgctgttgcctagacctctgtagccacaaaaatcctgaccctcaagcttatagagaaaaacacccatggcacccttgtggcacactgaagaggttaattcagactctacttgtattagtctgattgtgtcactataaataaatacctgagtgtgggtaatttacaaacaaaagagaaaggggcaggatggctgactagatgcagctgggggagcttctcccacctagagagacagaacctattgagtagactgccatattccaagcagatcttcagaaagaaggcatccagaatcaatagaggaaggatacagaccctggggctgatgaggaggaggttggaaccctgcacaaagttgctgagtaccagaagtcactgtgggtcccaagtggcaaccagagaaggggtgagtgagctaagaatagagtggactactctctccacagacctccaggatcctagctgcaggatactccacgaaacccacagatatatttgaattcatggggagaactgcctggagaggtgacagagacagaactccagtctgcatgggtcccaaagggtttggcatgggaatggctgcagtggagcacagccataggtgcccatccccaaagacttgttagaatcctctaagtggctttagccttcattagctaccagacctaaagagagcagggctctcctgcacagaacatgaccagttttgtatgggcatcccctgtctgctggcctctcctgcagtccctgcctacccatgcccacatgcagtacagccttaaatgccctgctgaaatgcttgctggcagccactgccatagttctttcaccaggagcccctgccttcccattggaacatttttgccaccagtgtgcaaccagctacagccttccttcactggcatgtgcttgcttgcagcctcccccagtcactccactggtgtgggctcgcctgcagccccctgactacagtgtactctcctgcagcccccacgaccccagcacagtgaactctcccacaggcactccactaccctaccagagcacttttgctggcagcccccatcagagtgttgttttccagagaactaggaacatctcggctcttccagcacaggagatgcctgacctcaaggggccagagaacaaaaccaaaagcctggtctcaggtccccagggttagagcatgcagcccaggagtactgactgagcctttgcccactgaaagcatccagaaacaaagtcagccaaacccaacttataccacagtcaaacctcaagggcatcaaagaacataaaagcaaaaagtttcacccaaaaaacagcaactttaaagattaaagtaatatcagcccatagagatgagaaagaaccagggcaagatttctggcaaccataaaagccagagtgtcttaagacatccaaatgaccacattagctccccagcaatgtttcttaaccagtttgaaatggctgaaattaacaacatagaatcaaaatatggatgtcaaggaagctcagtgagatacaggagaaggctgaaacctaattcaaagaaccagtaaaacaatctaacagttgaaagatgacatatccattttaagaaagaaccaaactgaacttccagaaatgaaaaattcactacaggaatttcataatgcaataggaaccactaataacagaatagaccaagctgaggaaagaatgtcagagcttgaacaccgctcctttgaatccatgcagacaaaaaaaagaatttaaaaatgaacaaaaccagcaagaaatataagattatctaaagagaccaaacctatgactcactggcattcctcagagagatgaagagaaagcaagcaacttggaaaacatatttgaggatatggtccacaaaaaattccctgaccttgctagagaggttgacatataaatccaaaacttcagaggacccctgtgaaatactagacaatatgacctttctcaaagcacatagtcatcagattctccaaggtcaatatgaaagaaaagaccttaaagttagctagaaataaggggcaggtcacatacaaaggaaactccatcagcttaacagtggacctttcagcagaaaccctacaagccaaaagagatcggggccctatatttagcatccttaaagaaaagaagttccaacaaagaatttcatacccagccaaactatgcttcataagcgaaggagaaataaaatccttttcagacaagcaaattctagggaaaattgttaccaccagatctgccttagaagaggccataaagggagggctaaatatggaaataaaaacctgatacctgctattgcaaaaacatacttaagtacatagcccactggcaatataaagtaactatgcaatcaagtctacataacaaccagctaacaacatgatgacaggaacaaaccacatatcaatattgaccttaaatgtaaatggattaaacatctcatctaaaagacagagtggcaaattggatagataagcaagacccaactgtgtgctgtcttcaagagatccatctcacatgcaatgacacccataaagtaaggagatggagaaaaatgtatgaaacaaacagaaaacaaaaagaacaggggttgctatttttatcttagaaaaaaatagactatgatttaataagcccactattatgagaaaggataaagaagggtattacataatcataaagggttcaatacaataagatgatttaactatgctgaatgtatatgaacccaatattgcagcaccaagattcattaaagacctataaagaaacttagataaccacacaataatagtgggagacttcaacacctaactgacattagaaatcaaggcagaacattaacgaagatatttgggacctatactcaacacttgaacaaatggacctaacaggcatctacagagcactccacacaacaatgtaagaatgtaccttattctcatctgcacatggcacatactctaagatcaaccacacactcaggcataaagcaattctcaacaaattcaaaaataccaaaatcctaccaaccaaccacactctgagatcacacaataaaattagaaatcaataccaagaagatcactctaaaccatataattacatgaaaattaaacaacttgctcttgaatgacttgggtaaaaaataaaaattaaagcacaaataaaaaagtctttgaaactaatgaaaacaaacatacaacataccagaatctctgggacacagctaaagcagcattaaggggaaagtttataggactaaacacctacaccagaaagttagaaaattcttttttttttttttttttttttttgagacggagtcttgctctgtcacccaggctggagtgcagtggcatgatctcagcccactgcaagctccgcctcccaggttcatgccattctcctgtctcagcctcccaagtagctgggactacaggcacccaccaccacgcctggctaatttttttgtgtttttagaaaagacagggtttcaccatgttagccaggatggtctcaatctcctgaccttgtgatccgcctgcctcagcctaccagagtgccgggattacaggcgtgagccactgcacctggccagaaaatgcttaaactaaccacctaacattatacccagaggaactggagaaatgagagcaaaacaaccccaaaaatcatggaaggactccttcctaactcatttcatgaggccagcatcaacagctaatgactatcaatgccatttttcacagaattagaaaaacgtattctaaaattccaaataccaaaacctgacagagacacatgaaaaaagaaaacttcaggccaatatccctgatgaacatagatgcaaaaatcttcaacaaaatactaggaaactgaatttagcagcacatcaaaaagctaatccaccacaatcaagtaggctttattcttgggatgtaaggttggttcaacatatgcaaaacagtaattgtgatcgaccacataaacagaactaacactacaaaccacataataatctcatagacacagcaaaagctttcaataaaattcaacatcctttcatgttaaaaacctctaacaaacaaggcatttaaggaacatatctcaaactaataagaaccatctatgacaaacccacagccaacatcatactgaatgggcaaaagctgaaagcattctcattaagaactggaacaagataaggatgtccactctcaccattcctattcaacatagtgctggaagtcctagccagagtaatcaggcaagagaaataaataaaggcatccaaataggaagagaggaagtcaaattatcccacttcactgatgatatgattctatacctagaaaaccctaaagactccttcagaaggctcctagaaatgataaacgtcctcagtaaattttcagaatacaaaattaatatataaaacccagtaccatatacaccaataacatttgagctaagaaccaaatcaagaacatgatagccacaaaaagaataaaatacctaggaatacagctaaccagggaggtgaaaaatctctacaaaaactgcaaaacattgctgaaagaaataatagatgacacaaagaaatggaaaaaattccatgctcttggatagaaacaatcaacattgttaaaatggccatagtgcccaaagcaattacagattcaatgttattcctatcaaactatcaatgccatttttcacagaactagaaaaacgtattctcaaattcatatggaaccaaaaaagagccccaatagccaaagcaatcctaagcaaaaagaacaaagctggaggcataacactattcaacttcaaactatactacaagaatatagtaaccaaaacatcatggtactggtacaaaaacaaacacacagaccagtggaacaggttaaagaagccagaaataaaaaccacacacctacaatcttgaagacttaaatgtaatacctataaaaaccctagaagaaatcctaggaaataccattctggacataggccttggcaaagatttcatgataaagtctccaaaagcaattgtaacaaaaagaagaaataaataagtaagatctaattaaagatcttctgcacagcaaaacaacctatcaatagcataaacagaaaacctacagaatgggagaaaatgttagcaaattatgtatgcaacaaagacctaatatccagaatctataaggaacttaaacaaatcaacaagcaagaaacaaacctcatttcaaaatgggcaaagaacatgaatagacacttctcaaaagaagacatacatgcggccaacaagcatatgaaaaaatgctcaacatcactaatcatcagagaaatgcaaatcaaaacctcaatgacataccatctcacaccagtcagaatggctcttttttaaaaatcagtaaataacagattttggcaaggctgaagatgaaagggaatgcttatactctgcaggtgggaatgtaaattagtttggctactatagaaagcagtttagcgaattctcaaagaacttagaactgattttgacctagcaatcccactgctgggtatacagccaaaggaaaaaaagtcattctaccaaaaagatacatgcatgcctatgttcatcatagcactattcacaatagtaaagacatgaaatcaacctaggtgcccaatgaatggtggactggataaagaaaatgtggtacatatacaccatggaatactacacagccacaaaaaaagaacaagatcatgtcctttgcaggaacatgggtggagctggaggccattaccctaagcaaattaacacagggacagaaagccaaattccacatgttctcatctgtaaatgggaactaaactttgagtacatatggacacaaaggtgggaacaatagacagtggggtctacttaagcagggagggtgacaaatgaatgagggtctaaaaactacctattgggtactatgcttactagctgggtgacaaaattatttgtacatcaaacttcagtgacatacaatttactcatgtaacaaacctcacatgtaccccctgaacttaaaataaaagttgaaaagtaaaataaataacagttactaaataaaagaaaaagaaaagaggtttacttttgctcatggttcttctagctgtatgagaaacatggtatcaccctctgcttctagtgagatgtcaggaagcttccactcatggtggaaggtaaagggaagcctgcatgtcacatggcaagaaagggagaaagagagaaagaagggagaggtcccagattcttttaaacaactgcatctccttgcatgaacgaactgagcaagaattcactcatcaccaaggggatggcactaagccatacatgagggatccacccacatgatccaacaccattagccccacctccaacattagggatcacattaacatgagatctggagggacacacatccaaaccatatcactagttaaacccagtgttcttaaaccctataaagtaacctctgaggtcaggcacagtagctcatgcctgtaatcccagcactttggaaggccaacggtgaggggggggggtggatcacctgaggtcaggagttcaagaccagcctggccaacatggtgaaaccccacctctactaaaaatacaaaaattacctgggtgtggtgtcatgcacctacagtcccagctcctagggaggctgaaacaggagaatcgcttgaacccaggaggcagaagttgcagtgagctgagattgcatcactgcactccagcctgggcgacagagcaaggttccatcaaaaaaggaaagaagaaaagaagggggggagaggggaggggaggggaaaggaaaaagagaaagagaccattgcatggaggagcccctaaccctgacaatactgatttgaacttctctggaggatggaacttataaatctaagcaaagtagagagaatgctcagtaacaacaacagttgttttgtttttttttttaaggagggtggagggaagaagaaagagatggagaaagcaaccagatatgagacaggaaacaaaaaagtgaaacagaggcccacagttggacccaatttgaaatccaaaatttactaaaagaatttatacaacgtaagatttaaaagggcactaactggcttttgtacttctgcaacataggttctgaattaactttaacacaatttgaatgcaccaacaggcaaatcttcatggccttaacactgaggctcaaactacatttattcctgggatctcattaaatttaaacaaattaccccctataattataatctataatatagatctaatttataagtctttcatttacagattaacatgctataatcttaggggagttactgaacaaaaaatagagggcacataagtatgtttcaccttaactgcaggaattattgtctaaattttccagtatcatagcattcattgtcctaaaatatcccatagtgagcatggacactctggcctaatgatcaatacatttaaatataattaagaatttgacatatacaaaattggcttggcaaaatgagaccccatggaccatacccctagtaaaaccagttagtatggctcaatgtaaatttaaacagaaacttacaagtactgaaatccatcacatgcctccattgttccttcatataagaactcaatttggcctgttcttaaatttggaatgaatgacactacacagtggattatgtaaccttaatgccatagtgctacccagtaaggcccccagacattatattattgaattgactgactccatctaatc

SEQ ID NO: 2571 - DNA, 337 bp, Homo sapiens
actgtatttctggaaatcacaatttaaagtggatcataacaggcaaaatcctaactgctacaaacaaagaaaaaaaaaatccaggaaaaaaaaaaggtcttggtgaggtgccgccatttcatccgtcctcggtttctgtgcctttcgcagagcttccagcagcgctacgttgggccagagcatccggaggttcacaacctctgtggtccgtaggagccactgtgaggagggccctgggaagaatttgccattttcagtggaaaacaagtggtcgttactagctaagatgtgtttgtactttggatctgcatttgctacaccctttcttgtaatatga

SEQ ID NO: 2572 - DNA, 1001 bp, Homo sapiens
tgaagtgaagcccgttccccaggcattccgattgggggagggaaggagggcactgaggggaaggctgggtgggtcccagccccctgagacgtgagcagcctccattctaaatgatgtggaagagccggcaacccagacacagctgctctgcaagcccatctgcccagctcagggctcaacctcaggacacgcccactcctcctggtccaaacgaggatggagcccctcgagcctgtgctcatgggcactgtctcactccatccgagcactgcttaaaacacactggataaatgcggatggctgtcagacgcttttaatgaggaaatattagaggaatattagaggaataatgaggaaatgatagaaaaatcagagactgtgtttttttaatctacagaatctattggcctagatttgccagacattcatttagaaacaataaaaataactgtaagggtgtctacatgacctgcagagcctaaaacatttcgtatctggtcttttacagaaaaatgttgccaaccctcgccctcccagccgccagaatttggattaaaagagactaaaacgatgtgacaatgaaatgcaatgtgtgagcctgtctcgaattggatcctagaccagaaaaaggacatttgaagggaaactggtgcaatttgaaagggacctgcagattagacaatagagtgcctcaagagggaaagtttcttatggtcatctcacaacaatcgttgtccctccaatagggaattccgccaaagtctgctccgcaaagcacgagcaaatgttcagggtctggagacagtagattgctccaggagaaatatgaaggagccaccgtgattccatatctgcctgggaactcttttaagctgctgaggtcagaagagatttgcaaagccctccaagagactttaccgaaagacatcgtgtgctgggggttaatgtttttcttcattagttgtgtttgtagcttcttgaaattattgtatatggactgg

SEQ ID NO: 2573 - DNA, 1924 bp, Homo sapiens
aactttttatttttatgtgagtattgtcaagtcctttaaaatacttaaacttttgggttatatcgtaatgtattaagtagtggctccccaaaagatccatatccaaatccttaaaacctgtggatgtggcgtgagccaccacacccagccgcttgttgcagtttttaaccaccaagtctgtggccatttgttacagcagccacaagaaactttaatgcagccagccttccatatccgtggatttcacagattgacaatatttgaaaaaaaaaaattaaaagataacacaaaatttaaaaagcaatacagtataacaactatttgcatagcatttacattgtattaggtattataagtaatctagagattatgtaaagtgtatgggaggatgtgtgtagattacatgcaaatactgccccattttatatcagggatttgaatatctgaggattttgatatccccagggggtcctggaagcaatactctgagcgcactgaggtatgactgtacatgtaagcttcagaaagttttgttgagtaacaattatgtgttaatgatgcaaatcattgaggagattgcttctgctttcaagaagcataggcaagcgtagagagtcagatacggggatggatcgttatagtacagtgtgaaaaaggtttgttaaggacggtatgtagagagagagagataacaaatgggaacatggaaagaatgccagcctttttctgaacaatgccagtattaagctgcagctaatatttgatctatcaattgaaagcatttatgtaaaataatctatttttaatacacctattaatatataaaaagaatgtaattaataacctaaagccttgaatttggtgaatttttaagctggagtatactacatgaaccagatatttcagtctgctctacaaataccaagagaactaaattataacatctaacctgctgtcagtctgcccgggcattttagtacctcttttcaaccctggctgtcagacttttctcttatgaaaatacatctctaatcttacaagggaatacactgaatagagacttgtcatactaatatttatcactagtatataaaaaatgatactagtagagtgctttatttttaagccttattgaggtataatttaaatactgtgaaattcacccatttttagtgcacagcattttagtttttaaaataaatttatagaagctaaaattgatctcacagaagtagacagtagaatagtagttattaatattagaggctgggaacgggtggggaacgaaggggatagagaaaggttggttacaaattttggatacaaaattacagttaggaggaataaattccaatattctatagaactatagactgactatagttaatagtaatttattatatattttcaaatagctagaagagaggattttcaatctacccaacacaaagaaaagataaatgtttgagatgatggatatgctaattatcctgatttgatcagcacacattgtatgtatttaaatatccctctgtacctcataaatatgtataattattatgtgtcaattttaaaaaacaagaactttgaacattttcaaaacttttacagctgatttgatcagtacacatcgtatgtatttaaatatccctctgtacctcataaatatttataattattatgtgtcaattaaagaaaacactttaaacattttcaaaacttttagagctgtgcaaaccttactacggttcactcttataatattctcacccctctaaaaagacccctgatgggcatttgcagtcagttttcactcctaatcccagccccaggcaatcactcatctgctttctgtttttgtagattcgccttttctagacattacatataaatataataataaaacgtgttattttgtgtcagg

SEQ ID NO: 2574 - DNA, 9529 bp, Homo sapiens
ttttttttaatctgctgtggaacaagttaaatgttgttggtgtttcttgtgccttaaaggtttggtggtagatttcacctgtgaaactgaacagtgctctagcttttgggggaatagttcttttttttttttttttgagatggggtctcgcactgtcgcccgggctggagtgcagtggcgcgatctcagctcactgcaacctccgcttcccaggttcatgtgattctcctgctgcagcctcccaagtagctgggattacaggcgcacaccaccacacctggctaattttttgtatttttagtaaaggcagggtttcactatgttggccagactgttctcaaactcctcacctagtgatccgcccgcctaggcctcccaaagtgctattacaggcaggcaccgtgcccggccaggggaatagttcttagtgatttattctattacttctaatgtaatcagtttcttttggaaccaggtttggtaacttatgtttcccatggaatttttctaatgtatttatatatgtagatgaacatagtacccttatatttaatttaatgttctctgtatcttattttgtgttcttcacattgatttctttgttctttcctacaggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagtgacagcaaagagaagggccgtcagagagccagtggcttcccaaggcaggccttttgagcgtccacttatttctgtcattgtggaaagttgactgttctgtcttgaggactaggaagaggcctttaccttttaggtacttgaatagatgagcatgtggtacccctatcctcagcttcttactttcttgacaatatttaagcataagaagtggttgcttcttcagacaaattaaaatcagtactcttggtgaaacacctcttaaagttacatatggctgttctgcatattaagatttgaatggcttttgttgttagggggcttttttatgaagttggtgcaaaagtaatcgcagttttgccattaaaagttattttcagtatagtcatttgactttgcctttcaaatgaaatgttttctgtatgcttatgtgtattatatttgtgacttttaagaaaaatagtgatttaatttaaatttttcaataactgtattaatattttcctacccaagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagtatgttctttttacatattgagatgttaaaaattacttgacaagttttaggtgtctgacaaaatagttatttgttttttatgataatgaagatcttgtaatttgtgatcatctcttctttttagaaaagcagcttggattttaaatataatatcttccctgccctttaagattgctttgcctaggagattcttaggtgacactaagactcgttaagtatctttgtcgtagattgacttttagtcttctaagcaaggctttatcagaatcctaggaattccattatacatttagcagtgcaaaaagtaagctgtgttgggagcaaggaaaatgagggaccagggagaagggcctgaaacagcctaagggaaataggttgaggagggcagtagtctgctgttatttgcaccctgggcttgcgttccttctgaggttgtttaaaatcaatattcctggctgggcactgtggctcacacctgtaatcccagcactttgggaggctgatgcaggtgttcaagactagcctggtcaacatggtgaaaccccgtctctactgaaaatacaaaaattagccgggtgtggtagcgtacacctgtaatcccagctactcaggtagctggggcaggagaattacttgaacccgggaggcacaggttacagtgagccgagattgcaccacctgcactccagcctaggtgacagagtgagactccgtctcaaaaaaaaaaaaaaaaaaaaaaaagtttttctttcctttattctggttatactaagggttttgttttagtagcaggaagttgcttgaaggaaggcagggcatggtggctcatgactgtaatcccagctactcaggaggctgaggcatgagaattgcttgaacctgggaggtagaggttgcagtgagctgagatcacgccactgcactccagcctgggtgacatggcaagactctgtctccaaaaaaagtaatgggatactttagttgataacttttttaaaagaattgctttgctaaaagggttcattttatgtacagaaattgtatgttttaagtctgatgaattttaattatacttcacacctactagaagcaagtcacaagtcagtatataattatattttgctttgtttgcagagtacgttagtatatatccaagtactttatagtagattgataattctgtgaaggaaatgaaggcgtgagtatcagggtaaccaaatgaaagtttcctgactaaaggtagctggtttaaacctacaaacatttacatgtgattggtatgatgggtactgaatgaattgggttggatcagtataagttgatcatgtcatgtagaaagttattaaagtagagaaaagagtttttactccagactggtttagggcaggtctttctgatttaaaaacagtgtccaggaagctgcacagatgagcagtactaggtcatgctggtggctgagctggagtttggacctgaccctcaaacacaggtgcatgtgcacatttcgtggtctccttactgggcttttgacttttcccttattttctcctgtgctttatttctgtaacaaatttcccaataaaaccaacatgttccttttatgtttttgtaaaaattatttcttaagtactgttttttttatttttttgagacagagtttcgttcttgttgcccagactggagtacaaggggtgtgatcttggctcactacaacctccatcttccgggttcaagcgattctcctgcctcagcctcctgagtagctgggattacaggtgtccaccaacacacccagctaatttttgtatttttagtgtagagcgggtttcaccatgttggctaggctggtctcgaactcctgacctcaggtgatccacccacctcggcctcccaaaatgttgggattacaggcgtgagccaccatgcccggccgcgagtactgttacttttaactccactagcagatttctgtttgtaaaaaagtcttcaaacaacagtaataataccaaacaattaccaagtatgctctgtgcctggcacagttgtatgcacattgcatgtgcccctctaaccctggtgtggggcagagtgtaggaacctagttcagagtcccagccattgagtcgcagagctcgtatctgagtccagcctgtctggctctgaaacccatactatactggtaactccttttcttcatcacttgcagaaaatagatctatcacacaggaggaaaagttagccaactgagacaaatcagcaaaagaagaaaatatgtctgcctttttttttattctgaaagtgataggtgttcattatagaaaaatggagtgtatacaaaactgtgtaagagagtaaataagtgttgcataagcctaccaccgcaagatgatctgttaatatttttgttgttatttccatttgagtcattttatggacttatgtaaggtacttccagtttagtattagtttacttattactactagttgatttatgccacattttttcccaaaaagctttcaaataacttacagaggcacataaaaatgtacaacctagcgtgagagcataaataagccatggtttttgtagagtgaagggaaaatttccctagaagtgccagattctgtttcatatggaagagagaataatgacatgataagtaagtagactagaatgtttatttgacatcagctaacttgtaatgagaggatgagttggtacaatgtcttatttcctttataagttatataaacattgattttaaaaacattaacacatacttaatctttttaggcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgacagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaacaatttttaaaattataaatttatttttatagccatatgtaggatataaagatttatatagattattttctcaagctacttaatgctttaattctagctactcatcatgaaatagtaaacagttttactgaaataaactctacagacagatgcagtatgaggagctattgaagtagaaaatgtatttcgctttgcacactgagttggttttagcagacaacctcaagtaggtttccataacagccattacctttgaaatctaccttctgtagtttattataaataggaaaatacatcctgattctgtagcaagtagattgtttgctctttgtctttaagaaatactaggagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcagagcttgcagtgagccgagatcccgccactgcactccagcctgggcgacagagcgagactccgtctcaaaaaaaaaaaaaaaaaaaaaaaaaaaagaaatactaggggagggccgggcgcggtggctcacgcctgtaatcccagcactttgggaggccaaggcaggcagatcacaagatcaggagatcgagaccatcctggctaacacggtgaaaccctgtctccattaaaaatacaaaaaattagccggacgtggtggcatgtgcctgtagtcccagctactcaggaggctgaggcaggagaatcgcttgaacctgggaggcagaggttgcagtgagccaagattgcgctactgcactccagcctgggcgacagagcaagactccgcctcaaaaaaaaaaaaaaaaaaaaaaaacagaaatactagggaagggccaggcgtggtggctcacgcctctaaacccagcactttgagaggccaaggtgggaggatcacctgaggtcaagagttcaagaccagcctgaccaacatggagaaaccccatctctacttaaaaaaaaaaaaatacaaaattagccaggcatggtggtgggcacctgtaatcccagctactcgggagactgaggcaggagattctcttgaacctgggaggcagaggttgcggtgagccgagatcgtgccattgcactccagcctgggcaacaagagcaaaactccatctcaaaaagaaaaaagaaagaaagaaatgctaggggaaaatgttttaactagtcattcttcccagtagctaatgaagctgacttttaaaaagaaggctgtgagctttgcagatgctgctgccgcccagggccccctgcttccagccatggtcaaccccaccatgtttttccacattgctgtcgatggcgagcccttgggctgtgtctccttcgaggtaaggggcctggaaagcaagaagtgactgctcatctaatccataaaactatgttaacagattggagctgtttgcagacaaggttccaaagacagcagaaaatttccatgctctgagcactggagaaaaaggatttggttataagggttcctgctttcacagaattattccagggtttacgtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaaaatactgtgacagaccaaggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtaataatttccccgcatgctatctttttagggatcctgaacacacagcctttcccagaagactgctccctccagctactgaggaatgatgacaagaaaaggccgaattgcagtgtctccatcagcagtttgctctccatgggcacacgatgacaaaatatcctgaagcgaaccactagtctgacctcagtagcaggattggaagcttcatgccatgggagctgtcaagaaaggcatcccaaagagaactgaaatttaaaaataataatagaccttcaggaataggtgatttgaagatattaaagctagaaattggaactagaaaatcaaaagaattcaaggcatcttaacgtgacagttgaactcatttgattatacttaaaaaagtttattgcagttattgactctcaattttttttttttttttttgagtgcagtggtgccattgttgctcactgcagcctcaatcttccaggctcaagaaatcctcccacctcagcttccagagtagctgggactacaggtgcatgccacaccctgataatttttttttccccaatataaacgaggtcttgctatgtcctccagtctggtcttgaactcaagtgatccacccaccttggcctcccaaagtgctgggattacaggcgtgagccaccaaacccagccaccaattttactttaggtaaacttttattttcaagcttttgttggtgttgcaagtgtaaatctgttttataaaatgttctataaatataaccactattccttgtaagctatttaaaataaattttaaagtctttcaagtaaacaccaatattgtgattttgatcctcacttacgaagtccctatttgagaacctccctactaaaatgtatttgttactccaaaatcatcccatgcggtcactttcagacatgcacagagcagcgaatgagccaagctgcctgacccgcacgttcctgacggaggctggacgggatgccctgccgtttcctctcctactacaagcaagtgtcctttcatagtctcttcacagtaccatgttttttgcatttctgcaatttttgttggcaatttcactatttaaaatggtcctcaggtgtggcaaaatattgcctgctgctctaagggcaaggctgtgatgtgcctcatggactaagtgtctgttagatcagcttcactcaggcatgagtgatggtgttggctctgagttcagtgttttattatgccagagaatcagtaggtcctgtaggtcctagaacctaaagctgggttgttgaaactgccactcctaaagtacttcagtaataagctgtccttttcccaatgctaacgtgcaaaacggggatgctcgcttttaggtgtaaaaagaaatctctgttgccatcattttaattgtctgaaggcattcctctgatagatgggcttagttcattatt

SEQ ID NO: 2575 - DNA, 14482 bp, Homo sapiens
atgcatgtactgaaacatttatgaaaatgacatgcttttcaaaaattgcttagataaaatattaattttcatcagagtctcagtcttttgccctcacccaggcaggagtgcagtggtgcaatcttggctctctgcagcctccacctcctgggctcaagcgatcctccaatctccacctcccgagtagccgggactacaggtatgcgccaccaggcccagctaattttcttgtgtgtgtgcatgtgtgtgtgtatatgtgtgtatgtgtgtgtaagtgggatttcgccatgttgcccaggctggtcttgaagtcatgggctcacgtgatccactgtctcagcctcctaatatactgggattacaggcatgagccatcgcaccgggttggaaaatttaaatttccatagcgtttacagaaacttaggaaacaagagaactctaattttctaaaatcgagagctaacttgaaagcaaagaggaaacaatttattgtttgccaaagttgtaataatgtttgactgtggtatgattaacagaattgagtaatgaattagtttatgttagatgatttgacgtaattatttaacctgctgttttattggtttgttttattttacataatatgacgattaaaactgtgatttgacagtatcttttaaaatttatgtatttggttaaccactagtttgtatcttaatctaaaaaaccctgtattgatgttttctttggtcataaattcttcttaatttattatattactaaatttgaaatattgacattaaatttcgtcagctgaaacattaaggagataatttttttctctctctcggtagcttttgaaggtggggaaattgtatgaaaccagtctctgtgatagatttattatcaacctttacttctcttgtttggatatataatagatattttcttaaaataatatgcatgtaaaatacagcacatttttaatagaaacacgtcttctaatatttacattgtgttacaaattatgttaagctgtaacatctctcttatttcttttttctttttctcttcttttttctttaggcttgctctccttttttaaattgtacatgtaatattaactgtagggggttttgaaaaagtcaggtgatattgaacaatttcactattaaaaacaagaaagaaaccctggatgcttctcagtctttggtaacagaaaaacttgcagcatttttattttttaggggaagagtcataaactctgttttgtaggtaacctggaaaagggtgtttttatcagataaatggtcaagacagggatatgaagtcactgacatcaatgcctatttgcattatttttatgaaaaaaatgttgttgataccaaaattggcacataatccaaaaaaaacaagcaattcaatattttgatgtgtgctacaaaagtgatgaataatttgggtttgtccacattaccaaaataataataaatccttcaaaaatattagtgtattagatatctttctgggttttgagattttgtttccttttagtgcactagcaatcatgtagatttattcatttacatttgtgtttacctataagacttctatatagtattgtttgtagtaaagtatatttagcccctttttttcttacaaatattgagcaacagcaaattcttttaagtgtgtgcattttttaggtataaagccatgattaatgtctttctctaacttgtctgaattttgtgcaaaatccaaatatatatctggatttcacaatagcactgcttttacctcattctgtcaggtcaaaccttgtacaaactgactcctttccttagcttcaaaatattaaaactcaaatgactctggatagtactataggtcatttactaattatatatacaaacatagtgattattttttaaagcagaacttctatgagcttctgtttctggttgagaattaaatctgtttatcatttgatattgcaaagtcagaaatgatgttatatcatttttaatttagcctatctcattagatgtaaaaatgtctttaacatttgttaatctaattatctgctttgtcaaaatatgtagtggtcagtaaacttttttgtgtagtttttggtgatgttacttcctacctccctcattgtgtttacaataaatatatggtttgtgtacagcaaaagaccatcaatatcttcctactcaacaaagtttagtctagaattgcttgctgtaaacaaagatgagaaaaggacactttgtttactcaggaatgtggtctaatgtctgaagttttgcttttatgagcttagcatgttttgttttttttttcaaatgaatttacgttttgtaaagaagctttagatattctttgtgatagctcagtgttaaggcataaatttaattttgaattcttataaatattctacatcataagtgatgtagaaaatctatctgaactacacagtagtgactgtggtagtagtggtgatagtagtgatggtaataataatttcacttatacccatacctagttttaaaagcaattttgctgtgtgagatagaatagtaagacatggcatacctactttcaggtgaaaaaacaccttcatatagcaaataatgtacaagcccaaagtgaatggtaaagggagtgccaagtaaatatcatagacatatgaggaacatagaaatttaaagaacaaggatcttgagtcaaaagcacctttgtgccagtggtgtgagttgtgttggcagcattttatatgaagtgagcaataatggaaaatcccagatacatgaatggattcagaatggtaagactctaggatttgagagacattttgtgggactgcaagaaagtgaatacagggaaaatagattaaacaagcattctgaatagtttgaactttgttctcaagcaatgggaagacaaactaccatttactggaaattagctatttttcaagttttgtgctatgcactttgtgtgtattatctctctctcttttttttttttaacaacaatccatttaggtagatagaaagatgacatgaagagaaatagaatagctttactttcacaaatttattcattgtgttagagaaataaaatggaaagcatatattctgagtgtgtatgagggttagttaaattaagttattttcatttctactttcccacattttagtcatgtatttacattgtggtgaatagactccatgttctagatactgagctgcaacttacagtggtaagtagttgaattggttgtcaaatgaagttatttgtgttccagtctctgtgccacagagcttctcagaggcagtaggtctgtcatcaaaaaaatggcactgtgaaagccctcttatgtcaccatctaagattttgtccaagagaatagaaactaagaaactgagatgctgactttgccagagtcatagagccaggaaatgatggatacttaacagctcccttccccaaaacaaccttgaatggtccaccagatggctggcatcaaggttcaagtatgtttgacattgggctgcctttctgatgctactgtgcagttctcatttttctggccttactttgttacttgatatagagacacaaactaaagcttgaaaaatccagtaaagtaaataaaaaagcattactgtttctatttccaacttcccttatatatcaaaaatattcagcttaacttctaaagccagagtagagttcattcatgtaaagccatttctcctagaggctaagatagaagagatttgcagaatggttggacaattaaagatggagttaatcattctcttttcattaggaagcacattgctacatgtccaagaaaaacaacaattttaaaagccctattttgtcaattagcataaaatatggtatttctctggtttactaagtcataagaaactcaatttttattactcttttctttgatattttttccataactatatattttttatttttgccatcattaggaatgcatatttgaaagaaatatgtacccacattaaataatcttatctgtgaaaggcaatagtaagtagcaaaattgactcagtaggcagctattatgaatgcctgcatagtacctcaggaaatatttaataattggaggctttaatattctaacacttcttttaaggtctcaagctaagaaggatcgctaaatttctgtgtcttgagcaagtgaatatgaagtagagatgatttatgaggtgaacaggtagtaaacaaagtcattttagggctcaagcaacttattgcttgtattacctggagaaagtcctagttttctcatttgttaaaaacaaatggtataaaaatatgtgttctgattcattggtttggtataggatttcattacatgttaggaaaagcaaaaggttttcgaaaactctagaacttatttcaaataaacactgttttaaaaatgtatcactcctagttattatcaatgttacttcttacccttttggtccccaacttttactgtcgtttttcagaatataacatttcaaatctgtggctcctttgtgaaaatgtggaatggggctctgaaacactgagcacatgctagcgttcagtgctcagtactctcagtgaggctgcccatcatctctcaggggaagccagagtgacagcatctcagatccacactgtccttgagcagggaagttggggcccagtcacagctcctgtacttctcagtgtgctcatcacctctctagggtttcacttccttccatggcaaaaaagaggaaggttgaaatagctgatcaataaacttctttcaattgttaaaccccatgttactatgaactacagctagagatgatgatcttgggatgctgagtaaagtattttaaaacataaatttagagaagttaaaagtagaagttttgaacaaataactaagccaagacttcattactttttgctgtagattttccattttcatactttgtattaaattagttaaagtgaaggaaacatcaacacaagtaggtgtgtagaaggccatctgaggggagattaaagtttatttatttatgtgtttattattttttgagataggaccatggtctgtcacccaggctgaaatgcagtggtgcagtcatggctcactctagcctcaacctcccatgctcaagccatcctcccacctcaaactcctgagtagctgggactacaggtgcacaccaccacacctggctagtttttgtatttttttgtagagacagggtttcaccatgtagcccaggctgatcttaaaatactggactcaagcaatctgcctgcctcggcctcccaaagtgctggccgcactacagactgtacctggccaagcctaaatttttagaaaatgtaagttaaaataccttattttaaaagactgcatatattttacaagtttctcagaacatttaatcaacatacttttttatactgatatttaagaaaataaaaaacggtgattgagagcttgaaatttggaatcagagacctgagttaaatattggctccatccagttttatcacttacagccatatggatttggccagtttttccaacttatttcagccatagtttctcatcagtaaaatgagaataatttagcacctgactcatagggtagttatgaagattaaatgagaatatgtgtaaagaacaaagtggagtagcagtgaatatgtgaatgtgctataactattcatatgactaaggataatttgactgatatattaacagtatttaaagttataaaatttagaactaacattccaaggttaaatagcttattgatgaaaaatatgataacttcctttttatgtactctattccagtcttttggattgctataccaacttgcattgatcactcttcaaaagtctctccatagcttacagaatttttattggaacttaagaccagagaatgtaccaatgtggaaagtaaagagctgttctggattagaaggaaaaaaaaagaaatttaatgtgcttttccttagttctactactgtttttgcttgctttaatgggtggaatggaactgtgactataattaagtaaaatgaatattgaaataaatattaacttcagaatataaatgggagaaaaggcactaaatacaaatttgcatctgcaagaagtgagaggttataaatatgttgttagatcacctataatgtctgctttaggcacctagttcttgcagttttacattgaaacacagagacaaatacaatataaataagtcattacaaagctcttaatccaaagagagagatacacacagaaataattaaaggatttcctaaataaaggactagataatgtgctgttggactaaagtgatggaacttctgaattctttttcagaagatggagaaaggaggcttcccaggtgttaacattaaattctagagcaaagaaaaaaaatgtgtagaattgtgtagttccttgtgtgggtacagaattttggggaaagcagctgttcaataataagtcctgatattttctatatatgttcagaaattaacatgcacttacattgttgattaatcctcacacatatttatgaattattattattattttaaataaatgatgtaactcagtgacatggcttgactctgtgtccccacccaaatctcatgtccagttgtaattcccagtgttgaaggaggggcctggtgggaggtgattgaatcgtggtggtggacttcccctttgttgttttcatgatagaattctcatgagatctggttgtttgaaagtgtgtagcaccttccttatccctttactctctcctgctagccatgcgaagatgtacctgcttctgcttcatcttctgccctgattgtaagtttcctgaggcctctccagaagcagaaatctggaaagtctgcagaactgtgagcagattaaaccatttttctttataaattacccagtctcaggtatgtctttatagcaatgtgagaactaatacactcagactgagaaaagttagtgacttatctaacaatatataatacctctcaattcagttttcttattattctgaggaaatgttttaaacacatgtgagtttgaaagtaaagtaaattatagtaaatttaggcacattattataataagaaaaagtactcaaaaggtaattgcaatagtttatgaatattaacatagtctaaaatgtgtaccacacattcactttctctaaacctattaaatggaatcaagattctgaaaaaaactgcaagaaaacaattatttatgtccagtgttgtcttaaaatgtcattgtaaattgcaagattatttattcctttttttgttttttatttcgtgtttagttgaccagatgttatccacagataacttcccataagaattaaatatagagccaaaagtattgcattaaaaatattgtcagtgagatagaaatccaggaactgtatgtgagaaaccttaatccttctctttatttcacaagttgggaacaagttccagtagtaagtaggcaggtggtgtaatgaatattttactatataagaaaatccagaagttactttcagctctaggtctgccatgtaaaagctttgggactatgaataaattatttaatttttaaatcacactgtcctcatctgcaaaataaaatatactagcctaaaataaaaataatctagtctaaatgcactttaagatcctttttagctttaactttacttttgtagaaagcttcagagggattttgacatgcattaagggataatgggataatttcactaaatgtgttagaatgaggaaaataaaattcgttattagtgcatcaggaacataaagaaatgttgaatggattttccatgggagacaacaatggctccatccaaggttataggaaaaaaaataaagtgatagaatatatcttcgaaagtagcttttaacatatgtgcagagaattgacacggcactaagatatttatattttaatctattattctggtaatattgcacaatatggggcttgaatcacatgacattcaaaaataggtttggtaaatcattttgaacttcattttgaacatgtctgcatggacataggaaatggaatgttgagtctgtttaagaggtttaagagagaagaagaaacaagttagggagagattctagggaaaggggacgcaggcaagaggggtatgtattcacaacattgtattactcccttataacagggactcttgcagactgagattacattttggaagagagagagttgaaattaatgttgacttctggaaatcaagccttatattaggtcacaaatgtaccaaagaggtacaaatgaagaaataataaatgaaataatttataagacaggttatatgtgtggagggaaactctctgcatgctgcataagtaggagttctggaaaatgccaactcttttctcatgtgttactttagacatcattcctccattaagccattctgaacctatctaagtctggattttgtgccctctgatagaccgggacaaatgtagcccataagaacttgtatcagtcacgattgtctttatgcttgccttttcccccactcagaaggtgcacaggcaggttttatcttaagcattgttgggcattgcacttagctccatttttgccatgtagtaggctgacacaatgaactaatggtctgtggtggcagaaattaagcttgtttgcaaagaaacacaatataacaataacaataaatacatcaaaaaatagatgtgaaaacagaagtgaagtggttaaaagctagggttctgatgaggaggagtgtttcttatataagatgaacctattactgtgtcatcaagaatcagtatcttcatgattttcagccttagtttccaaatttgtaaaacggagacaacaacaatgtctatctcataggggattttagaagttgaaatgaaataatacatgctcatgtataacctatgtatatgtaatacaagactaagtgctcaaaaatgtttaccatttttattaaccataacttctcctataaatgtcattagaatacagaaaaacaaggaaggattttctcacaacaattaagtgtgttaaaagtaatatagattattttgtatcaggaagaaatttcatccagcgtaaacacttttcatttcaaaaagtatgagattagaaattgtattctttcaaaactgtagtcagactgtatatttccagtgcctggcacatatctgtcaaatatgcaaagccatttcgtttcattttttttttattattatgctttaacttctgggatacatgtacagaatgtgcaggtttgttacataggtatacatgtgctgtggtggtttgctgcacccatcaacccgtcatctacattaggtatttctcctaatgctatccctccccctagcctccaacccctgacaggccctggtgtgtgatgttctgctccccgtatccatgtgttctcattgttcatctcccacttatgagtgaaaacatagtgtttggttttctgtttctgtgttagtttgctgagaataatggtttccagcttcatccatgtccctgcaaaggacatgaacttatccttttttatggcttcatagtattccatggtgtatatgtgccacattttctttatccagtctatcattgatgggcatttgttcccatcaatgggaacaagtctttgctattgtaagtagtgctgcagtaaacatatgtgtgcatgtgtctttatagtagaatgatttataatcctttgggtatatacccagtaatggaattgctgggtcaaatggtatttctggttctagatacttgaggaatcaccacactgtcttccacaatggttgaactaatttaccctcccaccaacagtataaaagcattcctatttctccacatcctctccagcatctgttgtttcctgactttttaatgattgccattctaactggcgtgagttggcatctcattgtggttttgatttgcatttctctaatgaccagtgatgatgagttttttttttcatatgtttgttggctgcctaaatgtcttcttttgagaagtgtctgttcatgtccttcacccacttttcgatgggattgtttttttcttgtaaatttgtttaagttccttgtagattctggatattagccctttgtcagatggatagattgcaaaaattttctcccattctgtacttcatttctatataacaacttggaatatcacagttctatgcactagaaaggagatttccatttttttcttaaccaatgaaacttcatatcctctttgggaagtaggtcatttaatgagtcattggtggaaagaaaatctactttaaaaacacaatactttctcttttgtttcacagatacaagtttctacaagatgcatttccctttacagttatgatagttctctttagaatctaaaggttaactctagcttgtgtgtgtatggtgcatgtgctgtgaatgttgtaagaaagccaattcaaagagattatgtaatttagaagatagatgctttgatttttttttcttttctaagaaccagcgtgctgccttttctaatacaaggttgggaaatagttctgtagctagatggggatatattaatatatactcacagggcacataatgacagtgcaaaaatatgctttcatcaagaacataaaagatggaacagaagtaatatttaacaacaggtagagattggttaccatggcatctattacagtgaaagtgtctaaaaagcacaatctgttgctctatttaatatagtaagtatatatttttgcgtttgtaaagttttgagatctagtctaatgcttttaatatatgtgatgcttctatatgccttaggaatgactactatttcaaaaagaaaaggttccatctagaacaataactcaaatataatgaataagttaatgcgtatatagtatggaaaaccattccaaatgattctgattgccactcccaggggattatgacttcctctcactccctttaaaattcaatatgttttttggcaatatttctagttgttcatacagcaacgagcctcccgcttttcttccatatgtgaattccatctaaagtattacattttaaaaaaatcttttatagttacacatggccatataatacatatatttagtgaatgacatttatcaaagtctggtaggtatttttgagaaagttttgctttcttgaatttggtcccatacttctttcttcttctcttgtctggaattcaatatgaggctgaaatgggaattatcatcttataaccattgagacaaaagtcacatggtaagagtaacttctgtgaggccaggagtctggttcttcagatttcctcaagtgcccagatctgtgtgggaatgccctacctggtgatttcttattactcaaaagacataaattggtttctgaccacagtagaggatttcaaattcatatagatgaacatcaacttaaccattacataattaactgctgtgtatggatagttatggagacttagtcctgaagtgttttttattaggattatatgatctatatactaatgactcctgtatttatatctccatcttgaaacttctgcctatttgtcttggtcatgtaattgtctggagtactacaaaattaacaagcccaacacagaacctcaaagtaccacttactcaccagcagaagctgctcatctagcagaattcctcatttctagctacagactcttctgttcaggttgtttcccaggcccaaaaccttgggatcatcctcatttactcaaaactcatatgtatcaactcaaaagcaactgattttgtttctaaaatgtattatggtataaccatttttcactagttttattgctattaaattaattcaaaccactgttgcatgtttcatgagttctcctaactggtcttcctactttcaatctgtctctccttccatgtattgcaacagaacatcaaaaggaatcctattaaagagtgagtcaagtagtgtcatttgtctgctcaaaaccatctcattcacaaagtcaaaaatatatgctcacaaagcgtgcacaatttgtcctccagtcatctctcctaatactctccacctctctcactctattacagagattttttggtgtgtacttttaaatgattaaagaattctgtcactcatactctcttgaattttcaagtgtatcctcatttcaattatctcagtctttctcagtcaaggtagtaattttgtaggccctaaaattaactaatattatactatgacaaacgttttgataatcagatttccttttgttttcatcaatctcagcttcatactatgaggcttaggagaccttttcagcatgtttattgacttcttatctgtgcccttagggacatccattctcaacttcaggttattcaccactgcctgctacaagttgctaccttatcttgtggtcctttgattccaaatattcaatttttcactattgtgctttgtcctattaattttcattctagaaaataaatgaaacaatgaaacattctttcacttgcactagaacagataattgcaaatatggcacatttttctcagtctgttgcctatatcccattattttacactcatttctgattcatttaaggttatttggttgcatttttaagctgactttggctaacattttgggaaaaaaagggaagatatttgaattctatttgaattctaaaaaaattaatcaataaccataaaaccagaggcaagaacaaaaactaagtggagagaacaatagaaaattcaaaaaatcctgtgatacaaacccacagccaatattatattaaatgggcaaaagttggaagcattcccgttgaaaccctacaaaaggcaaggatgccctctctcaccattcctattcaacatagtattgcaagtcctagccagagcaaacaggcaagagaaagaaataaagggcaaataggaagagaggaagtcaaaatatctttgtttgcagaaaagaagattctatatatattaatagaaaaccacatagtcttggcccttcagctccatcagctgataaacaacctcagcaaggtttcaggatacaatatcaatgtacaaaaatcactagcattcctatacaccagcaacagccaagccaagagccaaatcagaaaggcaatcccattcacaattgccacacacaaaaaaataaaatacctaggaatattgctaaccagggagatgaaagatgtctacaatgaaaattacaaaacactgctcaaagaaatcatggaagaaacaaacaaatcgaaaaacattccatgctcatggataggaagaatcaaaatcattaaaatggacatactgcccaaagcattttacagatttagtgctactactatcaaactgctaatgacattgttcacagaactagaaaaaatactattttaagatgcatatggaaccaaaaaagagcctgaatagcccaggcaatcctaagcaaaaagaacaaagctagaggctttgttacctgtagaaggaaacaacagacactggggcatacttgagggtggagggtggtaggagggaggagcaaaaaagataactattgggtactgggcttaattcctgggtgatgaaataatctgtacaacaaatccccatgacgcaagtttaccttcacatttaccctcaaccttaaaataaaagttaaaaacaaacaaacaaacaaaaaccagcaaaattttgtcatagtagaaacaagcttgttagggctccaaccttatgaaaagaaatctaaacattagttagtatgtgaattgcttaatattcaaagacctgagagagcatttaattggctgacactagctatctgattgacttctggctctgttctaagtgaaagaaaagatctatctggttctttggcatctatagtggaaaaatttaccatcccatacaaatggaggtgaggattacaccaaaggaaatccacctgctctttagatggggtagaatgaaaaatgagcgaccaagaaatatcaaagatctaacacagagatcctatccaatatttgtttcccaaatggcagatgtctactatgaaaaattattattttaatcttgctggttgagagtttccttgtcaatgttttttttaaattatactttaagttttagggtacatgtgcacattgtgcaggttagttacatatgtatacatgtgccatgctggtgcactgcacccactaactcgtcgtctagcattaggtatatctcccgatgctatccctcccccctccccccaccccacaacagtccccagagtgtgatattccccttcctgtgtccatgtgttctcattgttcaattcccacctatgagtgagaatatgcggt

SEQ ID NO: 2576 - DNA, 861 bp, Homo sapiens
gttcttttctgtcaccaccatgaaaatatcattctactggctttttgctaagaagtctgctgttaatctcagagactttttcaaaaatgcattttttccatgacttgcttttgagatctttgtttttcttcagtggtctacagctttactacaatatttgaagctttttgctgtgtgaatgccctaatgccaatgaaggtctgtgaagcctttaaccttttggacatcacaacttcttctaagcaaaaagaaaacaaaagcaagtagaaaacatgcgttttaaaaaattgttgttgttagtgtacattaacttgtgaatggaatgtttaaaataaaacgtaaattttgaaaattgctttctctattataaaagcctatgtagtatttgggagcacagttaataaatggatgcaataacttaaatccctaaaacaaagtaatgtagactaacagatgaaataaagagaagggggtagaaacatcatctccctctcttcactaacacattgtagaaacctggaaaagtcaattaatttttcaggggcccagatttattttgataaaatgagctaaagggtggatttcatagtaagttaacagtactaactaaatcttaagatcgctggaataagattaagaagtagctccatgctttataagattaatctcccaaatcatggcatttttcttaggggaatatagtcagaataggaaaaattatatttgtgaaatgtaatatgaaaatatgaattatattgcaaattgctccattactttaaggaagtaaatgaagcttgatatctgtaaaaaatgcaactaggtaattaatgccacatgctataactacaaattcaaaacatg

SEQ ID NO: 2577 - DNA, 5577 bp, Homo sapiens
aaagtggtgaaagtggcaatgtgttttgtgatctgacctcagaaatgacgtattgtcatcttctatttggtagaggagagctgttatgtctagctcacgctcaaggaaatgacttactgcaaagaaccactcttccccacgagacttcgagaagacccgctgtcacggactgagttgtgtcctcttaaaattcagatgttggagtccaaacccccagtaactcagagtgtgaacgtatttgaagaggtctttaaagaggtgatgaagggagagagaccccatgagctcgtcaagctccttctgtgactgatcagagatcccaccgtgagtccagctcctggtcccatgctctggatatatcggtccctggcagcgtggctccatctccgtagcctgcttttgacaaaagtggatacataaatctaggggccacctagctagttctaataagactttggaagtcaaaagctaaagaagaccaggggaccaagctggaaatcaggctctgcaatcagattccagagggaatgccattccacccaatcacctagccacaacggttcccttccttcaagatgctgcatgcctcttcaggcgaatggattaccttgtaagagtgacctgaaaaagcgttagcccagccacaccgaggcttaactgagccatttgattctcactgcctctctctgttgcttcctcttgctttcaactacagggtctttctgtttaggtggtgaaaaaaatgatcgttaaaaacaataaacctggggacctctgataccatgagcccagccagagatctgtgtcaagcaaatccttgcagacagttctgccagcctgcagatggctgtttgcctctcgtggatttgataagtgctcatttatgcccagaggcctctgggagatagtgctcatgctgagcttacaaactgaaaaccattatctgttccttacctgagaccctggggagcagtcagctcactccctgccgatggcctaagataggtactgatgttacagttgaggaatatctaggagtaacaaacttaagtagctggaatatgccaattttgacaatttgacaacatcattataaacattctgaagtacttacaagtcttttttttttttttttttttttttgggagacagagtcttacttactctgtcacagactaaagtgcagtggcgtgatctcggctcactacaacctttgccttctagattcaagcgattttcctgcctcagcctcccgagtagctgagattacagtcacacactaaggtgcccggctaatttttgtattttcagtggagaaggggtttcaccacgttggtcaggctggtctggaactcctgacctcaggtgatctgcctgcctcagcctcccaaagtgttgggattacaggcatgagccaccgtgcctggccatgcaatacttagagtcacagaagtttatggttagataattctcacagaggtgacctggttcagctctaccatcaaggtcattgagacactggcaccttgcccaaggtcatgccaacctgggattaggcgtttcctgcccgatgccctttccccactttccacacctattgttcatactaatttattgcaggtcttatttctacagcctcctttaattgctttatgttcacgggacactgtcttcaggataagattcaactccttagccaaagacgtggcaactgcgggtgaagtatctctgggcaggaaatcaatgcagaaatgcaactggggagagggggcttgggggccagttccagggagattggaactgctgtgttctcatcagcagaagtggcccctgcccacccccatcctaatcccttctcatgtgggagaaggtctgtgagccctctccctaccaggcaggttctatggcaatgtgggcacataccctggggcaggggccgagggacttaactcacttcatgagcgccaatggaggagcgaagggaatgcctgatgaaaacaacattctaccagtatgcactgttttctaacctacagagtgcctctgtgttcactgtcccatttgagaattctaagtagaattctgaacaggctggagcagattgcccaccccaagggacagatgttggctggtactgttggtattcatggaagattccttctgacactccctccttctttgtaattgccatgaactggagcactgggccaatataaatcatccaagggtgaacacgctgcacatggacggctcctctttgtttttgaagggattccatctctattttgccatgtgctccttcaccccactccccacccccgtctttcatttctttctctggaaaagatacttcaactcacaggactgcgatgttgaaacggacacccaagagcatcacagatgggccaggcctggacctctcgggacaacattcctcacgacttttagatagaagagattagagatttgggactggtggcaactggtaacgttttcagtgtttggtaaacagccagggtccggagctctgggaacagcctgatttagctctttgtttaagttttgtgttagaggctcccaagaagctgatgcaggggaaagaaattaacaaccatggctcattcacagccaggcagccaaatggacagctctataagactcaagccgacagcggagagagtgcaaccaaacagccttggcccagctttcagaggagaacgttattcaccccaactgctctgcatctgcctggatgtctgccaagatctgtgagcattacagcgttggtatgctttgggtgaggcctgtggctatggcaacaagttgggagcaacccggtccctgggaatgagaacagtgtctaaaatcaggcaggcgaggggcagggaggagaggtaaaggttggacttgcctgaagatggagccgttttattgttgtgggtaaagctgctaccattaggggctgtttacagagtgggtgcagctcaagctgggagcatgttagactcagcgactacgatcaacctattgacttgttcccatgagacagagtaaattaactgttgcagtactggtcatgtaccaccaacctcctgtgaaccagccctcagtgaaacatttatgtgaaaggccatggtgttcccataagagggtgcatgttctctcccttgactaactcttcagtatgcctcattctcacgcgctggtgtgcaggaaggagtccaacatgccccattgacagtcatgccctgtatgtggaaagtcttcaggtagagcactgggctcaggtttgaagatgtgagttctaatcctagcaaggccattacctcccagtgacctcatgtctcgatttcctcaaccacaaaacaaaggcattggtgagctgacctctaaggcctctccagttctcaccttctgtgtctctacagactggagactagaagattatgggcacttttattgagtcttcattttgtttccatttctttgtagtcatcagctggagttgaggacaagttttaacaatagataggtttctttttgtctctttttaaaaaattttatttaaaataaatgccaagtgtagtggctcatacctgtaatcccagcactttggggaggccaaggtgggaggattgcttttgagtttgagaccagcctgggcaacgtggtgagaccctgtttgtacaaaaaattttaaattagccaggcatggtggcgtgtgcctatagtcctagctactctggaggtagaggcaggaggatcccttgaacctgggaggttgaggccacagtgagctgtgattgtgctattgaactctagcctgggcaacagagcaagaccctgtctcttaaaaaagactattttttaagaacacttttaggttcacagcgaaatttggaggaaacttggcatatgtcatatgccccctgctcccatgcatgcacagcctctaccattagcaatgtccccactcaaatggtacctttgttgtaatcaacaaccctgtactgacacatcatcatcacccaaactccatagttcacattaggtttcactcttggtgtggtgtacattccatgggcttgaacaactgtataatgacattatccaccactgcaggatcatacagagtagtctcactgccctaaaactactctgtgctccacctgtttgtcccttctttcactctaaactcctggcaacaactgacctttttactgcctcgatagctttgccttcttcggaatgtcatgtagttgaaatcatacatcatgaagccttttcagattggcttcatataggtttccttccttccttcctcccaccaccttcctttctttctgtattcctaactcttggatgtattttccccagcatcatgacttgatgggacttttgctaagataggcaatcatagaaagtcataaatctcttgtcagccttattggctcacctccgagatggttccaacactctttaaggcccacttttccaatccacagattccccagcagaagtccaagctgctgagcctcacatcatcttttgcactagtaatctttaccactacttcactgtagcatttgaaaattttcatatgaagccatagttctgtgtctttttttttttttttttttttttggagacggagtcttaacctgttgcccaggctggagtgcagtggcacagtcttagctcactgcaagctccgcctcacgggttcaagtgattcttgcctcagcctcccaagtagctgggattacaggcgcgccaccatgcccagctaaatttgttggcatttttagtagagatggggtttcaccatgttggccaggctggtctcaaactccttacctcaggtgatctgcctgcctcagcctcccaaagtgctgggattaaaggtgtgagccaccgcacctggcctgaagccatagttcttaacctcagttgtgcaatagaattatctggggaatttaaaaattagaaaaaacccatgccctgaagattgtgatctaactggtcttgcgtagcgcctgggcattggtattttttaaatgtttcccaactgatactaatgtggccattctgcaagccacagttgaaaggcttattcaagcatcctgttgctgaatgcatgtcgtccttaccacatgactctggaggttttcttgtattctgatgtggctgccctgttgaggcctgccccttagagtggagattatcccctgcagtaggctgcctggaatatgatccccagtgatccctgcttcctggtattcaggccctggtgtgatccctttcccttgaagcctgggctggattagtgacttgcttctaaccaacagcatatggcaaaaataaatgtttattgttttaaacctctgttttagggtcatttattacacagcaaagataacgaatatactttctgaaagaaggggaggctctttagacaggaacatgttcctgtgggagccacaccttatgttgattttgaagaatggagggtctaataatgtgtccccaggggaagtgataggggggcccagactgcttggggctggaaaggcaggt

SEQ ID NO: 2578 - DNA, 1727 bp, Homo sapiens
ggaggcttggggaaagttgaagatctgataaaggtagttggtgaggtgaagaaaggagaatccactaaaacttgaccctaggagcattctccgccgaatggcatggggtagtgaccctgactctggacaaggagagaagcaaatgtactcctagccctacttgggaccttaaggaaagactcatccatggccatgatagtgtaaatgctgtttattggttttaagctctttaactcaccctttggagtgaaaaacaatagaaagttaagctggttacagaacagactgtaaatgttataaaccttgaaaatgtaaactatagatacagcagatggaaattaggcagtggaagggcatgaggagagatggggggaaaggatgaaaactgattgttccaaggagctagaagatgcactctaagactgattaaaaatagcagctcgatcgggtggcttaatgtcattctggttgagggactggaatatgtggtgccactatattgggataaagcaggaaagtgagatgtcaagacaggacttcagtagatctaaaagagtataaaactccagtataaaatgggcagctggccaggtgctatggctcacatctgtaatcccagcactttgggaagctgaggcaggaggatcgtttgagctcaggagttcgagaccaacctaggcaacatgaggaaacctcatctttacaagaaaaaaaaagtaagtaagtaaaatgggcagttggtttagaagagagacagacaaaacccataccctttctagatagaaagatccccatctagatgagtgtgctttctgataggagtcacacagccatacctgccatcactgaaccattgtgtcttttactttacctgttctttgattttgaaatactgtggaaatgatttctcagattttcagagttgtctttatggaaatgattttgttttagttattcacgtctaggacatctgaaaaccaaaagtaaagtggccagaccatgtcagtctagaaactagcagccagtaaattgtcttcttaaatattaagaaagcaatatactacctagatgcaatcaaagatgtcagcttttccttaaaaggcaatgatcaaaagtccaaaggtgcacaaggaaatagttaaacctacctaagttgaaacaaaagttttggctttaggacaaaagggtttaataggaattcacaagtaacctttctatttttgagtgactgatttgcagttcaaactacaggtaacctctttgtgctttgtgttttatattgttgttgtgtttttgtttgttttcccacgtgttggcagtgcttgccttttttgaaattttccctgctcataaacactccactagggggcagacaaaagaatagagaagaaaagaaacccatatcaatacactgcatccagtatacatttacatgacatgtttgctgctccttctctatactgtggcggaagtctttctgttcattcatccttcttataagggcactcaaagtgatttttagcagtcttatttttacatttaaaatataaacatatttccacaagttaaatggtaattttaaaattcattgtcatagtaattttttatggtttttctggtatgtctaccagtgaaccacttaataacgaacacttagttgtgtattgatgactgtaatgatgatccctatagggtttatcttacgtggagcatttgtttacccatcc

SEQ ID NO: 2579 - DNA, 4253 bp, Homo sapiens
aaaaaaaaaaaaaaaagaaaagaaagaaagaaacaaactacctgataactttgtcttaatgtctgagtgatttctgagggctaaggaattcttttggtgtgatttgaaaataggattcaaattctaagatacagtttccttatttctccaagagagataaaattctttattatctattttgtgaaagtttatattcaatgaggtgttaaagtcatctgtgcatagtgtattttctgtaactacagggcctagtcaaatagtggggcttaagaaaaagagagctaggaggtttgcttcatcctactaaagtcacctcttttattttgacaaaactcttcacagttacacgatggctaaaacatttttctctacatttgctagtacctgtagtaaaatgtaattgcatttctttcattgtgttttggttttcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctatttaaggcccagttaatataagtggaatcatcatagtttaaggaatacccagagattgctgctgttctatttattttacagaaaggatagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcatttgacatgtgtaatctcatttaaccctcatgataaatatgtaatactttagatgatataactgaacttcaggttattgagtgactttcccaaggaaaacagattgcaggaatatctgtaggatataaaacatgatatattagtattttttagagaaaatatttgctctaaatgccctttcctttcttaaaaattaataatttgttaagagcttgtttattttacttagctgttctgtctggtgagaattgatactgcactaaagacattttaaaatacaatctgaaagatctaacctaaatctttagggttgagagtctaacaaaggatacattggtgtagttctttaggtaactgtgttatttgaactgcatcctaaaccaagtaacaatgaattttagaatatgcatgtggtaggagctaccctgtattccctaatactcgtttttctccttctacagatttcccacctaattagctagggaatggcatcctggaataaagataaaacttttcctagattttatcgctgtatcttggtgtggccacatcaccaagtttgggccaatggatacacttccaggaagtatccttaaaaggaggaggcatgcccatcccttccccctttttcctgaaaggtagacacaatagcagaaactagagcagccatcttggactatgtgataaaggcttcgttttgtgaatagcagagaaatgaggtagatactgtctgaatcccatcttgtgggtatagtagccctgaactacttgtctgaatttttttttttgaaacagagtttttgctcttgtcacccaggctggagtgcagtggtgtgatctcggctcattgcaacctctgccctctgggttcaagtgattctcctgcctcagcctccctagtagctgggattaccaccctgccactacacctggctaatttttgtatttttagtagagacgggatttcaccacaatggccaggctagtctcgaattcctgaccttaggtgattcgcccgcctcagccacccaaagtacttagattacaggcgtgagccatcgtatctggcgacctgtttgaacttttaataaaagtgaagggaggaactaccttcttcaagtgttaatgttctggcttctctgttgctcatagcctaactggattcttgtcaatacagtgcactttgagcattatccatgattatttccatttgaagtaactttccatattgtactaacaactccagttgttagtacagtattagagatgtaataatttagtaaatacctagttgtcctttatgtagtaattaagtaaatattgtagttgctgccgagttgcactgttcagatgctgttgctacgtaaaactccactcctagaattactggtgaaaagtcattttattatgctcacaaattgtgtgggacaggaatttggatggagcacagtgatggctggggaaggagccagggagtggcagggagcttttcagctactggcctggaggttgacattggctgtcagctgtggcctcagctaggctctcggttggaacacctacactgtgtagtttctccctgtgggcacatttgacttcttcacaacctggcactgggttctaacaatgagccttccaagagagcaagagaagtgcatggcattttaatgattagtcttggaattcacatgatgtgtcttctgtcatacttcattggatgaagcagtaaccaaggtccatccagcttcaatagaatggtacatagagcccagtacttgatgagaggagtgttaagattacattataataagaagtatgtgggatgggagatagtctttagaaaataaaatctgtgacactttaatcatttcattaagactgaagaaattaggagagactgaggataagtggttttccattttttttccctgggtcagccttggatacaggtgaattgactgaatggtgctagtaaaatggaagtaaaatcacatttttgtttttttattttgacatggagtttctctcttgttgcccaggctggagtgcagtgccgtaatcttggctcactgcaacctccacctctcgggttcaagtgattctcctgcctcagcctcccaagtagctgagactacaggtgcccaccaccac

SEQ ID NO: 2580 - DNA, 308 bp, Homo sapiens
ccagcagcgaagagacatatataaggttgtctgccaacgctaactggccagctctgacaggaggtgcgtggcccaggaggagccatcaggccagttctctgggatactgctgtgtctccagctctgcagtttgctcttcgtcactcagcggcagacggagaggcagacacgagccccttgtgagccctcctccttaccgtcatctcacaatgctctgaaataaggaggcaaatggctgaggtcccctcagttgtgagtatcttgcttccttccccaatgcctcttcaaaccactttgtcaaaaacaac

SEQ ID NO: 2581 - DNA, 2331 bp, Homo sapiens
attcagtgtttgcaagccagaactaacagtgtattttctttattgtttatagaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaaatcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcctacaaagtgttgtagctgagataccttcctgttttttttcttaaacactcattctatatttcccatatttc

SEQ ID NO: 2582 - DNA, 769 bp, Homo sapiens
ctagagagggaggtcagaacatatatactctaggggctctccctgctagatcacaaaaggttgaatggttcttcttttaaaggctattgatcctgtcaagttccctttcctctccaggtttgagtagccatcttctccctgtacacatcagatccaggggtgttataccttctcacaattgcaagctctggaataaaacattatccctaacaggtttcccttagcccttcccatatttctgtaaatagcgcctctattaaattcttctcaattatacagtttgagtgagccgtctctttctgccaggagccagagtgatacatactcctttcattttggtattcaaaataagtggaaaatgcagtaattttaaaagacaaaatcagattagccatttgaacaatttgttgcttgatagtgaatgcccaatttagtatcatgataagattttagaatttttgcaatacatggaattttaggaagtcggtggtgaagggaactgaaggctgttggcatctacatgagtggggacttactctaagattttggattattttctagtctaccactcacagaaactaccttttagtgcaaccacggtggaaccctgccatagtatctctagcaataacaagcaagattcagaagtccaacaagtaagacattgatttcattaagagagaactagtaagcaagctatttgggaagtacactctcataagaatattgtttcatgaagtcttgagcaacaaaggaaatagtaagtaag

SEQ ID NO: 2583 - DNA, 14273 bp, Homo sapiens
ggtgaagatggagagtgaggccagaggagaggcagtgaggatggagactgggaccggagcagaggaggtgaggatggagaccaggaccagaggagtgttggtgaggatggagagggagacacaaattcaagagatactgcaaaaggaaaaccagatgatttggtaacatgaggaatgcgaaggaggagaaacaggctttgacctggagtgactgggaacaaggtttatctttactaaatatgaggaacatagggaagaaaaagaagttcagggaggaaatttagtctttggaacaaactgaatttgaggttctggcaagatccaggctgatggaaatgtgagctggagttcaagaacagtgtcaggactgcctcagagatgtattgaccaaagcatcatttctttttatagcctgggtccttttgtcccttcacagtggcatctgctttaaggtcatagtcaatctttttcattagaaggtagaacatcttacaaataagagcctttgacttcttcttggagtcatctgaggcatcacattttattaattgcacttttgaccttctataatagatgttttatctggctcttctacttaaaccatggtacttttagccatcttagaaagtgcataacaggctcccatgattgaagaaactggggccaagaaagtgccagtaagttggccaacctcgcacagccagttatcagcatcctgattcccgaccccctgcacttcccactggggcaagtggtgcctttcagaccctccctggtggcatcttgctctgtctctgcagtacagcttgttactttgcactcagaactgtttctttagaactgtcatattcctgtggtctcttatagcttatgtgttgtttccttctaactgaactttaaaaaattttgcttttctttcctactttgtgagggcctaaacgtagtcactttatgttcacttctaccaagaatattctcggtgtttgtaaccagcctatagatttgaacaccatgcctcaccctccttcccaaatgttcgttccatgttaatggttttaagaattgtatggattgttgcatgaaagagattgttgcatgaaaatgtatctgttgtcaacccacatgggttcctttaactccagcaacattaagtgatcttttgtctttcatactgcttatccaactcagagccccggcctcttctacgaggggaaaatgagctgcattcctagggctggtgagaaatcagtgccaatggggagaataaacagtaatcagacaagattccatttaaaacattagggttgcaatgtgtcatccaaagctataataataaaggcccattggtccccagtagagcacagtttaattaaatgcaaccacaagacaactttaccttaaccttgtagacctgatgctttctattaaaatattttctgcttggtccttcttttaccatatagatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggtgagtgagcccacgagtcaaaatgtcttttaagccaaagaaaaagggagtggtttgaagtagagttaattagcaacacgtttaggatttattattgcatataaaccatgatccatttggagatctaaatagcatattcccacgccttctccagctactccctagggaaacagtaaagttaacaatttcatttattactcctcaggtacagcttacttactcagtacagaagtgctgaagcagttctataaacttccaataattaaatttgaagtttttttaatggtcttttgaatacattagtaggttttgagtttgttctttttcttcatagtgattctacctttagatacttcctgttacaatttcagtcagcttttttccattggtttaagatgaatttttaagcactattattaaaatctggtaaatggttttgatgattcatttattttttgtagtattattctataagctttggaaaacacagatgaattcatatggctctattttaccctaacaaagatattagcaagtttttggtgacctttggcaggcagtggatgtaaatctattcattaagcgtgtgatttcattgaaatgatgagtctaattttcttttttgttgttaattttgaagttccgtacttctcacatgcatgttataagtcaacatgaagttatttcctgatagtggtatcaataagttagtaatttaatggagcactgaatgaaacttttacaacatgatctgctcatcatacattcaagaaaaaaaatcaaacaagaagctgagtttacagcagctcctgccacaaacagacttttgtttggaatcactattttttatattattactcaattgctattatgtctgctccaggcatagactattcaggaaatcatggaattctcaaaaagcttttagctctctttcagtagtagaaccggcttatatgttaaatactatacatatttagaaaaaggacttcaaactggagttataggagcttacaaatgcctgtaatggagtgcttgcaatggtattctgttcaaattatctgaagagctgtgggtaaggtggacattcaggcaagatggttagtctttacgcaaagtaataactgggttttaataattgagtctcttattgttaaaatgtaatgttttagtaacaatattactacatttggaaaatacttatttaaacagtcttcattcatagttcatatttttaccatatagtagcagcaaatatccatgaagttatgggagactcccgatgtgcacctttttcaactaaggtcgataaaagaaactctaactgcatacctcatatttagattctagtaacttgagggagatagagataaagatgttctgctagagatgagagcattattaaagagatggaagcatcagggaacagccacccccaaatgtcttagttaacatttttgaagtgtgcgattcactaatatttcctcagtaatcctcatgcaaacctatgatgcatgtactattactatttccatttaattgttgcagaagttgcctcttgtagctttcctcccatgtgaacagttattctgtacttgatgatcctggaagatgagcctgaacacatttctcctttcttgcctgagtatctgggaataggtagctactgcaacactgctttaatgcttttgttggtcacacaataaaggctagaacttatatctaagcatcattctgtatccctgtataaaagtagaaaatcagtgatgttcaaaggacaattagaatctttctttatcctcaaggaaatctataaagatggataaatattgctgccgcaaagacagataaatcttgttgggagctctagactactaaacaaaacaattggtttctactgctttctcattatagtttttctttaaacctttaactcacaggtgttcatacacttaacaaagaaaattattgactttaagaataaatccctagtaagattttatcaatgtgggacatttaaagttcatacgagagtccttaattggttccaaactcagctaattcttttggagtctttctaaatgcatgcatcaggaattctacatttaaattatttttctgcttaacatttttctgacatttgtagggaaaaatattatcttccgcttcattttctacttatcttagaaacctgtcacaacaatgccagcctgcagtttgctgtattttcagagggtcctattacaaaattggagcattctagctataaaaacttaaaactgttccttaaagtagctatgttaccctagatccaattctttcagaaaaaaaagcttatcgcaggattttcaattacattagaattttcactaggaaaatgatttagctttaataacattttaagaaagcctgctttatgatatacatcacaaaattatatatacttattttatttaagcagatgtccttagtaacagatataattatttacaattaaaattacattagaaattgacagtatgtagcagtagaaaaaactcatcctaaatttcaatgtatttgagaacaattgcacatttccgtattcctctttttttgtatttctcttttatgtaaatcaatgtcttgttaaactcagattcaaaaatatttctttcaagtcccactacaaaattctttttagaatgagaccagatacaaatgacaaaaaagaatgagagaaaatattctttcaaataaaatgacctgtctgtcagcatcccctcaaagcgcaaacattagattagttctactgcctgaagtttttacaatgtctcctgttttaatgtcacatgaacttcctctgaaataagcagtgggggttgcagagccagggagctagacattgggacagtggcccatgtgaggagcccaggcttccagtcttttcaaggaccagttggaaatcaagtaggggagggaggaacagtccatgctcacagcaccaattcaggccccatctacacgatcagagcaatgaaaacttagagccagccccactagatcattcttgttctagcagagaaagtggctgtatcctcttgtgtgttcataatatttttcacagagtttaattaggctatagttaaaacaagaacagataaatctgagatgtgaatggtagtgtagactaaacagtaacattttggagccagaaaagctgtgacctcaggcaaatcccttaaagtctgtaatcatcaatttttctgtctacacaagatatgcatcgtaacaacttttcattagggtgggcataattagagacaaggtgttcagggcaccttcacatggagcctgtccatgaccgggtattaatgagagagccattatgattacacaacattatatacatatccaatattatatacatacaatagtatatattatagaagaatatcatgctctatgaattattatgtaacaacacaaccaggcaactgaaagtgttgtgtgtgacccatagcgctctctcgttgggtgacctgtcgcttggccctctgtgagcctgtgagtggcatgtggcctcccggtctcaccagctgcatcagtgcctttgcttcaaatggttcattttggctctaattgccaaatgcagggcgagtggccaaataagtgaaagactcagattcattcactggtaacaggttttcaaatccatcctttcctggcataatctctcagcttgaatatgtgactggagtttagggagcatcgtatttacaaaggagaaacctctttccagcacagacaaggaaagcctgggccacggtcctctttgaaaaaaccaaactgctgtctaagcttttgagcttatttgcctgcattctaaacagtgaattttggacgtaaaacatgctgtctttccagtgactgctttgaggggaaagaaaggggagttcctacaaaatattccttggatgcatttgtcatacagccaatagcaatttattctttcctatgttctttcacaaatgttattaaaggttacagaaaattaaaacaataggaatcttcaatttatagctttcagagatgaaactaccaaattaatgatgcagagtattacatttgaggagcatgagccaataaatggcattaaagcttttacagctggaatatgggctccgccagcagattagggctctccgacaggcctgtttaccatattttggttcatttctaacagtaccaatagttctgaaacaatccctacctaaaagatttcagactccagatatcagagactctgataatgttgtaaatttatgtcatgaaatatgcaaaagtaaacataataatgaaatatcctgtccccacgtttgtaggaatcaaattgcttggctttatctaagatgtttaccattatagactaataaaaagttcattaaagagacttaaaattttaattcagatgcaggcacattaaaacatatggggaatgaggatgcctgaagtttgcaaaattttaggatgtttgtaccaggtctttgacctgtaatttaaacggcttctaagaaatagaagtaattattttatgttgatcatcttttaaaacaacttctaaggagaacctaggccttgtaagtcaacctgattcaaaccctccttgataaccctccttgatattcgtgtgaattctctgggaccaattctcatgctcttttcaaacgttgatgaacttctgggaatggattaccaaacaacaacagcagcaacaaaaccttcagtttttctgtcccaaagttgatgtatgtaaatgttatttctcctcacagagatttacatttaattttggaattcaggttcatcccccatggaattctgaacaattctgcgttcatgatttacattttagaaatttacttcgaagtccctttgaaatggttaaatgtgttaaatttgaaccatgagattatcctaaattccttgaggaaattattagaactactgccccccacatttctgaaagttagatttggaattgtcatgcatatatctagtctctctgagcacttcctccatgcacacttaactcatttgtctgcagagaatcctgggattataaagttggaagatccgtgtaggggtcctttggtctaagagtatctccaatttaccaaactaatcaaccattacttccacgaaggcaaaatgtttgtgttggtctttccttttcttatatagagcttggcacacctagtagaatcaggtgcctaatatgtgcttgtgtgaaattagttcactaactcagcctacgcaaccagtacttatttattccgtcttgtccaagcagcctcactacttcatggggtagctgttctacttccaaagagaaaggcagctcctgttttgaaaggaaatttacacctaacatttccatctggttcacctctctcatctaaactacacagcacaatggttaatccttttccacatatagcaagccctcgggaaattatagaaaactttccttccccctcggtattcacttctccaagtgcaatatccctacttcttccaagcattctctataagcagagctcccaaagcctggaaaatctttgaggatggggagggaggactcatttctacagaaacagatggttgtgcagcgatctaagtgagagggcagcccaggacagcagatggtcctgggaagggctcaggcctccctccctcacctgatgcccccacgcgtggtcagcccataaagacctctttaccatggtgaaacctacacatgcttatgaggttaaatgcctttcctcttcactgagactgctacatttgagtctattttcaacccaaatccacttataaaaagcatcaggggagtggggtcagtcacaaactgtaaattacgtctctatgtgctcttctctgtagacctccctggttgcgcctgcccggagggaaggattattctgagttgtctgtaacctggtagggcgatgtctaaagaaatcagaatccagctctgaaggctgtgtcttagcttcctggagccacgtaacaaattaccatacacagaatggcttaaacaacagaaatgtatcgtctcccagttctggaggctacgagttaaagatcaaggtgtggacagggccagctctcactgcaggctccggggaagcctccttcctgctgcttctagcttccggaggtgccagccgtccttgagctccttggcttgtggatgacgcatcactccagtcccgccccatcttcatgtggccttttttcctgtgcgtctgtctgtgtctcttctcttcctatgagaataccagccctcataaggattggattaagggcccaccctactccaatactccaatattactttatcttaactactttcattggcaatgaccctatttccaagtaaggccacatcctaaagttctggaaaagacaggaatttgggggagacactattcaatccagtccagatgatatacctctttcctacagcctgtggggagaaaatctcatctttgataaataaaggtagaggttttgtgttcgtttcactccttcacattgctgtaactagtgttactgagcctgctctgcacggactaatgaaaactccctctttcaacaacaaaaatgtcatgccttttcctttcagcaggaagggtttgtttagttaagaaagaaactgggcctggataagttttgagtaggggagatgcagggaattgatgtttctcttcttcttcggtaatgctgcaaactaaccagagatggaagctcacacttccaacagctctggatgctgccctggggatcccatagcagcaccccagggtgctgccgcaccagcccagtctcgagggacctggccacggtgaggctggttcacctgggcctgtcccggcccaaaccagctgggcaggaggctcaggccactctgcctaaaggggtttgtaccaataaatgtgggtcacctggtggacaagcaggggaagatgcttgggcagatgggataatttgtggagaaacaagaaatgggacaaagcatgcagctgccgagcacagcactgaggcgcaaaggctccggctgcagttcttctgggttcaaactgtttgccggctgtggcttttgacgggtcatgtaacaactccgtgccttagtctccataatttaaaaaccaagttactgggaggattaaagcagctcattgacttgcagagaactataagaaggtcatttttcaggagttctacttggagagaaggaggggaatgaattgtggaatcgagggtaagtgctttgaaactagcgtgttaggtaaatgtctcctacctgcagcacagggtttatggagagaaccaaatacatgtggctttatatggtccttccaagaaaattaagtgaaatctttttaagttaatatcataattaacatctaagatgattacatatgaaataaatattcaagaatcaatacctttcccatatgtcagcagtcagaaatgcaatgcaaagttcattttctagatgctactaattcctaattgcaaatattccaacccagacaaactttcactgctcagctctcccttcccccgaagacagtttagttccttccttggccctctcacatcattgcaaagaagggctgagtagtgacctacgcatagggctgcatcagcaggttcactggcctgccccagtgaactagtgaaatcccaacctctttccactgtgttctgttttcgattggcccttatatttgtggtttctctgtataaatctttccaagttgttgtggccaagtttcctctggacatccccatttcaccagcatctggctttaccactgtccccacttatccaactttacctgaagggatcagactgccaggaggatacagagttgcagataggttcatgacccaggcacatccccattgtttctggaccagtggcaaatgtggtatatcaagaatggcttgtgtaagagaatcccattcattgcttctgaaacggtgatgaaaggtgtcgacaaaaagagtcacactctgtaaaatatttaaagaggcttattctgagccaaatatgggtgaccatgacccagggcacagtctcaggaggtcctgagaacatgtgcctaaggtggttgagttacagcttggtttttatatcttttagggagacataagacatcaatcgatatgtgtggggtatacattggtttggttcagaagggcggtggtttacaggtcatagtgggttcaaagagttcctgattggcaattggttgaaagagttaagttattgtctaaacacctggaatcaacagaaaagagtgtcagggtcaagataaggggctgtggaaaccaggtttcttattatgtagatgaagtctcataggtggtacccttagagaaaataagttggcagatgtagactctccgtaaatctcttcaggactgggagggtatggaatggggaaagatctattatgttaatagagattctttatagacacaactttctccccactaaaatgacttttcagtccatttcaaaatatggcaaagaaagatatttggggtgaaatattttgattttctactttgtctgtcatgtgaggttatgctagagtcaggctggaaagtaagccacgttatatagggttaaatgaaacctctctgatgagattttatggtttgtggggtgtgactccccaggtcccttagataggaatttgggcaagagaagtaaaaggtcagagttcagtcctcaaaaggaactgcagtatggaaacagcagctcaggatggagctggaactggcactcatgccccctgcctgtgtgtggaacaggccatgtgatctgaagcctgcttctcagcctacgagacaccctactgccattccagggactctgggagttatctctgctcttccctccatatccacactcagacatcccatcctttcagtaacctcccctgactccgcccccactagcagaacagagggctcgtccctccgattattcccaatctgccttgctgggtagaggtcctatttcttgtgtccctcctcaccaggcgggagagcccagatgccgggtgacagttgggacaactggcttttggctggacctgttttcaaagccatgtttggaatgtgtgcttttgttacaggaaaggggtcctgatccagatccaaagagagcattcttggatctcacgcaagacagaattcagggcaagtccataaagtaaagtgaaagcaagtttattaagaaagtaaaggaataaaagaatggctactccatagacagagcagccccaagggctgctggttgcccatttttatggttatttcttgaagatatgctaaacaacgggcggattattcatatctcccctttttagaccatatagggtaacttcctgatgttgctgtggcatctgtaaactgtcatggccctggtgggagtgtagcagtgaggacaaccagaggtcactctcatcgccatcttggttttgatgggtttgggccggcttctttactgcgacctatttcatcagcaaggtctttctgacctgtgtcttgtgccaacctcctatttcatcctgtgactcagaatcccttcactgtctggggatgcagcccagtgggtcccagcttcattttacccagcttctatttaagatggatttgctctggtttaaacgcctctgataccttgtcacccctccacccctctgaggtaccccaacagggatccacagacaaaatgactgggttgtggctggtttccagtgcttggccagtgacatccctcctgctagctgggaactggcacatttcccaatcagagattgcgaccaattcagctaaggccttacagatctgcctagagaaatctgtataatatgctttaatgtatttaaacgctcaaaatgggccccaagtgagcaggcatgcacatattcgcccaagagaaaatagcgttcttttctatttatgcaacagaaagttttacttaatctgagcaagaaagcaaatagcaatttctaaagctttaatttaaggaggcttctctattcagtcagctcataatttgtagtttttaagtcccctaaaatatcacctattctggatttgctgataattgagagttcattctgattttcctttatatgcaaatcttccatgagcaccaactaatgactttttaaaggtctctttgtggacattgcagagaaagtaagaatgtcaccaagtgtaattgttatgctgaataccactattcatgccatcgttaaaaggtccgtttaaagggggtgagagacaaaagctaagcttgactggatggaggagcctttccgtgccactgcggaacccctcgcaggggtgggtagtgagggtgagtaaattgttctgccctcccctgagttcccaggctccttgagtcgcacgtgctcttctagagactgatgggaacgctcagcttgcttcactctcagaccttctctccccgcccagcgcggacgggctccgggctaggagctcgcagagggacgggctgtgtcgcctcgcctctccctgcctctgtgtaggaattccccgccgctgaggtcaggagggcgggagtgacacaggagccgtggctgcctggactcctgggctgccccaggagccgaggacagccaggtggaggcggctacggctcggcccgaacccaccacggcctcccctgcagggacctgtgtccagcctccacggccctgcagctgcattcgcctcagcctctcgtgctgggatccctgggcccttctagattcccatcacgcagggtcaaaaatgcccccacccgtgcacgctcaccgtgagaaacccactcccatgccgtgcactgatcgcccggcgtgctgcccggactccagccctgctgcctcggcctttccattctgcaccgcagggaaggcccaggcgtcgcgcggccagcccctggggacaccttcaggctgctcgagagggttccagctgccaggtcaggagcagagcacagccaccgcgccctccaaggacaccaagaatggaatataaatggctcagaagaagcttaaccatcaataaatgtggagttgaaaaatgcaatggacatattctctagaaaaactgcaaatattattgatattttcttgcttgcctgctttctgtattatattctcatgtacatcttgaattaatgttccaagtaataaagaagaaaggtaaagatggcaacgtaattatgaccaagttctgttcagagccctcgaagatcaatttactttttttgctcttaagtacagtactttaatatgagctttagtgagcatatttatattcattttgaggcggtcatacaatgaaattaaaaatcattctccattcagtgacttttaatttagattttgcataccaattacaactctgcctctgcccccgccccccaaaaaaccctacatttcatcttaagttcatttcttgaaagtatctttgtcacaaactaaaaaactaatgatacaatactggaatttaaaaaacaagatgtaattgggccataatgacaggattattgcctggtaattttcccactattttaagctttgtgtttgacctgcatgctagttggatatttatttgtgtacatcgggttttgaggagttcatagtttttctaacagaaatcactgaatgttacatatgtttgtatgagtctttatttattataaatatgataaacaatcacctaaccaaatgtcttagatgttgttctttctggaagcatattttgtccttccaaagtttcttacaagctgtgagtgtaggataatgatattcaaagagaatcagtaccttttctatttttttgatgaccaactaaaatttctagaagaatttctgttaggaccatagacaaccatggagtgaggagaaggagtgtgatgtcgggcctgtaaaaacctgcttaaaaaacaacccacacattcacctttcttcgtgtacctgctgagctagccactggcggtgtggaacatgaggccttcctgctctcaccgtaagcctggttgcgctgcctacacaaagactaatgcaccaggctacctccaaaagcattagagagcaatgtggtttttatgaaagtcttttttcggggggaatgccaaagagagaaccacataatacatccttcactgattcatttaaacaaaacaaaacaaaaaaagttgagtgcttactatgtgccagcgcagcaaagcttcctaaaaaatcctttaaaaacagacactatgcggccacacagtcattttcaatttaccaaatccctcaaagacttccccagagcctcgcccggtgaacctgaatcaatgtgtacagccacggaaggcctgaggggtgaaggaggttttcactaccgtcgggaaacaagcaggtctagaaaaggatgggaaccttgccacacatggacaccatcctgcaaactttatgttccttctaaccatatatccttaccttctactcctctctttaataacctgactctgaggtcagggtacagtttggaacagtaaaatccagcactgatggcagacttattgaggttgct

SEQ ID NO: 2584 - DNA, 1480 bp, Homo sapiens
ctgcggccgggtgttggcggggcacggcgccgggcggggctggcctgcctatttttccctccgtggcggtctgcctaccggttccctttttgttttttgtttttcatgttttcggtcctacagttaattcgttaggagtagccttgaagatgaaattaaccagtcaagacattccggccgccctatacgccgggcaattaggacgcatctaataagagtaatcgggcgtttataagcaaactccagactgttacgaattaaaaaaaaaaaaaaaaagccagcgagagggtgtgccccaacgttgtcgtcttcagctgttttggagcgaagttcagggcgcgggttgccggacatttgggtcctcctccctcgctgggcggggctgggaggggcgcggcgcagggtacagagcacagaccttagagcaggaacgcccggctacgctatttacgagctgtgagatcttggacgaattccttaacctctctgggcctcagtttcctcctataaagtgaaggagtttggagacatgaccttaggcccttctctgctctggagctccaatccttccgctgagatgatggtgtgtgtgaatggagaagtactgtagcggaagtcagggaacttaggttttggtccagggtctgtgttagcctcagtttacccaattcttaagtagcgccagccatctgtaccccacagggtccttatgaggacccaatgttaagaggtgttgagagtccattgctgacaactcgctgtgcaccgtcacacaacttctgtcctcagtttccttatctgcaaagtgggggtgttggtagcagagaaaaatagagccgggaacgcgaagctttcctggggctctatataaagcgctggcatttccgggacggctggcggcatctggccgccccaagggccccaagatacggtaatcccaaacaatactcggggtcattgtttacagctataaaacacattctgtcctgaacgctatccccaaggacgcgcgcgcgtgcgcgacgaggcgaggccagccagactcctcgcacctccgctgctgcccgctggacagagtccccaactccgcaggcccaggagaggggtgtggggcaggcggacgcgcgcgccggccgtgggtgctttgctcttccccctccccatccctgcgtcctggcttgcctgggtgtttacgcgcctctcccagcaggactgagtaaatgcagtcctttgacgcaaaacgaatcagtccttccccagcggcagcagcaaaactcagaaaactgggggtgggggtagggacgggaggggcacagaagaaatcgtgacattttcccactcggttctcagcccctccccgcgccacgcgggcctcaggccgccctagccaagtcttgggggctgcaaagggaggcgcggccaaagcgccctgcctgagccctcccagtagcaaccgcgtgtcggagcggcgcgaacagac

SEQ ID NO: 2585 - DNA, 4403 bp, Homo sapiens
cagcactgcctcagctaccctagccctggggtaggatcctccctgccaaactcttcccctagccagtgggggacaagctgactttccccacagtgacctgcaagatccgccctgctgaaagacggctctcagctgcaccgagacatttgtgcttcctctgtggcccctgatgtgttggtctgctgtggttccttgttcccaaagctgcacgatgtaaataattcacatgtgaaacctcgagttatggaaactcttggtgttcataactgtgttttttcctctctgcttcatttgaaggctgatgatacctacctccagctgaagaaagacctggagtacctggatctaaagattaaaaataatgaacctttgatcaacgtgctttacaaagtgctgaagaagtcagcacggggctgtcggcccaggagaagcgtaagatgatctgatccgtgtctccaagcggggtcattccattgcttctggctcggtgccgacttcatcacttgcttaaccagttgctctcctgaccgccccaggcttcccgcaagtcattttggtttattttctttcaactgaagctctcttcagcattttggctgatgcaccaggctgagcctctcatctgcagttttctgtgactccatgttttgtgctgccaagggtgggggagcttgcctggcttgccaccagcttgtgttgtgtttccatcatcacgtgtctgcctccatggcgagggctcacccagacagagttgagcatgagtttcttgggagggaacagcagttattggtcatcttccaagagccagggtatcctcagatgccacggtggccctgagattaaggtggcactttttgggggcaggcagttggtatttggataacagcctggagctggactagaataaaatgccaccccctgcccataccctctttgattgatgcagaagtagggactgcaatgtggccagctctcacagcattccaggggaggatgcagatcgagaagcaggtgttgtgtccaaccatcgtgagccctgagaaagtgggttgggatgtggtggaggggagggaagatgcctgggtggcctttgattcccctctgatggagagactctttcaaatggatgagcacccacagacttttactttttctgatgacagagatgctggggggacccagagttgatgttttaagtgtatttgaacatggctataacaaacacacttttaaaaggaaaattagatgtaatacgctacacgtggatataatatttcttagcagcctcggctgtctggagcagagctacattcagaagcttaacggtcctctgagctgtagaaacagctctcatcaagcccatgctctaaagcctgtgacctttcgtccataggagacagagtcagctcacattactttgatacattcatgaactcactgagcaaacattgcccgaatttcttcaatatgctaggccctggctgggctttgaggatacagaggaaaggcatccatctccacagtcacccctaattaggttactctctagtgaggagagacaaatgagcaaacggaacattgtactctaatgtgctgggtgctgtagtagcagcagatgcaacgtgtggaaagagcaccctgaagggcatcacccccagttaaagggagagaagagatgtaagtacctcgtgtcagtcgagcttatagtcctttgaattcctaacctacaacacctagtaagcagcagttttttttgtttttgtttttgttttttttttttttttttgacatggagtctcgctctgtcacccaggctggagtgcagtggcgcaatctcaactcactgcaacctctgcctcccaggttcaagagattctcctgcctcaacctcccgagtagctgggactacaggtgcgcggcactgtgcctggctaatttttgtatttttagtagagatggggtttcaccatgttggccagactgatcttgaactcctgacctcataattcacccgccttggcctcccaaagtgctgggattacaggtgtgagccaccgtgcctggcaagataagcagcactttaaaaagggacaagagaaatctacttcttagaaaaagaggtagtactaatatcctgagagagagaaaaaaaaggttgaatgtatattcagtattccatgaaggcagcaaagggcatacttttagaaagctttccatcaaaaagtataatttagaggattcagcttcttctcaaaatgtcctttttatataaaatatctcattcttttcctgatggtgctggataaatgaggcattgctcaattagattttctggcttgttatttaagtatcaaaaagacatcctctgtaaaaagcttcagtgaaataaggggaagagttttgctgggggaaagaatccccagagtgtatctccatttgaaaatgatttctacctagaaaatgagccccaaaggtcagccggtttggagaatagacaacctccttgttcttggctttgatgaaaggacgatggcatagagcgaagacttcactgctttcacctgctttttctcctgggttcccctgagtttaaaacccacattctgcctgagaagttcagctgtttgtgattcaccaggattaacttcatgcccacctccccacacctccctgcaccgccccccccgcattgcaggagacagcacagtctgtttgtttgtggattgttgcagtcttgtgttctgcaactgtgtgtatacgtgtatgtacacataatctgacagtctgaagagcagaatttggctggagttctattttttccgggaactcaacaacactgacctacatgtgtttccctttgacctacatgcaatgcaattcaataagcatttgctgagtttgtgccaggtcttctgttcagggctgactttaccaagataaaacaatggttccgtcctcttctgtgtgaccaaagggatcgtgggaatgggtggggcatgtgtgtagcccagaatcagtcctcactccaaggcagggagaggtcctctcccttgacctttggatttgctcatgacagtttgcagggagaggtagcataggacagttgggcacatgaagggcttgagcactgagtggaatgtttgccaatttatttccacccccaatccacactgacaaacttcctggaccttacagatagaatggggagaaatctacacctctctctccagcagctatcggtccacattgggacctctctgcatagcacacacacaccacctgtctctgccactgttagctccaccctccattttcctggtcagatctgcaaaatagagctcagtgaggtggtttcccctacattaggcaaaatagacttggttctccctggccttatcttggccatgggagggtgcatctgtgaaagtcactcccctcagcccctgcatgacttttggcaagaaagaaattgggggaaatggaaaaatgggataagtaagatttagattctcaggagtcagtgagagacaggcagcatattgcctactttgagtcaagtgagggatgggaaatgtaaaatcccattggcccgcaagtttgggtgacttttgtatattgctttatggtttcctttcttgtaacttacacaagtacagcctagcctcagttattcagggaacaattaaaaacccttgctgggaactagccaggttcctttttaccttggccaggtcttcttcccaaatggtaaagggtaaggaaggctggccttacccacggggaagtgggctgctcagagacttcattaaactaaggcttgacaatggtcaagggatttgtttgttcctctgggtctgcccatctcaccaccctgggcagggggtgatgggcttcgtaacttgtgtttgttcccacgttcagtagtacacctctgtcttatcggtggcaaatcttccaagattcatgctgatttttcacattcattttaggcaaatatatacttttaaaattgatgatcctttaacttgaacatctacattttctttaactcaaaggacttaccagcattactagaatcatcaaaaggttttggttttttcctaaaatgaaataggcatagaaatagcgaagtatggcccaagtttttgtccctctcatactatgaccctacctgccactgccaaggacttccacaccatccattataggatgaattttctttcctgagttctgatctcaaacaccatggttaaatctcttttaaattgttcgcctcccagatgacaggccgggaccttctcaaggatcgaagtctgaagcctgtgaagatcgctgagagcgacactgacgtgagtgagcagagtgacacgctgacccctcagctgcctcctgacccagacccc

SEQ ID NO: 2586 - DNA, 12873 bp, Homo sapiens
aggaaaaggaggaggaggcagaggcggtctgggccgggccgggcctgacccctgcgtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggcactgtgctaagcagttttcctggaagtgtctacctcatttcgttctctgaatagctctaagagcgtgaacaaccccagaaggaaaaagagtgctgttgttaaaggtatctggcatcatggacccaaccatcaccaggagtttctcacttcatctctgctttattgtagtataatttgcatacaataatggcacacatttaatgtgcacagtgtgataaattttgacatatgtatacatccatgaagccggcaccacaatcaagataatgaacatctcgcttaccccagaagtttcctgtgccctgtcactcctccgtattcctccatcctcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaaggtatcaatgaacgaacaaataaattaatgagctgatgtattgattaaatgaatttacttctttcagatttacttttccaaactaaaaaaaaattgttttaaactttgttccaaagttatacagtttttacaaaaataaaactttatttttgaattgctttatatttacagaaaagttgcaaagatatggaaagttgcctcaccctataattagcttctgacattagtatggtacatttgtcacaattattgaaccagtattgatgatatgttattattaactaaattctatactttataaagatttcctcagtttttacctaatgccatttctctgttccaggaacccatcccagaaatcacatttcatattgatatcaagtttcctaagactcctcttcgtaggtacagtttcagggccaaaattttaagggccttgagtgttttgagcagtactggacaggtgttttttaggatgtccctcgactgagctttgactgatgaattgctcatgattgaattgggactatgggtcttcagaagaaagatcatgagccctttttgtcacatcatgtcaaagataccatgccatcaatacaacttattactgatgatgttgacattgaccacttgactgagataacatttgtcagatttctccactgtaaagttacttttccccactttccatactatactcttttgtaggaagtcactatgcacaggccatacttaaagagagctccatctccttgagggcagagtaactacattaaatatttgaaatctttctgcccaggagatttgtctatttttccaatttatttattcaatctattattattatgttagatatgagaccttgctatgttgcctagatgggtctcaaactcctgagctcaagtaatccttctgtctcagcctcctgagcaggtgggactataggcatgcaccactgcacctgacaatcatttattgatggcagtatgaactcatggacatttgttttatccttaagttataacccaatattatattattttattgctaaattatttcagttttggccattgaagctcttttgtttaatgcccatgtcattttgacatacctctatcattgtgggatttctttttacttttttgcagatatttctttagtttttggcactacaagaggctctagtttcatcatctatcctgccccagcccaagattcaaccatttcttcaagtagcccttgctcttttttactgtacattgtaattaataatcaagttcttggcactaggttcttcagaaatttttttttagtttatatgtttgttgataaggtattgataaagattctgctagtgattaccaatgtaacttttggcaaattatctgaaacatggaaataataatttctacttcataggactgttgtacattttaaatggattcactaggatagtgcacggagtaaaaggaaacaaatagtaactctaaatggtattattacaaattcattggaaataaataaatgtaaatttgcttccaaaagtcaatctgaattctctggaagttttgtttctgctttgacatgttttcattgctatatacgtagactaagaagttagagactctgattctaggcctagctcggttgttaaaaagaattcactccagtcatctaatgcctcctcttttaaaatgggtataatactctttgctgactttaaccccacagggttagtctattggtgtaattgatataaaatgaagtttatacaaatgtataggtggcaatattaccaccatttttgtcggtatcataggcctctgattcattcattgctctttgcagctccattttctttctccttttcttaaaaagtgttgaccatactatcttgaatccatctatttattataaactttaattatgtcaggttttgaaaaactagtattcaagtttagacaacacaattgtgttcaaatgctattacaacgaatccacattgcacaactattttagagacttaaaatttagttaacatttttctaattagttcgcagacagtagtaagctggtgagcccacctagttcttggtcttgagaaattttcattcaactaagcataactaagcctactgagttactaagtcataaagaaagtagaaatatagatgtttgggaaagtaagggatagcaggagtgtgtggcatcttaaaaatgccctagtatcaaattattgatgcaaagcagttggctactgtcttaaaaggaagggacatcaaccatctagacaagatcaaatatcaaagtcgatgggttttgcaaactgatcatcttgttttcctcttaccaaggtaaagcaaggtgcttcgacacacctgatagattacagactgtatcaatatcactatatgagtaatgttgatctccataggatgtgtcaaccttcaaaaacattttaacaggtttatgtaattgtttgctatctcgttgttgggcagtatggataagaaaaagtgaatatttagctctaaatcctttgagcctcacttccttcaaaatacctgtcagatcatctgcaaaaattcactctaattgatcttaagacttaatggcaacatgttgagaaggagaattgaactgggttcccatgctaaatgtgtttaaagtcacttctctgatttattttctttctttcatggacagcaaattcaaacttaactatttgtacgtatcagtgaataccttttgttatgggtgtaagatttatttgcaaatcggcaaaatggttaatcaaatattttgtgtgcattatctgatctcttaacctttctgtgcatctgattcataaataaccaaatatattaataattctttttttttttttttgagacagagtctcactctattgcccaggctggagtgcagtggcatgatctcggtacactgcaagctctgtctcctgagttcaagcgattctcatgcctcagcctcccgagtagctgggattacagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacagataaaagaaaataccgaagactgaaaatgcagaaaattcaaccatgcagcccattccaaattaaatatgtcttcctctctaattcctctcttctagcagagaaggggagatgagctatgactccatgctcatgcttaacaaaattgtgttagattggtgcaaaagtaattgcagtttttgccatttaaaagtaattgcaatgttatctcctagaatttttatagtttcaggtcttaagtttaagtccttaatccatcttgagctgattttttgtatagggctggacgttcgcttaggcaaggatttcatgaccaacaacctgaaaggaaatgcaataaaaacaaagataaatagctggaacctagttaaactaaagagcttttgcatggcaaaaagaagagtcagcagagcaaacagataacaaacagagtgggagaaaaccttcataatctgtacatctgacaaagtgctaatatccagaatctacaatgaactcaaacaaatcagtaagaaaaaaacaattccatcagaaagtggctaaggatatgaataggcaattctcaaaagaagatatacaaatggccaacaaacataggaaaaaacgctcaacatcacaaatgatcagggaaatgcaaatcaaaaccacaatgcgataccacctcactcctgcaagaatggccataattaaaaaaaaaaatcaaaaaacagtagatgttagcatggatgcggtgaacagggaacacttctacactgctggtgggaatgtaaactagtaaagccactatggaaaacagtgtggagattccttgaagaattaaaagtagaactaccatttgatccagcaatcccactactgggtatctacccagaggaaaagaagtcactattcaaaaaagatacttgcacacacatgtttatagtggcacaattcaaaatagcaaaatcgtggaaccaacccaaatgcccatcaatcaacaagtggataaagaaactgtggtatgtatatataatggaatactatgcagccataaaaaggaatgaattaacagcatttgcagtgacctgaatgagattggaaacttattctaagtaaagtaactcaggaatggaaaaccaaacatcatatcttctcacagatatatgggaactaagttatgaggactcaaaggcataagaatgatacaatggactttggggacttggggggaagggtgagaagtgggtgaggtataaaacactacaaatatgctgcggtgtatactgcgcaggtgatgggtgcacgaaaatctcacaaatcatccctaaagaacttactcatgtaaccaaataccatctatacctcaataacttatggggaaaaaagtaattgcaaaaactgcaattacctttgcatgaaccaaaggcctactttggagagtcagaggaattcttaaccataattcaaccaagacatacggtatgtgccttctctttggtggaacagtgaatatacaggctactagcctgtactgagtgtttcagccaaaacacattcttttaaaagtcacagttttaagtgacaatatcccaatgaaaatacaaattaaaaaatgcattggcatatctatattccctcccaaaataacacacatttggaatatataaagaactcttaaaagtcaatgagaaaaaaagcaatagctcagtagaaaagtgggaagaagacttggacacttcagaaaagagaatatattaaaatagtccataaacagaaataaaaggtgctcaactttatgagtcatctgggatatgtagattaaaaccacagtgcaatattataccacccctaccagaataactaaaaagagtaagttggaaaatactcagtgctgatgagaaagtggggtaattgaaactcttatacatcattctaggaacatccacttaggaaaacaacttggcagtgtctaataaagtccagtatatgcattccctataacccagaatttttactctcaggtgtatacccaacagaaatgcaggtgtgtgttcaccagaaatcatgttcaagaatgttcatggtatcactagtcatgaggcacaaaaactggaaatgttcatcaacaatgagtaggataaataagttgtgttaatatttatacaattgaaaattatacagcagaaagaataaataatctaaacctacacacaacagcatgaagaaatctcatgagtggaatgttagatcataacctaaataaacttacctggagcaggtgccactgaagccataaaatggtaggatgaattgctggaggctgactatggactagcttgacagtaaaaaatttggggaggtccattctgaaggaggcccctcacactttcttggattttatcttcaggaagcccaccagattttcatggtgaagatcttagaaaacatctctcatatcttggtcagttgggggaaagtagcattttgaaataatcctagagcattctccatagccaaggtttactcctcaacggaaacaactttaccagagccttagttgaccatggagaagggcagttagccccctacatccctctctagctttcttgtgttacttagtggaaggaaaaaaaggataagaaacacttctgaagtccaattcagggacttgagcccactaaaagactgaaatatacttacctcctccacaccttaccaccacatcaacacagctccagaataatcacaatgggttacaatggaaagagctgcaaaacatagactctatttaagaaggaattcttagggaaatccaatgtggagaaaacaaagacactgaggaaactaaagtctctggcatctatagctatggaaaacatgaagcacaacccatctgctaggcagattgacataaaacctcatactaaagacctattttcctcagttctcattacctgatacatcatgtttgacttttaacaaaaaatcataaggaaggctatacaaaaagaaaaggaaaaacacagtcagaagagacaaagtaagcatctgaactagactttgacatgaaacaaagtttggaataatcaaatagataattaaaaataactatgattagttatgttaaggactgtaatagaaaaagtataagcatgcaagagcagatgaataatataagcagaataatgaaaactctaagaaagaatcagaagaaaatgacagaaatgaaaaacactgcaacagaaatgaagaatgcctttgataagctcattactaaactgaacataaacaaggaaataatcaataatttaaagatatatcaaaggagacattgcaaattgaaatactaagagaaaaaggactacaacctccattccaatatccaagaacaattacaaaaatataacatatgcataattgaagtactagaagaagaagaaaggagcagaggaagtgcagaggaagtacagtagttccctcttatccatggtggatacattcaaagacccccagtggatgcctgaaaatgcagatagtaccaaaccctacctatacattctatgttttttcctatatgtacatatctatgataaggtttaacttataaattaggcataaaaagagtttaacagtataataaaatagaaaaattataacaatactcagaaccaagcacaactgaaaacttgtgaaatgtttatttctgggcatggtggctcatgcctgtaatcccaacactttgcaaagccaaggcagatggattgcttgagctcaggagtttaagaccagtgtgggaagcatggtgaaacctcatctctacaaaaaatacaaaaaattatctaggtgtagtggcacatgcccatagttccagctactcggggtggtgggagggtgtgtggtggggggcagtgtggggtggaagggagctgaaatgggataatcgcttgagaccaggaagtcaaggctgtactgagccttgactgggccactgcactccagcctgggtgacagaatgagaccctgtctcaaaaaaaaaaaaaaaggaaaattattaaggataaagatgggcattaaataatgagaaaggggcaattatccaaaaaacataataattcttaagttatgcaggtaacacagcatctaaatacatgagacaaaaatttataaaactgcaagaagaaataatcaaatttaatattatttaataatatttttggagatctcaacatccctatattaataacagctaatttcaacaagcagaaatcaggaaaatgttcaactgaatagcactaacaatgaacaggatctaactgttcaagtagcagcagaataattaatcaagtaacagcagaatacatattcctctcaagtttatatgggactttatgcaaaatagaccacattctggggctgaaaaagatgccctcacaaatttaaaagaatagaaggtttactgcatgtgttcttagactataatgaaatttaactggaaatcagtgccagaaaaaaactcagaagtccccaaatagtttgagattaaataacatacttttatataacacataggtcaaagaagaagtctcaaaggaaatttaaaaatatttcgaactaaacaaaatgaaatgtacatcaaaatttatgggatgctcaggaaaaatagctagtggatgcttggcttcatacctaggtgatgggttgatctgtgcagcaaagcaccatggcacacgtttacctatgtaacaaacctgcacatcctgcacatgtaccctggaactgaaaataaaaattgattaaaaaagaaagagaaaggataattcctttcacccacagtttcctgtctcctaatagtccttctgttgtgtctttaaataaatgtgtctcaaatcttaagatattcataaaatctgggattgcagatgtattttgcattacaagtcctatttttattttttaatggaatgctgtaaaagcagttcttagaggcaaatttatagcagcaaatgcatatattagaaaagaagaaaaatctaaaatcactaatagaaatgtgccttaggaaagtaaagagaggagagcaatttaagcctcaagtaagcagaagaaaagacataaaactttgagcagaaatcaataaaattgaaaacatgaggtcaacagagaaagtcaataaacccaaaaggcaatgcctttaaaagatcaataaaatcgataaatccatagccaggctaaccaagtgaaaaagggagaagacacaaattataaatattgattccatagacattaaaaagataataaaagaacattacaaacaaatgtatactgacacttttggtaatttagatgaaatgaatcaattccttgaaagacataaaccatcaaaacttatggaaaagaaatacattacctaaatagatctatatttatttaaaaaatagataaatcattaataatctttcgaaaaagaaagcgtctcgcccagattctttcactaatgaattccaccaagcatttaaggaagaaataatgtcagttctctataatcacttttagaaaatagaagtaagaggtatacctcctaactcattcaaggaggcaggcattatcttaatatcaaaaccggggaaatacactacaagaaatgaaacctacagctcaatatattttatgaatatagatggaaaaattttcaataaaatattagctaattgaatccaaaaatatataaaaatagtaatacatcacagtaagtgcaatttattttaggcataccagactgatctgacatttattaactggctaaagaactattttatgattctgtcaattgatgcagagaaagcatttgacaaactccaacatctatttatgagaaaaagtcttagaaaactaggaataaaaaacatcctcaacttaatctggaacatctaaaaaatgggacttcacgctattttatggtgagaaatgatatgcttttcttctatattgggaacaagacaaggttctttttttgccactcttattcaccatcctactggatgtcctaattagtgcaacaaggcaagaaaaaatatatatacagattagaaagaaaaaaagaaaactacctctgttcaagatgacataattacttatttagtaaaactgaaagaattgactcctggaattaatatgtgattatagcaaggttgcaggatgcgaggttaatagaagtcaattgtgtttccatgtaccaccagtgaacaagtgaaaattgaagttgaaaacaaaatacaatttcattccttcccccagcaaaaatgaaatataaacaacaaaatatgtatacaacgtatattatgtatatggaaaattttaagtctgatgaaagaaataaaggaagatctaaataaatggagatgtaccactttcatggataagtagattcaataatgttgagatataaattcttcacgaattggtgtatacatttaatacaattctaataaattctcagcaagttattttgtggttattgacaaatttattctattttttagcttcatctcaaaagatgattttaaaatttatatggaaatgcaagagacccagaatagtctacataatactgaccaaaggactaagttggagaactgacactactcatagtactacaaagctacagtaattatgacagtgaggtatttgtacaagaatagacaaatggattaatagaaaagaggagagagcctcttttagaccctcaactgatccttgacagagcaaaataaattcaattgagaaaggacagtcttttcaacaaataatcatcaaaaattgtgcatatacatgcaaaaatgaatctagacatataccttatgcttttcacaaaaattaatttaaaatggaccttagttctaaatgtaaaacaaaaactagaaaacttctatgagatagcataggagaaaatctaggtgaccttgggtttgattaaatcatgatccatgaaagaaaaaaattaaaaaaaaattgaacttaattaaatttaaaaattgttatgtgaaatatattgttaagtaaatgagaagacaagccacagaatgagagaaaatattttaaaaacatatccagtaaaggagttaaatccaaatgacaccaaggtatttaaataattctatgtaatgatcaaaagatctgaacattcaactcaccaaataagatgtacagatggcatataagcatatgaaaagatgctcaacatcttatgttattagagaatagtaaattaaaacaacaatgagaaaccactacacctattagaatggctgaaatccaaattactgacaacaaccaatgctgttgagaatgcaatgcaagagaaactctagttcatccaattttcaaatgtgactgtaaaaggctgcagccactttagaagacattttgtctgtttcttacaaagctaagcatagccttgcattataatctgcagttgtgttcctctgtatatacccaattacactgaaacattatgtctacaaaaaaatcctgaaaacaaatgtttatagcaggtttattgttacttggtagttaccaaaaatggaaaacaatcaagatgtctttcaatagatgagtgaataaactataagatatccataaaatggaatattattcagcagtaaaaagaaatgagctttcaaatcatgaaaagacatggaggaaactcaaatgcatactgttacatgaaagcagccagtgtgaaaaggctacatgctatataatttcaattagatgacattttggaaagaagcaaaactgtaaagaaaaagatcagtttttgcctggcgttcagggaaagggaagaataagttaagcacaggagacttggggagctgtgaaatgattctgtgcaatattggtggaattttggcaacattatgcatttgccaaaggcaatagaagtttttgacacaaagagttaccataatgcaggcaaattttagaaaattatttagaaggtcagaggatcccagaagcaatgtggactttacagaagaaattcactgcattacaaagcatcagataaccttagtaaggtggagagagaaaatggtcttaacataaatatctttaaaaatgaatggaatctgtcagactataggcaagatgagctgcacaaaagcactgtactctagctgataaaattatttctcattggcttctggttaacagttctgatactgctatacatatatatgggaattgaataattaagcctataaatggcaaacattgggagttatatttctcacggtgtggaaatttacagatcaactaggggaacagtcttgaataatcaatgtgatgatcattacagttggagacatcaaggagaactaatgtttaacttaatatagatatgggtggttatatatagaaatattcaaagatgtttatgtaaatacacaaaagcacaaccatgacacatctaaaataaataacaccctggtaaccatgggcacacttagtactcaaatgctggagtgcaatggcgtgatcttggctcactgcaacctctgccccctgggtttaagcaattctccagcctcagccaccagagtagcagtgattacaggcactcaccaccacacctggctaatttttgtatttttagtagagacagggtttcaccatgttggccaggcttatctcgaac

SEQ ID NO: 2587 - DNA, 10059 bp, Homo sapiens
gggatgtgtcctacaatcaccatcagccaggaagtggtcaggatgcagtggttataactggattattttccctggcctggctgaccatctgcaaccccctggtgtttcaatgtacaaactattttaggaccatctgcgtactggctgttgcctgaaaatcttgtgttgatgtggatttgtaagactgggaaagcaccagcattcaaaacttgaagaaaggtgttagcagtttggcagacaatcctacagaaaactctttattcttgggggagaaaaagttgcctcccatcaacttcaatggttcacaggatgatgacgtgtggggaaacacaaacctcgacaacattgagtccaaatgtgtttcggaagactcagaatgaagaagaagatgccaaggaaaaccttaaccaatttattttcctttttaatgagtgatatgtgatttttcaaaagcctaaatacatctaaaagagctatatcagttaagtataagataaaaattctaaaccatagaaagcactgttactgcttaattgacagcaatttttctttctttgcaatgtataaaataatgggtgctttttatgttcactgaaattcatattgttgtctccttttacagctgggaaagcggaaatctggagaactaaaatatcttgctgaagatcacaatgcagtaaagcatagggcaagtttccaactcgaacatcaccccagaacacttccttttaaacataaattatgttgctaacttttttattgttacttagcaggcagatttcaaactgatacaaatgttgaaaatgatacaaaatgttttcccaccttaaaggcattctgaaacctagcacataacatctgtcactgaagtccatagtttccaatgccatgattggataaagaccctattgagactcatgtgtttgtctctcactgcttaaaacactcatgtgttttaagcaacatgacaagcacaaaagagaacaagtactgctcctgctctccaggaagttaccataaaataaaggggataaggtgccttccaaagaaaaaacaaatactaggagaggtcagaggagaagagagattattccagaaggagagactgaggcagatttcaggagggaagaatataagagtcccaaaagaagaaacaggaacccaggttagagagcaatgggcaaggggtaggaggtgagactaaactcacaaggaagttgcttcaaaacaatagtgccccaaatgccaagctgatgggttggacccatttaggaaaaacccacaaagtccacaggagagcagactgcacttccatgagcttcaagctgtaaacagtaacctcaaataaaacttttcccggatcggtaatttccatcctgaacaatggccaagtcaaggaagctgaggatcgagccccctaccgcatgccacaaagaacctcaagggaccccatgctctggggagctcgcaggaggaccagcacagaggtgtgactgcgttggggcagggtggccacatgtacaatgttgtaccttccaatgttcctccttaggctgtgcttatgaagtcccaacatgtcttctgggctgtgttttcaaccaagagagttaataaaaagtgggatgggcaccaactatgcctccagagacatcaggcagaatatgccacagcgtgccatgtcctcctgcaaacagtcagaaagaaaagatctctaaaagcagattggaagagactatatatacagagcgagtgccggtacagaagttttgctgcaaatacaccctctaatcccttgcaacccactgcaagctcgagagaccagtgcccttggtaaaacataggagagatcattaattaaagcctaggccctttctttgatcctgagggataaggcttgggaaaatgcacagtgataaaagtgaacattttaaaagagcagagtgagtgtgaattcccaaagagaccattcatatcaagacccaagccatgagaaaatgctacaatgcccttgatcaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttgtgaaggtcacagagtttcagagttctaagatcccatgcgagattgctgaacttgaacttgtttcttctgatctcatgtcaataagtgacttagtcaacacctgggtagaaatcatcactaaagtgagaaagcacatggtgagggggatgaatcctgtgcccacatggtccctttcacctgcccaatcctcaggcctctcacctggggtacccctcacacacatggcactttcctgaactcatggacatttcagtttgtaacgatcctcctaagattatctactttcacctatccacatttgaactatacttctttagtggaaaaaaagaaataaagccagtgctgagaatgatcaaactccagaaatagtagactgctgtataatttgtcttgcgtgacaccagatctttcaaggaactgcaagctcaagtgcacagttaagcaagatcaagatctacctttgtctttcagagccttcccttggcgaggtcaaggatatctgctgtgagcctgggctggctgaaccaaagggcaatggaggcggccaagaagccccagccaactgctcccctccccaacccccttctccctggaggtcccttcagctagaatttgccattttctgtcagggttgtgcatttcttccagtcaccatgacttcctgagatagccaaaagcatttgctgtgagcagagccccatggctggctttgcacatcaaacatttcagacagccatatatttcatagaatacaaggggaagataacactggacacacagaactttccaacagcttgagaaaatgtggtgcctggtgactgactaaatatacaatcggacaacagccaggccatagcaaaagatggaactctgatccacaaggtgcagcaactttcccagaaaacaatacccttacccacaaaaagcaaccccggaagctggcctgctctaaatcagacctgctggaagccaaattgctctctagtaactatccaggaagctaaataataacttctgtaacaattgactcaaaatgttcaggactggattaataactgatggcttccctaatttttgtccccgattccaacttaggacccaccagagaaagccaaatatggtcccctgaccaagcacacaggatgttcgcttctagtgagccgcctccagcttccccgcattgataacctccaatcagggcacacctgaagccttcgcctttttccactataaagctctcccactcgtctgcccacctttgagtctctgccaaattgcaaatgatggtgtctgactcccttgctgtagcaagctctgcataatagcttgtgcttattctctttgggtaggtcttcatttcttttcacaccagataggcatcatctttgaaaacatctttactgggtctcttgtctccctcctgcagccactgatctaaatcacagacttttttagaaagagggaaaatagtaaagaaagaaagcgattgagttgatgctcccagccactgtctgtaccctgaattttgtttttctgccatatgtcaggtggcctctcctggaccatcgtcactgtttctcctgcttccctgcagctgcagacacaggagcactgtgtaggtctggccttgagcacccacccacccagtacagagccagcccctgctgttctgaatcagtgcagtgaccacttagaacacagtgcccatgcctctgtgatctgaactgctctttccagttccatacaatgttaagaacccacttaagaatgttttaatcattcagtagtttttcgtggtatataataaaaaagtgatttaaatacaatctattttattttagattatatcattaggggttattttacaaagttacctttaaatactattgtaaataaaattaataacaaataagcaaaattcttacttttccttgtttgacaattgacatggtcaatttaatttcctttaaattaattatgcaagaaaaggatatttcctcaagaaaatttaaaatgatatatatttcttggttgggtgccaaatattcattcagaagaagacggaaatttaaatccttgtttctaatttaaggaaaaaactactttcattattggatgtgtgaaattcacccattttgtgtttatctagaaaatctagtttattgtccaaatgttcttattttccccaaaagcatcagttaggagagaagatttccagctgccattaaaatacaattgtgtgcaatgaatacattttgggtatagatagtttttattctctataaatgaaatgccaaattggatagaaccatcctttttttttttttttcaaaaaaaaaaggcttttggagtatcagagacatcctcttatgttattttaaaataaataattatttgagctgtttgcttcttggaagcagataacaagggggcaggtgagataaaaaaaaaatatatccaaactgaggtgagaccaaagatggccaatctaagaaccaggcagatgtctctgcctgtcctgggaagattccctcaccaggctccctcactggccagaggagcccacttgttgggctgccaactggttcctataaattctaaggcaattagaatcatgtggtgactgtaacgggaatgacacagctgcccaggcattagaaggaaaccacacccaatggctcaagccagtggcgagagataaaaactgagagacatctcccctgactagcagactgggctccctgcttccccattgcttcctttaaacaggccattcacacatttgcctgaaaacttacagtggcccagaccctactccctatacacactgccagttgccatgtgccttgtttctctctctctgcatgatgcttcattcctatctggagtggcccagggacaaaggactgccctcccgactctctgtgccctccctgcccaggatccgtaaattacactttttgaatttgtttcctactgtggtgtatattgcctttgcaccttccatctgaagaccaggggatgccccaggccaggttttacctgggatgcccaagagagcacaaggtttggctcccagcgccagagcaatgggcaggggggcataaactgaacacaggaaaggcaagagccacaaagacatataaacaagtttcccaggcgaggagcccctggtcacaggtcagacaactaggcattgggccatctaccaggtaaaagcagcatcctatgaaaggcacgcagtaaataccatgtccatctccccttcatttccccttagggcggtttgctagctgttctgggactggaacctcagtttagctgggggctctcagaacagacagctagatgaattaaacaatgaagtctctcagccttaggcacatcttccaggacaaggggaaggccaggggagagtaacatcagtgatcctacaagatgtgcttccaggccaaggccaggttgcagttgcagctacttagccatggtacacggtgggcctggagcttctgggtgtgcaaagatgtgactcaagagtccatctgccagcagtgagcagggcaggccagctctcctctcactggtacggtggttccagccctcacaggacattaaaaccacctggaaactgtttatgaaggttcctatattcaggaaaaatccctagagattctgaccgaaggaatttggtgctgcctgggtaccagtatttttaaatttccccagatgatcctaacatgcagtctgagtgaaaaacccaagtttgacggctacaggaatttagagcttctctaaaacatacagggaataataccagggccatacattggaagtccttccattgggaatgcaaagaaaaaagaaaaagatggccaacatctaccattttaaagggattccagcaagcatattattaaatgcagggctgcctctggcatctggaagcagcttgggtgccctggatataattctcttttaaaagtttttttcacagcttttatagaccacttaaaactggccttcatcttgtgccaaaatagcagggctgtgtttgtttagcttcaagattttcaggtccaattgattaaaaaaggtgagtgagaagcctgccaacacacagtgaggctgtcacccaggcagctgctgctgctggcttccagcatccagaagctggaacatcagccagctccaatcacctgacagaggatggatcctatgagaaggaggaccggggcttaaaaccagacgtacccactgaagtcagggcaggagatgaaaatcttaacaagtgaaggaggtatgaaaacaacagattctagggatcagcaaccaatgaatgagggtccattttttgaaaaacaaatacttctactggctgtcttttgagtgccaggcattaaacaaagtggaagaaaaaaattggagggtgactcaacagatggaccagatcaataatgaggggtaatttgagcaggacaaggctggagctggaagtgcatgcaggatgccagcatcagagcagccaggcatcagagagccagccttgactactcgccgggcctcaggggctgagccttcgtcccaggacaagggagtggccagagcttggctggccccgttccagatgaggactgtgataccagtcaggtcaacgagcaccgatagaggtagggcccaatataggaccgtgtctcacaatggtgcagacccgcagtccaacacacaggaaggatgcttgttgctaagtcttagacacgggaactggaggagggttgagggcccccagcagtgggaaggcaggcatggcatgcagacggtggacgcggactcaagacaccaactctcatcactacaggtccgtggtttggaaagtcccagcaccattccagagaaggaaacaggcccaggtttctgatggggatgggtagtagccacagagcacaagtcagccgcacccaccacacacttgctgtagtgccacactctcggccctagagggcactgacgctttcccttcgctctgccccagggccagggccaaagccatcaagtcctgggcagagggcgggagcgttcagtgagagcagcacagaggttaaagagctgctcttttttgagatcttcgctctcacttcctttccaggcagccagttcagcaaggtgggtctggggctgcctcctgggagaagaggcctttcaccctcgaaccctgcaggacctcagtttgtcccagggcaaacctcctacattgggcagttaggtcagacctgcttcaggccttggaagactgtcttctccttggcttctcttactgcactggatccagccaggacactgatcagacctccagggcccaggttaacaatatgtggcccagctctgggagagaagccagcaggtctcccaggcttttgaactcggagctgaaaaccaaacaaaaaaacgaatccaccccattgacaagtggcccagcctagttggccagtcaggagactgcacaggcactgaggccaaagctgccttggattaagaggtatggatgccaccgctgcccttttactacaggtacactggccgggaacctgtagcactgagtgacacctgatcagagagtcacccactggctgggtctcccccaactcagatgcatggctaacaatcactagctaagcatgtattcactctgtggaaagccacgtcacgttcatatatttattatctcatgtattaatatactgatgtaccacattattctaatttactacctcacttaattcttacaacaacctaatgtgatgggcaatattattattagctccattttacagatgaagaaacaagacctgaaaaggttaaacaacttgcccaagatcatccagccaagtcatgataaagctgcacttgaacacacacttctcagattccaaagcccaagtttctctctactaactgtatggcccctgcactcaaaaactgagaaatctctctgccctggaatacaacaagaagtcaaccgtctgcagcctgtaagagggcctctcaccagaacttagccatgctggaaccctaatcccagacttccaggcttcaaagtgatgggaattaaatttctgttgtttataagccacctcgtctacagtactttgttatagcaactcaaatggagtaggactgtatgcaaacaaaacaacccatttttgatatttgggaaaatctaagatctttaatagtagttggaaattttcagcaaatcctaatattgggtgcgtatcagtatatgtgtgtatccacaatatacagtgtcatacacacacccatataagcaccatctgcattatataataggcacacctgtatcctcaacgttggtgtacagatgcattcatattacccatacagtatgttctgaagatagtcaataaactcagacccaagacagtcctcccatcttttaattctacatagaaatcaggacgcacctgataaacagcagaaaatgtaagagaggccaggtgcggtggctcttgcctgcaatcccaattttgacacactgaggcaggaggatcgcttgagctcagaagttcaagaccagcctgggcaacctagcaagacctggtctctactgaaaatcaaacaaatttagctgggcaaggtagcatgtgtctgtagtcccagctacttgggaggctgaggcaggaggattacctgagcccgggagatcaaggctgagtgagctatgatcatgccattacactccagcctgggtgaaagaacctttgggtgagcagagcagaagtcaagcatttctgggtccctggctccgatgctgtcttacgggcaccacttgttcctaacaggaagctctctttgtacacaagttataattacccatcaaacctgcggctctgtgacctttagcaaaatcactgggtgttgttttcagaaataaattagatacagaaatggagaaaatgcacagagtaactccagacatttttg

SEQ ID NO: 2588 - DNA, 11473 bp, Homo sapiens
ctcctgagccaggacgcagaccatgactacttttgcctctgcacgtctgttctgatttctttcttcatgtgggatgcctctctatccttctcctgcttttaatatggagcttcagtctctaagctaaaaggccaagtccagattcacctgccaatgaagctctttaaattatctcttctttctcaggactcactggctatcagacattactttaggtgaagactttccagtctgacttccctcacctgaggtaggtgtttattctttcctcatctcacaggactttgcaaatcccactgttatagcatattaaaatttaaattgttggcttgcatgtctatttttctacttagcgtgagttcattcacagtagtgatcatgtgtttggttcttaacaaaagtggttttctttggattttccagaagcagaacctaagagaaaaattcacgtgaaaataatttattaaggaagggctccagggtagataaataaggcaattagtggagcagggcaaggaagagaaggaagtcaggcaagagtgtgattgccatgcaaagcccaaggagaacagctttagcctgattccacagggaaactttggagtgtaaactaaactttagagctactataatccagactatggatctgggactttggtgagtatctttcggtcactggttagtggaaacctcaaggggaaataaactcccaggcacttcacgacctttttaagcaagggccaagtagctccagtagctgagtggcagttatccaaaggaaaaaatcatgtaggcactcaataaattttgagtggctggctggcgggacaaatggataagtgacaaattatgcaacttggggttgcttaaaagacaacagggggacactgaagacttttgatgaagacagtggtacccctcaacttgataaattgagtagattagtttagaagcattgagtagaatagattaatggaaggaaagtctaaatgcaggaacagtatttaaaagaaaactgccgtggtgacgaaagcctgttctagcatggaagtagcagtatgcaaggtaagacttgccttggattcatattgcaattgaaaatttaatcattcttgatgaatgtcggcatttgtgagataaagggaaagagagaaagagtgggggttttgtgctcaagtgacaatgggattgcttacagaaaaggacaatctaaacacattgggagttgagttattacgatgggctgggggcagagctagtgttaaaagttcagctctagatgtaatgggagtcagtagggacaagcaaatatatgtatagcagacatattggaaaagtgggacttgatcttggaagacatgacagattggaaatatggatgtaagatttagcatttaagacaggagagctgaatatggaatggggagagggaacctttaaaacagaggttattgaacaaagatattgaagaagaacaggactatgacaaatgtcatttggtgatacagagaaagaagagataggaagaggtagaggagaaacaggacttaaattcacactgtattcttatcttactctaatgacgatttaagctggcataacttccatgaaaaacaacttgacaataaataccaaaaatgttttaatatttggatattatattccagcaatcctactttaatctcaacaatcctaagaaatcagccagagataatcatgttagcaacagtatcaaaatagtattctaaatgttgagcaataggagaatatttaaattattacagaaccaaagggcaaatcttacataatcattatagtctatgattttagacactatttaatgccataaaattcttttataaaatattgtttgaaaaaataggccataaaatatataagccaacattactaaaatgtattttgtttatataatgtatatgtgtgtagatatggataggtatgtacacaatctcatttagtgtgtataatttatacactgagtgttgacaattgagtcttaattgattataattgtctatttttttttttcaaatttctccaactgagcatgtcagtttttatgtttttttttgagagagggtctcattctgttgcccaggttagagtgcattggcatgatatggctaactgcagacattacctcttggactcaagtgatcctccaacctcagcctccctagtagctgggagtgtatgcgcacaccaccacacccagctaattattattattaaagatggggtttcactttgttgcccaggatggtctcaaactcctgagtcaagcaaccctcctgccttggcctcccaaagtgctgtgattacaggcatgagccaccatccctgccctgtgtgagttaggttttttgtttcttttaagtggatggtgaaaataaaatcataggagaacttctatctaatataaaagttgttagaaatgttaactttaaaataattataaataaattaaaaaaataaaaattcaattctttagttccattagccatgtttccagagctgaatagctatatgtggctggttaatactgtattgggaaatactgatttagggaatatttccatcataatagaaaattgtgttagattatgtttatgtagactaagagatctgttaggcagatttttcagaaaagaaagtaatagaaattctagaactaaatgcaatatgcaaaatagcctaaattaataattcaatggataagatgcagagagatcattacgtggaagagagggaagaagaaaccatcaataatgatgaaaagagagacaaaaaaaaatatgtgaaaagagaatagtacataattttatattagtattatgcatgaatttgtgttcacatatgtgcatatatatgtatatatacatgtatgtgtgtatatatttatatatatacatgtatgtgtgtatatgtttatatatacacatatatacatacacctcttgctgtttattctagagaaatgatgtgcctatgtgtgtctggctgtttaatcatattaatcatatataatttgtgatcactagaaacacagaaatataatgttcatcatcaaagcattaggtacatgaattgtatattcatacaaagaatcctatcaagcatccaaaatgaatgaaatacgtgactcaagaacataaacaaattgaaaaaacaaaatgtactataggtaaaatcatacaccaagactatatgctttatggttccattcatataaacttcaaaggaaattcttaagagtggtaactaaatgtaataaggaattactgccataaatatttgaaaagtgtagttagtattccttcaatggaacaaagggggctgtgactggaagagcagacagaaggattctagagggctaacagtgatggtttcatatacaagcagtggctccttggctttctttccacacgggtttctttctctttctctgatgcctcccactctgccttgccacaggggttttgcacatgctcgttcccattctgatagacttccttccttttcttttcactctcatatcccagatcagctatcacttcctcagggaacatcagccctaccagatgtggaaaagctaccttcttacataccctctgagaaggacattcattccttccatcagagtatgcttcagtttgtaacattgtaatgtctgacattattgaagtaattgcaccaaaaatgaaattggtacaactttcaccattgaccctccaatgtcttatacattgactataatggcttgttaaattaatggatgaatatggttacacaaattgaatttaaagtgtctatataacacacacatctagtaagcagcaggatatatggaccagttgttcctcagagttttctttctagagatagggagtcacgaataaataagggctagcatagctaatagtgtatttaattgctctggaagaggcaaaaaaaaaaaaaaaaaagtcaaccaaatgaaaaggcaacccagggagtgaaagaaaatatttgcaaacccgatgtctgttaaggggttaatttccaaattgtatatgaaactacaattcaatagcaaaagaaagaccaaattaaaaatgggtaaaggactggaatgacatttctctaaagaaaacataaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaacaaaacatatacaacttttctttgtcaattatatctcagtaaagccagaaaaaaataagagcaaaacatacatctcctataattcaaccttgatgccttgctccagctgtattgcacttgaccccttcccaagatctacactcccagccctctggattacatgacttttctgaaatatttcttctttttttcctcatctctatttccttatgctttatgtcattttcctgaaatgcctatctcttccttctttgcatcactgtctgtctgacaatgtgttccacagtttaaaattctgaaacaacagaaacaacaacaacaaaaccaaaatagcagctcttaacgctagaagatttttaaatattgtattacacaacaaaacttgacacaacctgaactcattcggtggcaaaatctgatgaggaaacacgggaggcaaaacgtggtgctgtccagtgctggaacaggtgtggctttaaaagggtatacatgtcacattatcattctcaaatccaaatgaatacatagaactctaaattttgcaacatagatgtccccaaatgctctgtataagattgagtatacaccttgtattgtgtcttgcgcttcataatgattgataaatattgccatatagaatgccaaaccaatgagtaattatgtggttttatgaggctctgtcaatttcaacaacagataaaatacatatctcatgtatgatggtggaagctagcccatataattatgaatattgggatatttttcaccccaagaattctccagtctagtgactaatgcctacacagagaagaaagacagtgacaatctgatgaaggatgtatgtagaataaaaatgacagaattggggtaagtgtataataaacacagagtaaagttctgtgatattataaatgataataggtagttttagagttttcaaaacaagaaaagtaatacattaaggaacatatttgcttagagaagtatgattcataccagttgcaaaaaaatagaaaaatagaaaagcaattcagatgatctcaactttattagttttctaggaaacactcagtatgtgatatagactgtagtaacagtctgaagagttaaaagaatgtaaccttagaagtaaaaaattgcagagtgaagaatccatttcctgttttctgcagacttatcttggaaaatttgaagtattcattgtgcaaagaatgtggttacattgaggttactaatgttgatgctactgaaagggtggcctttaaaattgcctcacaccttcacaggatacacctgtccatacttcaactttggaatttcaaaaaaaaaaaaaaaaaaaaaaaaaccaaaaaaccttctagaaaactagtagttctgactaacactcttccgtgccagttgtgtctctaatttaatcatagttgttggtattttccctcttgattacatgccaatttgtcttattcttgcaccctgggatctagacttggagtaaaacacacagggatccagtgttagagcaaacacttagcatgaaaagactttagaactgagagccaggctgaggcctttggtcagatcattaaagggttgcagttttatttctggaacaatgtatgtactatttatttacttagtatttccatgaaataaatatgactttttctttttatttaaatatatttatcatacttaactttaatatatcttaaaataataaattgagttactgcttcaggttatcatgtttattattaacctgtgtctccaccatcacctgcaaagctcagttaaatattcaccatctaatgagagcaaagactattcatgttaatttttaaaatttacttaaaattgtgtcttttacaattacctaaaattatttcatttcttttttaattgtgttttgaaaatatctagctgtgtaatatcaaaaaaacttttgccttttttctttttaagacagggtctctgtcacccaggctggagtgcggtgtgagagcatagctcatcgcagcgttgctcactgcagcgttgaacacttgggctcaagccatcctctgtcctcagactcgtaagagtagctgggattatggatgcatgccaccatgcatggatacgttttgtttgcttttgtagaaatggggttcactatattgcccaggttggtctcgaactcctggcctcaagtgatcctcccactttggcctgtttttgctattattgaaagttgactgaacttagtttaggtaaataatgagccaaaacaaccaaatgcagttcataaatagaagtaggctaattcatttgaaagaatagaaaagcatgtttgtgagtgggtgggtatataaataacttgaatgtaaataacagaaaatctgtttccttgaatgtagcccattggttcctgcctctctattgtgtacctgggccctgcccttcatcttgggtgtcctgcctggagaaaactgcaccatgatgccactaacttccactaactggaatccgcctttccctcctccctttctctccttcacatctctaccccaattaaatccctaaactttgctgattaaccacttaaacatccttttaattcatccatttttttcactgtgtcttttcattgctaattctctatttgaagccacctcacctttttctcacaatgtcaactataatggcctagctgatctcccagtcattccaggcttgtatctgcctaaactaccttccactctgccctgtgctgttttctaaacaacaaattttatcctgttgcttcccaatttcaaactcctcaatgacttgaaaatgccttcagtgtatagctgaacatgatataactctttttttttctgtagcctcatgtttcccttttcattgtatatttcattgtatattacagttatacttcgaattccttgaagtcagggaaattgtcttattcaaggttgtattcccagaacctaatacagtgtttgctatgtagcaggttttcaagataatttttattttaaatttcagtttgatgagtttaaatcagataaatatatgactttttggcatcctgagtctatttctattctttcattttagagtttaagtaagcttaggctactatgagagttacttgaaaactgttatccagatcctctggaggttgaaattctggtaatagaagcatctggtctgttgtcagttctaattttgctcaacccaaacaggcagatagaaatgcttactaacaaaggctgactcttgatactccaaaagtggcaaccgaacaggtgcggtggctcacgcctataaccccagcactttgggaggccaagggcggggagggtggatcaccagaggtcaggagttcgaaaccatcctggccaacatggtgaaaccccatctctactaaaaatacaaaaattagctgggcatggtggcacatgcctgtaatcccagctactcaggaggctaaggcaagagaatcgcttgaaccgaggaagcggagtttgcagtgagtcgagattgtgccattgcatgccagcctgggtgacaagagtaagactctgtctcaaaaaataaaataaaaataaaataaataaataaataaataaataaataaataaaagcaatcaactcttcatttccagaatattacaaaaaatgtttgccggtggatgagaacagatttggtactgtattttattctgtatatatttccttggactgctgcaacaaattaccacaaacttggtgacttcaaacaacagatatttattctcttgtgttctggagtctgaacatttgaaatgaaggtgtggataggattggctccttctgaaggctctgagggaaaatctaactcaggcttcttccctagtttttggtggttgccagcaatctttggtactcttgccagtggcaacctaatgccagcctctgtctccatctataaacgcatctcctccatgtgcctgtgtctgtctccaaatttccctcttcttataagaacatcagtcatattggatttcagatctttagcaatccagtgtaaattcgtcttaactttattacatttgaaaatgctctgttttcaaataaagtcacattcacagggcccaggtagaaatgaaatttggggggatacatttacttctacttttttttttttgatgaatacaaggtaaaaagagttgagtataaaaataaaattacaaaactatttttaacatgacatgagaatattattttcaatgaatcatgtttgtcaaacgatttcaacaaaaaagtgacaaaatccaaaatcgtaataaaggtttaacagctaattaaatgcaggatcctgaatcactgactgacagaattattctctcaaattagaaatatagaaatggtcaagtgtaatttaatatattttttctgatatatggtcatcctatatcagcactaggcagtctcctagttaagcctttccttaacagtaatggtaaatactaataaaatatgccttatcaaatggaattattttgtgttcatggaagtcaaacaatttgtgaataaggactctatctgacaactctggaaaaccatttttattgcttcatttagaaaaggaaatggaaatattgagttataagggaagataacagtttttttaaaaaaccaatctttacatcatgattattagaagctgtgactctcccctataatgaggcacttaaacattttaagggtattcattcacaatattgagatatcagtttgcactttttggaaggcaaaaattaaacaaagtgcaatcctggaataatttacaaagaatagcaaaagtattgtgaatggaccgaaacattcaacaaatatctatttagtactgactctgtgcaaggcactgttctatttgtgggggatagtgtgggacacagaaggataaaagtcaggctctcttgcaacttgcattgccctagtcatgctgaatattctccacctgctcttctggcttcagttctcatacttcactgagttttgagctctgggcactgactaagtactacttcactctggttgctttgaccaacaaaaggcaaagacagcagatcagaagttggaggagagatcaatctgagtgtgatttctcaggatccttccctgctgaggcatagcttggcagtgcctgatttctgctacttacttatgtgtaaggccacagaaattacacatctaattggttcaagtgtctgttccttacccttgctcctttagaccatggaaatagctttagtccatctagctttcttgtaacttgtgaaattcttgaaaactgcttacatatttataaatagccattttgttacattctctttaattatcccctttgaatatgctttctatttcctaaagaatcttaagtgatgcatggggttagaaaggaaatacaaatacatgagatatttgaaaaaaagacattttagcagatgctgtctgcagcccatccgtatcttcctggctttcaccattcttgggtatgctccctatcaacaactcttcaactgagcactctctttggctgcgacagtttgccaggcttaaagataaagtagattgggcatgctagaaacgaatgcatcccttccacttccttccccaaagcagccatcaaccaataattgtcagatggtatggaccaaattgtcagcttcttggaaccttggttggaactgctctgggtcatattcaccctatccttctgagtttcctgctgagcctaggcacctggtgcccacagcagtacgctgcttgataacaaaacttttattggcttactttcttccctcccatatttttccactccagtgttggtgagtcctaggattacctcagcaaatacacattgtagtctctcacacacatatacacacacccatacaaacactacacaaactcacattcttgtgcaatagtaagctctggaaggttctgaggagaggagagatgcacactttttaggctacaatgggcccacgctggatattgtgttgactcagagatttgaagggttgtgagggcagacacactgagactcttttagggaagttagttcatctataacactagtagaccattgcaagaatctagaggaaagatgataagggattgcatctttgccatgatgctatgatgagattgctttttagatcatctgatcaatatttattaaaatgtattatgtatcagtttgtatactagaaattagcaagaaggatactgtcctcattttagaggtaacgacattgagattaggaaagtaaagtaaaatatgcaaaatctcagacacacagtccaaatctgcccagagctttaccctgtccaccacggtcaggaaggttgccacactctagactgagtagagaggtaaaggcagaagacagcctgcagtgaaccagcagagaaaactacatagttttctctacataggaagtagaaataatgaaatcaggaaatttggcagaaaaaaaatacagggtaactaaaaggcataaggtagcttttttgttttgttttcttattttcctctttaacctgagagaaacctattcttctttacatgcctagcaaaaagaagcattggagaagacacttgatgtcacattaatgaaagggaataatggattaaggaaagcttggtagcaaaaagaagttaaaatatatctgagaaaagtattttaaaccataaataacttgtaagtatctgcaaatatatgtttattataaaatattcaaataagagaaatgtatagaaaaaaaccctatgcccacatttaccccatttcctataaccctcaatattattgctatctttaatgtaaccacactttagtatgtacctcttcaaatatttgggtgtatgcatatgtgttcacatttttgcataaagtgggtcacaaaaatgcaatatttttgcaatttgcttttttttacataatgtatccttgacgttcttccatatcagtac

SEQ ID NO: 2589 - DNA, 901 bp, Homo sapiens
aaataacataaattgtcttagctaacactgaacaaatatcgattatgtgctggcacattatctgatttaattctcttaacatctccttgagacaggtctattgtgcagatgaggaaactgaagccctatcgcaaggtgatggctctgttgaattctagagactgcaaagatgaagaaactaagaaactgtggcacaaattattaactatactgcccaaggtcatacactggaaatgggtggtgaaggaggtcagcaggagggcactaaggatgaagacaagctgtcagatgaagacaagctgtcattcaaacacagtgacagaaggagcagtgcctccttctgctcaagtgtgtctctacttttctgcatgttgcttccagacaaaagcttgaatttcctagactttatctcaaggtgtacaacacccttcctcccacttcagtcccatgctggtggctgctcctgctacctcttttgcatggagcagagttctcaagattcgtcctcccaaggtcaacttcttgtttcttgttttcctaacaaacaggaggccaagtgtggaaagtacttgtgttaaggttgcatttcccaccagagaaggaacatggctaaaaagcattaattccatttgattctttctttacagaaatccatttggtctttttcagctttgagaacttaaaaactgtttccctgcatcacttttccgaatctaacagagacttcaagcatggtttaagggcagagatggcgctgtgtgtttgattgttaaagtgaaaatgcagactgtgaggaaaatcaagactcccagagcatttaaaatggaatgacaggtaatattccaacattgccacaaggttcgagggtgacacatctcacacatgtacgtgaacaaccaat

SEQ ID NO: 2590 - DNA, 3746 bp, Homo sapiens
ctgggtgccagtggagatgctgcctactgcagtgtggagaatggattggaggggtcagaatgaatgtagagagaattcaaaggctcctgcaggagtccaagcaagaggattgcagattgtagcctggaagaggccagtagctgtggtgacaatggacaccaggtggatatgttggagagacacttagaagggtctcactctgtcacccagactggagtacactggtgtgatctcggctcactgcaacctccgcctcccaggctcaagtgattctcctgcctcagcctctcgagtagctggaattacaagcatgtgccactaccaccctgctaatttttgtatttttagtagagatgcggtttcaccatgttggccaggctggccttgaactcatgaccttaaatgatccacccgcctcagcctcccaagtgctgggattttaggtgtgagccactcgcctggcagaaagactgtcttctgaaaaggacttttgggagtgaaataacatcagctctaagtgactcatgtgcctatatccacctggttggtggtgaagaggagttgaaaggaatgaaggattctaggacagaaggttcctattgagaagacactttcggctataaccactgttacgtgtgtgtaatttattcaacactactgtgtatataacggacaaacaaatcatatttaaaacatcatctagtctttttagatgtttagaagtgcacaaagtatgttaaaagtagaggtaaataacacattttgtagatatccttttgatgtgaaatattgtcttttggaaattgagcaaaccaattccctgagccgtacacattattatatctgtgtcagtttggggaggaaggaggagcagaaagtacaaagggcttttcaccagtgtgtttatggtgaggcacattgactattatctttttttttttttttttgagacgacgtctcgctctgtcaccaagctggggtgcagtggcgcaatcttggctctctgcaacctctgcctcctgtattcaagcgattctcctgcctcagcctccagagtacctgggactacaggtgtgcaccaccacacccagctaatttttgtatttttagtagagaaggagtttcaccatgtttgccaggatggtcttgatctaagtctgcattttctttgtgctgtgtagatagcgtacataagaggacaaaccaatcctaatctatatcatctagtctttgtagatgttagagaggtccagtgcgtgacaaaagtagatttagtgaattaaaacactgagtacgttttgtgttaaaattcatagggaagactgttgttaaaaacatagaagtgggcagggcacggtggctcacgcctgtaatcccagcactttgggaggctgaggtgggcagatcacttgtggtcaggagttcaagaccagcctgaccaatatgatgaaatcctgtgtctactaaaaatacaaaaattagctgggcatggcagcgggcacctgtaatcccaggtacttgggaggctgaggcaggagaattgcttgaaccctggaggcagaggttgttagaatcctttctacacaatacatttggcttatagctgtccacagggtggacagaggttggaacgggaagggttctaggccaaaatgttcaggggaggggtgctaggccagaatgttcgtatttagaagacactttcaaattacagtctatgttatgtatatgcaccatttattcaatgctactatgtatatagtggaaaacctaagtcctctttgaaacatctagtctttctaaatgtttaaaagtgcacaacataggttagaagtagagggctaaagtgacaccctttaagcattttctttattactttttaggagtgtttgcatttggaaatggaatggttaaacttgatgctttggactgttcatagggtgatggtgggtgtaggaggaggaagtatgcaaagggaagggttctgtgcccaagagttagattagttcacatgatctaaccattgttctatatgcattttagttaatagtgttttgttttttatttttgatggagttttgctcttgttgcccaggttggagtgcaatggtgtgatctaggctcactgcaacctctgcctcctgggttcaagtggttctcctgcctcagcctcctgagtagctaggattataggcacacaccaccacacctggctaatttttttggtaatttttagtagattcggtgtttcaccatgttggccgggcttgtcttgaactcctgacctcaggtgatccacccacctcagcctcccaaagtgctgggattacaggtgtgagccaccgcacctggccaatagtgggtattaaaagataaacaagtcttaatgctcaaagtatgttaaaaatagatgtagtaaaacaatccgtctacaaatgttcttttgttatattttaggaggcctgtcttctgggagtgacctttgttattccacctcttggagctaggcatagtcctatacctagtcactgggatggtggaagagggagaaaaggaaggatgaaggaaagagctatttgctagtatctccacatctagaagatggttttagatgataaccataggtctacatgagcatttttagtaaagtgcttgtgtgtaattctggacaaagtttattattttgcactatctaagctttatgaatgtcctggggtgataatgtgtgataaaaagtagaactagtgaattagccaatttgtaaattttttcttgttataatttatagaaaagatgcaacttggacatggaactgttaaaccatctctgagctttgtatgccaggacttgttcattaggttggcagcagagcagcaaaaggaagtataaagagagagatgtatgcagatgtgtcgatatttacattttgatgatagccattgttgtatgtgcatctcttttagctgtactataggaatacattaggtatttcaatgaaaacataccttgctaatatttgaatagtatagatctgctaatggattctcttagaaacattatacttagtgtattctattgctgtatatttcattttaaagtgagcactaaaggaatgcggtattttaataaaaactctgccaacgcttttacttagaggcgtgttgccaatttttgtcttttatgaaaatttggcccaagaaaggcaggattacattgtttttccaacagattgagtgggtgtagtgtattcttgatgatcaaaatactcatatagctttgagattttgaattggtaaatactcaagatgtgtgaaaaagcatgatacatactatatgatctcagtcccataaaattgactattgtatctacacccacacaggacctagaaggacatgttaaactgtaaactgcttgtgattgtggatgacctttttcgttgcttcttgtgtttttcagtttcctataatgcacatagtaacttaaaaaaataaagattatttttgaaacctaaaaaaaagaggttacagaattgaatactccctgagataaggtaaaatcatcttatgctaacggttgcaagataatggtataagtaagctttcgtcgtacatatcaatgaactttaagatttggaagacaaaattcagtttatgtattcaattaaatgtgctcagattgtattgtgctagataggcacattattctaacataatatgaatgaatcaataaaatccttataatactg

SEQ ID NO: 2591 - DNA, 2218 bp, Homo sapiens
ggatggtctcgatctcctgacctcatgatccacccgcctcggcctcccaaaggatgaatcctttttctgacagtagcttgcctgctttgtggatcgttggtgacacatattaaatccctggccagctaccctctgccactgtagcacactctctgagccacctctctctaatggagggtaaactatgctcataagacactgactctttttttattaactttttttttttgcattgactcttttaaatggtcacactaaactaagaagataaacaccatttctaaagacattctaaaattcacaaaaagagatgatttttttcagagagaatatttttctggattagccactacagttgaccttactgagctgagggcatcagcagatttcatgtgctcaatgaatggagtgttcattcagtgccagtgtggtcagggaacggttacacccagagtggagaacatgaatgggctattactctgagcaaatgtgatatgtttcctgtgggggtttcttctgttgcctgtggaccctccatttgcctcaaatacattttcaatttatttagcacccactgtgttctagccaccatggagggagataaaagatgacaagatttggtctctacatgaaggagcagacagtttgagtggggagagaagcatggaaaccatggaaagtttaatgatattgaaggagttacatcacaatacctgagggcgggtcatcacaagagatgttacaggacagagaagactcattgccaaatgagcgacactaacaagagtgatgctctcagaggaaggacagactgagtggactgcaaggataggggagacttctggaagaggtggatggtgtggcagacccttgacactcattccccttcagcaggcttggaatgtggggatgactatccccattttcacatatggcaaaggcccaagccacacagctggtgaagtctggagcaggacttctgaggctttctatcctccatgctgctcactagaaaaggggctgtgaactgtaagtaactttgattggcgttttccatgctgactcaataaggttaggggttaaagaccagccctgaacctgatctttaacagccatgcattgtgcaagagaaacactcaacaaagagctagtcagaatgtaatatacagtggagctctaattagattatgtctgaatgtgacaaagaggccctgtaatatgacatcgtatttaattagactatattgattgtgcattaaggtggacttgatgtgttacatgtgtcatgagtgccggagaaggaagctcttgagtctgcaaggccgacccagaccccagccactatcgcctgtgggctaagcctggaaggcaatgagaggaggaagtggcaacatcagtcctcaaactcggccaagtttatagcctgcacttgcttttacatctggttatttctggggaggcatgagggaggaaaaaggaaatgctgctgaccgcttcccttccatcagcccagtaatagcttgacctcttaggcttatttgctcatattggttctccccacttggcaaaagtctacccacctgtgggacccggcctaagtccagcctcctctgcagagccttcctaggtaacgccagctggaagcgatctcttccccttctgaaattccgcagcattcacacacgctgcccctgcctgtgtcccctgcctctgtccccacctctggctgtcacataaccataaccctctccagcaaggctgtgagctcctggggggtaaagtctgggattcctacttctcagtctgcccactgcacactcagcctagtcgctctttagtaagtgttacctggatgactgagttgccctgggcaggcatagtttccccacgctgcttatggggctacctgaggctgagctgttgctgccgcgactttgatagtacgttggcttccaaccagtccatggaattataaatgattaaccgttatcagcgcacatcttcacctctgtgtaaaaatagattgactgtaatgagtatttgaataaatcataagaatggccgccctgcgatcggctaacatcctgccgatggctgcccggtgagtgagcagggcgccggccctcccgcctaatggcctgcgattcagcgccggtcgcctctgtgattgacgggcctgggctcccagggcacctcctctgcagccctgctcaggagc

SEQ ID NO: 2592 - DNA, 59352 bp, Homo sapiens
caggatcaagggctcaagcaaagtttaacattgtcattataatatttctagggctggaaagaattttagagtctagtttcaccctctcattttaccggtgaagcaactgaggccctgacagagttttccaccaaatctgtcgaattggctaaaggcacagagaagaaactgcacaagggatgctaagacttagaactattctagtcttcatgaatgtatatgcacagggttatggggaggtcgaaacgagatcattttgaagattctttggaaagttaaaagcaagacttaaaataagcagaacatctaaaatggacattcattctctctctcagcaccccgaccttgttcttccagatcttctaacaacctgcatttacctgctgtgttgacttatcatctgcctctctgcactacaatacaagctctatgggagtaggggttttggttttctagtttgttactaatggattgttaatatgcagaatagttcttacaggccaggtactcaacaaatatttattgaaaaatcaataagcccagggagtcatgagccctagtaataaagaaatctttaaaatatcagctttttggtagacttctgcaatcacccagcaattatctatggggagcttcagagttctcggcattctctctggatctggggtttgagtggtaaaggaaacggaccacgccctgctgatcttcctgtggggaagcccagcagcaactggaaactgatagagaagtaaaatatcagacagtgacccaaacagtgcagggaattcaaggagggagtatcacatcttagattggaggtcagggtagaagaatgacccaaacagcgaagagaattcaaggagggaggaccacatcttacattggaggtcagagtagaagaatgacccagaaagtgaagagaattcaaggagggagtaccatgtcttagattggaggccaaagtagaagaactctctgggtctaacatttaagcagatgttgaaatgatgagaagacagccaagtaaaccaacaaggaaagcattccagggggcagcccagaagaatcagcttcttgcaatgtacatttatatagtgccttgtctatttctaagtgccttgctgtcatcaccaccacgagagccctaaggattaggggttttgttatcacaatgtctggtttattagaagggcctctaaagtttgcctctagtttggaaaaccactgtttctatttatctgaatagagaagagaaaagctaaccttgggaccagttgttttaatttgcaggaaaacctagatttctaatgaataacaatgaatgagagagaattgatacaggcagatctgagatatccatatctgtctctgcagtacatggttaggaaatgctacatatgatttgtatttactgtgctgatgttgagagaggaacacctgggtgagatccagtaggttctaaataaatctagcttgatgatatctctttgagttataagtatatgttctatctgtagagaaagaaagggagaagctacattgattttaatggaaatgtcaggaagaggttgaatgagttgaaacataaatgagacagtcattacaaaatattcaaatgaaattttgggataataagaatgctcatttaaaaagcccgttcgattagtgtcaagctagaacagaaaaacacatttaaaaggctgtactttagtttgtgtctgtgtatttgccacacataagcttagacactttaataagacacttataaacattgaaatatatgagttgatatggtgaaacataattccagaattcttgagtataataggtctggagcatgatttataagttattttgcaatgatgtgtctgaggtcatggtggccgcacctgtagtctcagctacttgggaaggtgaggtgtcaggatcctttgagcccaggagttccaggttacagtgagctgtgatgcgccactgcactgcagcctgggcaacagagtgagaccccatctttaaagaaaaaaaaaagaagaatctgagacattgtaagaaaaattccttcatctcctcatcaagtgtttattgggtgcctgctgtgtgcccagccatatgctagaggctggggatataggaataaaagctaccagccatgccctaggtcagtgcctagttctgggtcagcaaatagcatccaacttgttcagtgctattctatcattaaaacataagctggagttctatttgtttgcacattttacaaaaataatgtgtaaatagatgattctataaaaatgtccaaacaatgctgttaggtagacatcactctacacacttgttttgtgggtgacattgcctcactaaggagcagctccagcagccaaccagaatcaaagctgtcctctttcatggggctctgggcttacccaggaaagaacaaaataaattgacacaatgtaggctaatcatgatattgaaaacagaaaggacttgggagcctcctgaaataaattgttaaaaattacataaacctatttatggttggatttataataagtgcctgtgtgtttgttttcttgacagctctgtcaaccaggctggagtgcagtggtgcaatcatggctcactgcagcctccccatcctgggctcaatcgatcctcccactgcagcttcctgagcgggtagaactacaggcatgcaccaccactcctggctaattttttttcctttggtatttttttgtagagacagggtttaaccacattgcccaggctggcctccaactcctggactcaagcaatccacctacctcggcctctcaaagttctgggattacaggcgtgagccaccgcgcctggcctgtgctggtggttgtaagagcataagctattgttctttccatccttctctttttcagtttttcttctgtttttgcatagttaggcccttgtgaagtttggctgacatttgttgtatgcttttaattcccctcaaaaaagaattttctacattttacaaagaactaagaaaaaacccaaagaaagcactttgtcctggggatctgtggtctcgttgcctgcagcctgtttcctgcggcctgtttcagcgagctctgttgcttgttaaagccttaaataaagtcaatattttgtgatgagaccattttagaggacatgcttgcatatctgtgatgtgcccatggactcccaacagatgctgctattttcgtaatgacattttctagcagcagagatgaaacaaatattgaggcgttgagctcctttctttgttatatcagattagaatgtaatgccaattgcatccagcttcaaacaaactcaaggaataaaaatctagacttccaaaacagatgcacgaggtttgaataaagattcatctgagggtctgcacttgctttcccctccttacgtattgttcgttgaagtgattttttaaaacccaggtctgaccctatcatctctgatgcttacaatctttccaaggcttccctttacctatggacaaggcattttaacatgatagaaaatgtcctttcagcccattcccaactcagcaggccgctggcatgcacacacgcgcacctccaagtgtgtgtcccatgctcatgtggctatgctgtctcgtagtctccaagtcactgagggtcccattgctggggctaggtgtggtgtgcatggttctttccaaggagatggagggatgccagccctttgcctggtgaggtttgggacgaggtcttgccgtaaccagatgctatgctgcaatgccaggtgtgggcgctggaagtctgtgtaaccccttagtgtcctttcccaccccttccccacccctttaggctagaatgtaatgccttaatattcacactgtggtccaagtgccagcaatgccagcctcacctgggagctccttagcaatgcatcacactaggtcctaccctggacttactgtgtcagaaactctagggtggatccagctgttgcgtttgaacctctgggtgattctgatgtacatttgagtttgctgtaggtgaacacagcctggctcttctaggtcccactgacgtattgaagcagaatgtgcatgttaacaggaacccatgatttctgtgctcagcaccgttcagaacctgcttccttgattgcacatattacattcctactgagctcttctaggtaggtgggcagctaggaggagcagtatagacagaggccttgcttttaaaaagcctgcattccagatggagggtggcatgacaataagaaggggggaaaagcaggtaaaacagtggcagagtaatggctctgaatcaaaggaaacagccaggtgggaggacaggggagagagagagagacaagagacagagaggaaggtagagaggcagagagagggaagtagagagagagaggagggacaaggtaaagacagcatggccagtgaggcctctctctaggaggagctagcctgtgctcacctgggaccatgttgcacagagggtgttgtgagatgactgggctcactgcgcagtttctgactcagtaggtctggggtgaggcctcagcgtgttgcgttgtcgacaggctcccaggaggtgttgctgctgctggtttgagaaccctagatctaggagaccattccagaaacatggcacatgtatttagaccttgggctttggggcaggcgtgggtgggacaggctgttcagcacagcctgggggcagaggaaggtgggacgttgggggccaagtctggcaggtcagcaggtgccttgtgggctgtgggattttgttctcttggcccaagagagctagtggtgggttgtggcaggggagagatgtggggcctgatttgcatttgtaaaaatgcaaattatattgctttgattttctattcaaggacagattgggaggcagaggtagaagcaagggaggttaagaggctacggtggtggtcagtcccttccagagatgacggtggcttggatccccatgacagtggcagagagtagagaaaggtgggcagatttgaggtacatggtgcaggtggagcagacggcacttgctactggatgcttgggggtgggagaggggaagagaggaaccaagggtgcctctcagcacagcacttgggtggaggtgaagccattcactggaatgggaagctggggttggagcagtgggaggtggggcgggaaacccagtgttctcttttagacatgtcatggtgtatgtgaggatgagacatcccagtggcaacatggagctggcatttgtgcctgtgagtctgaaattcagggaagtagccagggatgaggattttattttggaaggcatcatcaagaggtgccatttgattgaagttagcaaattggttcagccatccaagggactccacactccccagcacaccacgattcccagcctccttctaagactctcccgagcccagcctgggtctggctgcttcccccgaagcagggctggcttgctgctctttcccacagcacagccacagctagcagcctgctggacagaagaaatcctctaaacccagctcctttctactgggggctctgctgaccttcagtgccagccaccacttcactcaagccctcccacacttgcctcagtggggtttccaccagttgggtctttgcacacgtggctacttcagcctcatgccctgaccgtatgggggtgctccactgagccaggatctgcccccacgccgtcctgctcacctccatgatgcggagctgttttatcagctggttactgtgtgtagtccaggtcctcagaacttggaataggatgggcctttttcatttaaaaaatatgctctccaaacacaattttcggataagctctttcaactttattttctttttctttttccttttttatatgactagaggcatgtgcaggtctttaaagaatcgctgtgtgactgtgattgattctttggtctgaacatgacagccttctggtcaatctagctgctgttgagtcacaccaagactgaggagctgcatgttccactcgctgactgtctttggcaagccaacgtgaagtcttggaattaaataactatccattctgtgcctaaatactcatttgtagaatccatgctcctgcctttcctaagaagcacctttgatttgcttttacattctcatttttttttcctgtttcataagctcagttcaattcatcataatcagctgtaggcagctccaaatttaaataatgtcacctgggtgagtcatacctaagggaacacttagttggtcaatacatggtctctgcacaatctaaattaaagtcaactctgaggttgacttgaacagagtgaattcagccagtgcttcaggtttaaaagaccaagctgctcttggttgtttgtacatgataaactaggttgtcttagttcacagacgaatcccaaagaacgtcagtgtcttttggaagtagcagatgttgggactgagaaacactaagcactatcaaaggactaaatgccccagcaaactgaaaatcctgatactctttgcaaagtgcctcagtaattatggtctggaatacctggtgtgttgggggaggtttatttatcttaccttaatcaaggaccatatggtactaagtcaggaagcagcagtgggaccttgactattcctaggccaaatatggtaaaattactaattgccttgcacaggattaataaagtgctattatttgtgttgaattttattgaaacataagttagagtttatagagaccgtcataaaatagatatgatcttttctgttcctgatccttttccaaaagatattactttcctcctctttcagggcccaggaacaaagaattgatttcctttcctcatttaattaatatttgttgggtgattgctatgcaagaggtactgttgtacaccttgaggatacaaatgtgagcaacatcatggcctctgttgacataaggctgagaatgtggcagtggaaattgatatgtattaatgttgtgtaattaggagcggtccatcttacatggaggtgaggcctgaggttctggagccatgctagctcctcgaagctgaatctttgaaaagagagtaatcaagaatgaggacagagatactggtgagttgggaagagctcagatgttcctaaatatgtcaagctcggatggtatcttctaggcaatggctagccatccaaagattttaaacagaggtgtaagactcatcagattttacttctgaaagatcattctgggattaaggtgaaagatagatttgaaaggtgctgcacacacccagaagagagatagggagatttcacagggaggtgacggtgggagtgataaagaaaggatggagtcattggtgagaagtaggtgaaacagaaagaccccaggagacagagatgtggtgggacagtgagacataggtgtggtgggatggtgagatgtaggtgtgttgggatggtgagatgtagctgtggtgagatggggagatgtaggtgtggtgggatagtgaaatgttgtggtgggatggtgggatgtagtgtggtgggatggtgagacgcaggtgtggaggcctcagaacatctagcctttggacaggtgagttggaactttagcaggagttggggaaggagacacagtctgagaaagcagctctgtggaactgattcttcatctgcagaagtggatagtctcttcctgcaagcatttagaggagggaggagaagcaatcactaagccagagggatgtggagaaagcacaaatgacactgaggagaaagagacaccagaggagaaagtacgacagtgtctttaccaatacttagtaatgaccttcctttttgttaatttatttaattctcaaagtttcccctatcaacagggaaggaaacaggatgacagtgtgtgtcagatattctctgaaatggccacaatcaatcaacaccttccatttttggaagctgaggctgggtcttctcaggcagggcagactgttgaatctgggctatcatctccaccacattgactattagaatatagtggaggaggccgggtgtggtggctcatgcctgtaattccagcactttgggaggccgaggcgggcagaccacgaggtcaggagatcgagaccatcctggctaacacggtgaaaccccatctctactaaaaatacaaaaaattagccgggcatggtggtgggcgcctgtagtcccagctacttgggaggctgaggcaggagaatggcgtgaacctgggaggcggagcttgcagtgagcccagattgcaccactgcactccagcctgtgggagagagcgagattcctctcaaaacaaacaaacaaacaaacaaacaaaaaagaatatagtggaggtgatgtcaggtgcctcctgagactaggtcataagaggccctgcagtacctctctcttagagtagagctctatactgggggcaccatgccacgtggagaaactacatggagacccaggtggaagtgccccagtgacaaccagtaagctctcagggacatctttgcagaaccagcctgagtcatttggctcctgggtccttgttcttcctgttctgagatgcctcatgcatactgtggaggtacggatgcattcttgcgcaaacagtattcatgctcttataaaaatatgtacttatgcaaatggcacatttgccatgcacaagtgtttccctaaatatttagagcaaaaattattgcatggatagagcctgaaagtcttaaaaaaatctttcagaatttatcttttttcatttgtgagttggaaaaaaagagcccttaagactcccatactgatccagtttgcttattaagtgtattggtttactggggctgtcataacaaagtaccataaactgcatagcttaaaccacagaagcgtattgcctcccagtgctggaggctggatgccagcaatcaaggtgtgggtagggttgggtccttctgaggctccggggctgactctgttccatgcgtctcctgtttaggctaatgagcagcacacattagctgctggtggtttgctgaacatctttgatgttccttggcttgtagaggtctagtgccctgatctctgtcttcatcttcacatgggcttcttcccatgagtgtagctgtgtttgagttgccctttttataaggacactggtcatactggattagggctcaccttagtgactttgtcttaatttaattatatctattccaaatgaggtcacatgctgaggtcctgggggttaggattcaacataaagatttgtggggacacaacccaacccataacaaatagtatttattaagtgtttattcagcacacctctgcaaagttctagcacattgaacagaagtaccaacaagtaatcatagtcaatttttgtaagacagataggagcaaagtgccctggggaaagaagcaagtaataccctctgcctgggagaaccaaggagggcttccaggaggaggaatttatagtgtgtacagagagcgggcttataaaaaagtagaaatcaccccatgcaagagccaggagcagacgggccttggtgaagggtgtgctagagtctggagggctgtccagttcatgttttagccagaggatagcattccaacttgaatttctgagaaaaaatgctgggtacttgtgtgcatttcttcttttcttttctttctttttttcttcttttttttttttttttttttttttgagatagagtcccgctctgtcacccaggctgaagtgcaatgatgcaatcttggctcactgcaacctcccccttgtaggttcaagcaattctcctgcctcagcctcacaagtagctgggattacaggtgcatgcctggataatttttgtatttttagtagagatgggattttgccatgttggccaggctggcctcgaactcctggcctcaactgatccacctgcctcagcctcccaaagtattgggattacaaacatagccaccatacttggcctgttttttcttttcttgtttttatatcatgtcctttattattattttggtttaggtgcctctacatatatatgtctgcattttacccttatgataaactacacttgatttactttgccatgcacagggctgatttttactccctctattatgttgggcactgaagaacaaggagcaggctcctgggcagggctggccctgtaggaacgggcgtccacccactccaggtgtgttcctgtacgcctcacactcctgccatctcgaaggtccttggcgtggggtcgcagcactgctctcagctcaccttcattattggcattaactgtactgtcacggggcatgatgggtccctggacttaatccccacaacagccccgggagcaaggcatggggcctatctccattttactgaggaggaaaccgtatctcagaaagagaagcctgagaagtaccacacagaggccctgagaacacccccttcggctgtctttgcttggagaggaagctgaggctctgcagggcaaagggacttgccgaggtaccaggagacccagtggccaaatcaagcccaggcccatgccctgtctcattgtcctgggctgcttctaggttaccatttcaagcttcctgccattctacatgacttaccataatgatagagggaaataaacagcattttagtctcaagggtttttttttttttaattttggttttgttttctttaaagagttcagtgcatcttatagctgagagtgatttgcctgttaagtatgcaaagtgaataaacatctttgtgtactgatgcatcagatcttggagttggaagggcacttcctggtgctaacccacccctggcactctcagaaggcaggtgctcagtgtccatgtactgccatgcccgaagcttggggccacaccatgggacgcacatgctgttcttgttcttgttccaggagcaaaggaagcttccaaggctctgcagaggggtggtagcacctacccttggacagtttccctcctccctcctttcctcactcagtagctcgccttctttcatgtgcaagtcccttgcagctcttgtaggtgtgtcctttctaacactcacggcagcgtgcaacccttgagtacagccttgtgattggttttaagtgtttgtctccctaactcactgggatgaagccatgcatatattgtttcccactggaatctcatggcttagtgcagcctctgacacacactggggctgcatagctatttgcagaatgcatgaatccagcgcctggtctcagccaccaaactctaccgctttctgcactaggtgggtgcagggcagttgtgggctggtaagtagtaaatacccacaacctggccttccttctgtgtgggtgggaggactggttcccatgcatctgctccaggctagtctcactccagcatgcacactgctgatgtgtgcagcttgttagcctaaacaaatgtgttgaggattctccaggtccaagcataaaagtcactaattgtttctctaacaaaaacccaaactagcggctggtgggccagtccaggcccagggttttgtgctgccaacttcattcttttgggttttcatggaaagagatgctggcttggcaaaaacatggtatactaaaattttttaagtgggaaagattgctgagccctgaccttgacaatgttcttggcaaagaggacatgagaagctgctggcagtcagttctccttttggtggggacacgctttgcagttccaggctgcactgtgtcaccactcctgcttccaaaagctggtgacaagcagatatatacaatctattcagccggctcttttggcaaactttgttttctccttggtggctactggctcgtttttatggttaattattggctttctttttctttctttccttttcatttttttctaacagactccaagactcaaacatttggaagctatccggatgtctctggcccctctcctcctcattctctcccagccaatgcttcttccttcctccagtctcacccccaggagttcatcagcctctgctgcagattctgtggcaatgcagaagaattttgttccgagcgaacttgtctgaaggcttgaaatggctttcttaaattgagtcactttttattctcataagaggttaattttctttacacatgaaatcgatgtagcttgctctagtgttgcatattgaatcttctctcttctttccccagtggacccataggggacccaaagggacccatagactcccagagacctggaggatgcaggtatcatgtggtcattgccacagaaccatgatgtgttaggaagatggcagaagactgtggaagatgtgcatttttttaaataacaaggacaggaaactcagggaatatctggataaagcagggattggcctgggatgttccagatgaagacagggctgcaggcttgccaaaggacccccccgtggggatggtggtcctttggatcaagttgtggtccaggtacaagaggcacatcatcaggattctccccacagtggaggcctccaggagaccagagagaggttcttcttttgacttacatcaccatcttaaaaaacagcactattacccaaaggacaaattagcagagaagaggaatgagttgtgcacattggcactgtgtcaacttggaacgaaggggagcacggatattgttcacaatataccccaaaccaaatcgtcattaaaaacaaaagccatggccgggcatggtggctcacgcctgtaatcccagcactttgggaggccaaggcaggcagatcacaaggtcaggagatcgagaccatcctggctaacacggtgaaaccccgtctctactaaaaaaaatacaaaaaattagatgggtgtggtggcaggtgcctgtagtcccagctacttgggaggctgaggcaggagaatggtgtgaacccgggaggtggagcttgcaatgagaccagacgagatcaagccgctgcactccagcctaggccacagagcgagactccttctcaaaaaaaaagaaaaaaaaaagcaccaaaagaaaaaaagccatgtaatcagtcaaataagatgtcattactttggggatttatatatatttaatcctaagctaactaacgcagaaacagaaaagtgctgcatgttctaactgggtgctcatggacgtaaagctgtcaacaacagatactggggattcctacagcagggaaggagggagggggaatgcattgaaacactaactattgggtactttgctcagtacctgggtgacaggatctatactcccaaacttcagcatcatgccatatacccatgtaacaaacctgcacatgtacccccagaatctaaaataaatgttgaaattatgtaataataatcatttaaatgttagcccatgagatggtgaaatattgttaccaagacaactttgacaaagtgggagtgcactgaccagaagcagatcatgcgatggtgaggatataggctgcctcccttccaatttcagaaggaaacacggacgtgggaccagctgcactcaggccagcagggtacttgtccttcttacaaccacacatattgtgaatttgtatagcagttaacattgctgaagccctctcaggaatatatgtcatggtcctttgaactgataggcgtggtgtttaaccatgtctgtagcacctataaacttgatactttaacatctgcctctgtgatgatacccgacgccttgttctggacagcctgagtcaccttgtcttggcctcccgcctccctcatcaccaccctccacatcaagaggagtccttctcctgaagtgtgcttttcaaaggcaaaccacctaatccagagtctgcacccccaaccacctcccttatctggctctcacactctgaaccaccatccccctgccgttatcaccataccagataccagatagcccctggaattatttaaactagcccatcctgagcttgtttgccctacctcccgttgcttcccttggaaaccataataaaggctcttgcccacagtgacctcttccaccgccttctcagcgaccctggggagtccccatgtggccctgtggtgtgatgcacgttccctctcttgggatctgtgagtttaatgcacaatcttttcaatggtagttgtcccctgatctgttggcttcaccacacctgaaaaaaataatgaaacctatcaaaatacaggctatgaggcagaggatctgatgcctgcaagatgagagaccctgacagttttttctagctcctagccctaagcttctcccctgcatgatattctagtgagatatggggtggaatgacagaaagaaatccagcttgggttgtatgtatgtacctttgacattgcatgggagctctttgcctacctgtcttgcttgggcatttccagtccttcctctgggcattctcaatagcagtggaatttttaattgggaaaatggggattacttcattgggaaatgaagtaatatgacatattatttaaaaaaaagccacattacttcatttcccaattataaatagacccttcaccatggatctgccatttgcaacttccatgacattgcaagtgtttgagttcaaattcattttctgcaaaccacgaccatgtttgtctgttgcacagctgtattcccaggcttagcatatctggcgcagttagtgcaggctagatatcagttaactgaatgaataaataaaccacccaactactaaatcaggttgtctcaaactcatccaaaagtttatatgggttgagtgtaacaaacttcatgggtttctgtggtaggctgaataatcattcctcctaaaagatatccacattcaaattcctggaatctgtgtgtattaccttatatggcagaaagggtctttgcagatgtgattaagaatcttgagatggggagattatcctagattatttgggggaccctaaatccaatcacaagcatctgtgagagatgcagagggagatgacatgcacggaggcaaaggaggcagcgtgagcaggagccagagattggagtgttgtgtccaccactatggaagcttgacaaggaatttttctgcagagcccccagagggagtatggtcctgatgacatctgggttttgggtttctggcctcaaaaactatgagaataaatgtctgttgttttaagctcctacctgtgtcataatttgttatatgtgactcaggaaactgaaagtttccgagggaaattgatgggtatttctctctggagaattctaaaaagagagactccctggtcatgtcctgtagtggccggatagtagaaactagatttggtggtctgttggtgttcctttccaataattcttcttggattctttgagaagtgtgatgacttggcttcattttctgtcctcatgtaagtgacttaggtaaggttagatgagaagaagagcacaggtgtgtttaggtcgacctacaccccccagataattaggatacttcaactcctgttgttcttagtccattcttgtacttgccagtccatgttacttagaaaaaagcgaagggagtctttgaggtttatgttctaccattacacagggattgcatttctttctctatcgagttaggactggaaaagatacttcaagagaatttttgaattcaataggatgacctttgaaggtaaagaatatgtaaagtggatttctaatgaaatcttattcaatcccggtgaagatattaacattttgttttgtgtagtattttcctgctttattttttgtcagttaatttattaagaggccactgacacttttttcattttatttttttaaatctacccaaacaaggtgatcagaagcttctaaaatcttaataaacacctgattcttaaatgtgaaatgaacttagagaaaggatatagcatacatcatctaattatttaggtatgaaatgttagaattttgggggttagagtctcagatatgtccaaatcatgtcctgtcctttcttgtctcctaggtaactgctagagcacatttgagattttttttcctgaaaaataaatgtcttatataagaagctggcagttaagaaggcggaacatatatgttttttttttccattttaaacaatacaatttggccatagattatatagaacataaaaattgacagagaaatatagcttcaagagatataatgtcagtatgcaatattttagtgaaagttactaacatcattttgattcattgcatttctcttaatataaaattttatagagcctgcttttccacaacatccctgttagcagggatctgtgttggtctcattgtagactttagtctatattcagtgtccaggctctgtccagtattgcaaaggcaacatatctagcaagggttcatcatcctctacctagagaagctctcacagagggcagtgagttttctcctgataacaaaggccaaaatgccttttctctcttaatgtaagattcatctttaatcctgcggcatacaagccacttttgtgcccagtcagccagtgtctgaaatgtctccaatctgaatccagtttactttttttcttctagttggctccagtgggagtttgcaatttcacttgctttttgttttacctttctggagttccctagggaagttagtctatactatacaaactttagtagatggccaatacatgcatgtatcttctctaccaataatattgatttctttaataacattcctaccagtgttattggtagaaacattattagtggaaagaatgatatcaattgagagtggctcctaggcttctggctaagaagcctggtgagtggttttagtatttattggggaagatggtgatttagtgttttttttttcaatggatttgattttctagagcagttttaggttcatagcaatattgagcataagatatggaattttcccgtatatctctagtttctgcacatgcctcaccttccctcaacataccccaccagactagtgcatttgttacgatccatgaacttacactgacacatcaccatcacccaaggtttatggtttatgttagggttcagtcttgattttgtacatgctatggatttggttatgtttataataacatgtgtccacccttgtagtatcatgcagagtagtttcactgctcttaaaatcctctgggatccatctattcattccatgatttaggttttgatgtcttgagtttgcccacagaggacaaatgaaggcttgcaaatgggtaagggcatctaggtatacagtgtaaaataagaagagaagattgcctgtcactgcatcttgaggagcaaccacaggcggcaaagagatggaccaagaaagaggcatctacagcacagtgagagtggcaaaaagataagtgaagcaattcttttattcattcattcattcaacatatatttttgagtccctactatgtgctagagactactatgtgttaagagctgagtatttggagagtggcatcacagaagcacaaaataaagagtgtttttaaaactagaaaatggtcaagtgatgtgttttggacatgaggtcattggtgactttagaaagagaagtttcagtggagtggtgagagtgggagccagatggcagaggcttgaggatggagagagaggtaagcaagggtgacagtgaatgtgaagagttgtcaggttcacgactatgccaaatgtcatgttgaggtctgaagggagtgggtggatgagcagaaagaactcaagggcccgtagacaggtgaaagatgattttattcagcagcaactgtcatcaacagctttctcacactgtctgccctgtcttggttgcttgagccagtggctcccacatacagctgcgcagctggctctcccctgctttcagggtcagcagcttaactctttctctccctgggcatgagtgagctgagctatgttctggctgcccttggtccatctgcaaagatggacagctctgactcactctctctttctctgggtgccagcacctatagagtgtcaacagggcaattatacctttcacagacagtagtggcttagagccaggtgatgagcctttcttatgttatggctatggtggtgagcttctctatgttaagtctacatggctgtgataacaagtggagttgtacacctgcgctctaaattcattgagtcactctggatgtttacctcggcctacccttgaccaaagcacagccttgttccttacactccaccccctgggctgagggagacgtagggcttgatacacaggttatatgcataaactttgggtacatagactcaatatacacaggcatgggctttatacataagtttggggcacataggcttgataaacaggtttggcacacaggccttacattctatcccctaggctaagggagtccttagtggggacccatgcacatagggcagcaccttggacccataggccacagcaacaatacagggaacaacagactaccactaacgttcctgttatgctacctgtgattattagagcccaacataggccagagcctagagaagcccaccgtctctgcagggggtcatcagtaaggcactcaatcaccttaatatcctgtgacaccccttataaggctgctgttatgttctggtggttgtcaggaataaatgtacaacattgcgtctctacaagggcacagctgccacattgggcagctctgaccatgtctaaggccatccggttttgcagaaccaacttcctgatctgattgacttcatcagttaacaaaaaggagagcaactcgggtgtaattcagggcccaaactgtgtgctctgcaagggctgtaacttgcatttctacagtagcgacacctgctctagggatagttatcgcttaggggtagagtcactagggggcttgctgaactcgtaaaaaccaggaacatagcaccttccagttaggtggatgactaggcaatgtgggaaacacagtggcaggcacagaaagccacccccaggtacaacgtccagtccaattggctggtagatatggccatcctgtgtccccacagacccataaactccctgggggcataaagtccatgaaggtccagccttggtaaggcaacttattccaccacacccttggtttcgcggcatgtgttatgtttgcacaaacctcagcaataatccctcagtgactttaccccagtgctcccctatacatcatggtacctgcaatgggggcaccacatgttttcccgttagccagccccatccatcatggacactataagtcagccagtggcaggcttgccatgggttttgggacgtccccctatccaaagcccaccattgcattgtctattgaacaccaagtctctagccatgtccagttctgcacagaagctggatgcacgttccagggcaagctgcctgcagctgctgctgaaagggtggtgcagatacaacagttgaagacattggtcacctcagtgtaggtgtgggcccagaacatgatgctgttggagcatgccacctatggctggaatgacaaagcaagcacaggtactaacaggggtaaatcatgtccctcaggcaaaatacaggccaacttttcacctctcgataacagtgcagccaccaagggcatttgccctgggtgatgataccacaccttatcagctccctgtggtccttttgggtgctgtacccatgccaaacacacaggggagcttatgctaagccacacagacagtacacatgccctctggaggagagtctcttccctggccgttcccctatgcatggttaattgtggaggccacacattaaatacccaaggagtaacatgtaagttatactgcagcccctccccccagggggctatgatagccaaccatctgcaatgaggtgcttggagggtccatggctaacaccaggtttttctgttcccctgcctttaggggtactggggcaggcaataacagattactgttcaaccctgtacctggttggagaaggttgttcttcctctcatagatctggccacatggcctggccctacatgggtcgatgactaactagctaattctgtaacttctaggtaattaaccacaaagttaagccttgataaattgcctagctactagtacagattaccacaggtgtcatctccttggtgatcacagtccatattgccttgagttcaacttattagctactttatttacacctggttttaaaccatattgtgtcagtactaggctggactgtagcagcaatccaggcagcagcagtactctggctatacctacctgtatactatgcctcattaggaatgggaggatgcccttccttatggtaaaggctcagggtctagaggtgcctcagaccccatgactttatcttgcattaggactataggcttcaagacctattgtaattttactcctaagagaccagtactcagtgtactctgctgctctaagtaggtgccccacttcgctaaagtggatgtctgtgccttccctatccagggggttgtttcccatgaatgcccaatctcacaattactaactgcttctctatcaaggaatactggggctcagctcccttccacagctgggaacaaaagcctattggcatactcaggtgctctatgcactgctataggccctaactgaaactctgttgtcacaggcacatctagtttaaatgggcacctctggtccactacccgtatggcttgtgcctgctaaatagcccgctaggctaccagaaagactgtctcaggagcatcatcccaatcccaggcaagaagaacattgccacttctaaatctgcaggagaatcagaggttaacatgacatcattaataaaataatgacacgtggtggggctatgaatatagccctgcagcaacactgtgaaagtccattgtcaccctcccatgaaagcaaactgttcctgcctctctggaacaatgtcgactgagaggaatgcattggtcaattccaccacatagtggcattgtctcagttctgttgtcaagaagttcatcaaatccatgatagaaggtacagatacatgcagaaggagtattactttattcagtttccgataatccactgttatctgccaaatcccatcaggctttctgactggccataatggaaaatggtaggggctatggatgccacacactatttgcacctcctctaacttcttaatagtctcagttacctctgtattcccccctggcaaacggtactgatgagtggaagtaacctgtcagggttgtggcagaacttggggctggtgatgtgtatgttcacccagtactggctttactgcatggactcagaatctggattctctggccgtggtgtgcaagcccagaccatgcaaaatgtccacccccagaatatattcaggtataggagaaacatacacagtgtacaggtggggagccaagcggccaatgccaagatgcagagacacaggcttcaccttcaccgactggctcccataaccgtccataaatgcagctttgcctagaaatttatctgggttcccataaactagactgcagtctgcaccagtatctatcagtgctaggacccgcggtacattagtgggggaccagtggattgccagctccacatatagcctctggttgtctagttccccctgccaagctggcgacctcggccagttccctaatcaaacaagaaaggctctgtatctctgcctgtctgcaaatagtccttgagttgcagcgtctgggagggattaggttgaacaacattgttttgccccccacaccttaggcattttctggaattgctgctcccgggacaattgccttcacagagtcaacaacattccattgggttgcccgtcaattttctcccgagcaaccccagctgcaagtaaatcaatccacatctgcatgcaggtcacctcctggagcccctttttatctggtggggtggttaactgcggatgaggcattttctccctccttacggtgcggattctccggtcctgcgaatggccttctgcctccctgagggctgccagagcagtagtcacttcatgtatgcggcaccccacatactgggtgagaacagcggctagaaagccataagggttcggggtgctgaactcagcacaagatccctcatgtgggaggtaaagcgttcatcatctggccccatggtaatcagaccaaacatagcctgccgcatacctatctccaagagtatctgcaccaaattagtatgtgattgccatttactcacagtttgtagtatctctctggcatcattgaaaacagtccatatgactgtcattagccacttgattaatgtgtggccaccttgctcttgtgccaaccgttggcacagctgcagctgctgacgaagggaggggtgagttgtgatagaagtcagcttctccatctcagaggcggaacaaaaaatgctatcagctccctcagacgctgccggcactatttacctaattcccacaactcactggggttataagcataataagaggcgtgttccaccactgtggacggggtccctgggctttcccctagggtcccatcagctgcttatgttctaccttctgacggatcacaggaggagcctgcagcggaggagcctcctcctcctcagcatcagacctaaagggagtgtcctgcctgaaggaccggctcaaggtcgcactaacagctcttgctaactcctgttccaggctgtttatctgggcctccaagtaccctgcttgcgcctggaggtctctcacccccaggtcctgctcaaagctgtgcacttgggcccccaggcatgcggcttgctccggaaggtcccttacctgtggcactgagcatgtacttcctgcagtgcagttagaaatgcccatccgactctgcttgcaaagaaaaagactatcttggtggaagaaaaactccaaaacaggcacagctgcttaaagactgttaccggaaaggaatcctgatccagacgccaagagagggttcttggactcatgcaagaaagacttcaggtgagtccatagagtaaagtgaaggcaagtttattaagaaattaaaggaataaaagaatgcctactccataggcagagcagtggtatgggctgcttgattaagtataatagttatttcttgattatattcttatagttattccttgattatatgctaaacaaagggtggattattcatgagttttctgggaaaggggtgggcaatttctggaacggtttttcccctttttagaccatatagggtaacttcctgctgtttccatgacatttgtaaactgtcatggcactgatgggagtgtcttttagcatgctaatgcattatgattaccatataataaacggtgaagaaggccagaggtcacttttgtcaccatcttggttttggctggcttctttaccacatcctgtttgttgacaaaaagagtcaaactatagaatatttgaagaggtttattctgagccaaatatgagtgaccatggcccataacacagccctcaggaggtcctgagaacatgtgcccaaggtggtcagggtgcagtttggctttatacattttagggagaaatgagacttcaatcaaatacatttaagcaatacattgctttggtccagaaaggtgggacaactcaaagcaggggcttctagcttacagatagatttaaaatttttctggttgacaattggctgagtttatctaaagacctaggatcaacagaaaggaatgtttgggttaaaataaaggattgtgaagaccaaagttcttatttgcagaggaagccttcaggtagaaggcttcagagagaataggttgtaaaatgtttcttatcagacttaaagtctgtgttgatgttaatgccagggatgtataatgaggcatgtcctaccctcacttcccaggatagcctgaatcagtctttcaggttgaatttcaagagtgccctggctgaagaggaagtccatttggatggtttgggtgccttagaattttatttttggtctagacgttttatcagcaaggtctttataaaatgtatcttgtgccaacctcctatctcatcctgtgacttagagtgcctaacttcctaggaatgcagcccagtgggtctcagtcttattttacccagcccctattcaagatggggtcactctggttcaaatgcctctaacaaaaccagatggcctgggatggcaccagagcttcttaacccctgaccagatactggagggagatatgacccccaaaccagcacagactggaacagatgaccccttgttacctttagatcattaacatatcattataatgctaaatttcccacccttatgtaaaaggaaaataaatctcaggaccccaaaatcactaagccaaagggaagactcaagttgggaactgcatcaggcaaaccttcctcccattcttttctacatacctctctcacaatttgcccacaaggaaattccttgtggacaaaggacagatagaactcaaagtcatccctttgctcatgtaagacaagtgcatatctgattgcttcttttgccttattgttttcactaagccagactaaagcataagtgactattcctatgaagtgtgtattcagtgaaaggctaatcaaaaactcaaaagaatataaccatttgtttcttatctacctatgacctggaagccccctccgtgctttgagttgtcccacttttctagaccaaaccaatgtacatcttacatgtattgattgatgtctcatgtctccttaaaacgcataaaaccaagctgtgcctcaattgccttgggcacatgtcatcaggacctcctaaggatatgtcacaggcacgtccttaaccttgacaaagtaaactttctaaattgactgagacttgtctcagatactcttggtttacacttataggaaaatcaccaccattttctgaacatatgtcacatgaagaggagagtttattgtctacgcctgtgtctagggttcctccttgcacatgtttgcatactttcccaccccatggctaactccttaaaattccccagtgtattagtctgttcttatgctgctaataaagacataccggagactgggcaatttataaaggagagaggtttaattgactcacagttccacatggctggggaggcctcacaattttggcagaagggccaagtgcagtgactcacacctgtaatcccagaactttgggaggctgagacaggcagatcaccgaagtcaggagtttgagattagcctggccaacatggcgaaaccccatctctactaaaaattagccaggcgtggtggtgcacacctgtaatcccagctcctcaggagactgagagaggagaatggcttgaacctgggaggcagaggttgcagtgagccaagattgcattactgtactcccacctgggtgacagagtgagactctgtctcaaaaaaaaaaaaaaaaaagaaaaaaagaaaatcatcctgaaggcaaagacgaagctaaggcatgtcttacttggtggcaggaaagagagcaagtgcagcagaactcctctttataaaaccatcggatctcatgaaacttattcactatcacaagaacaacataggaaagacccacccccataatttaattacctcccactggatccctcccacaacatgtgggaattatgggagctacaattcaagatgagatttgggtggggacacagccaaaccatgtcacccagcttcccatgtctcagggagaagatgctccttctacattcctggccaggaataaaatctgtttgtctttttttctgattgggtgttccttctttgcgaccaatacaaagtaggaaacaaactcagtttactggcaacaagggggctcaaacaacaggcagattgattatctacaaattgaacaggccccggatgtagtgaatgcaggcaaggttggttcagtggctgtgtaatgtcacaaggactgaggttgtgggggccaagagagaactttccccttggccctttaaaggttggctggaaaatcgctgacatgaggcagattggttaataggaaaaaaaggtgtacaagtgtatttaacgtgtatacacaggagccttcgaaacgaagactcaacttcccaataaggtagagaagcttatgtgccaacttgaggtttcagaaagaaaggggccttggattctgataaaacaggttatgggaacatggagaagaggaagtctattgatgggaataaatgattattcaggagaatgattgaatggggaacagaaattaagttgtaaatagttctctttggaaattaagtgatccttggagatagtcatcatcttgaaaaagggtccattcaggtggttacattttggtcttacagggaggggaagaaaactgttctccttgataggtctggatcttaggcagataatggaacttcagtttctttggaagaaacggtggaaggtcagagagaccttgagtcttgttcttcagttcagcatgtcgtattttggggtactggtttctgaaaaccaacaggttctttccatctttctgtccttccatcctccatgtcccagctctgtcctcaacctgttccctttttagggctgctgatagaggtgtagtgtggtggttgttaaaaggaaaactgtagagaaatttaacaaagtttaatggagcaaagaatgattcatgaattgggcagccccctgaaacagaataggcttagggcaactccagggttgccatatggtccaatactatttatggacaaaaaaagtaaagtggcgtatggaagatggaagtgaggtaaacagaaacaatcagattggttacagctcagagttggtcttatttgaacgtggtttgaacagttggctgcctgtgatcagccaaatctcagctgctgtgattggttgagacttggcgacttgttgtaagagtaggttgtggtgtgtttacacatccagttaggtgacagttcactatgtattaagaaacctttagtcccgactgaaaatatctaaagaagaagctgtagactaaattcaatttaacaagactaaatcatggactggagttcaaatctcagctctcttgcttagaagtcatgcctcagtctcctcatatgcaaagtagaggaaaatggaggaatttatcccacttggttgtgctaaaagataaactggttttattaaaatagtaaagagtttattcgaacagagagcagttcatgaatcaggcggctccagattgccagcagtccacagctccaacaaaggatcctgaggggaggatttttataaggtgcacggagaggcaagacaaagaaaacatctggctggtttaagtgcggcagtagcctaatttgattcatttcagtgcacagttcctagttagagtttacttggcagtttctgattaaacttaagttttgttctacttcaacactgaattgggttttggtttacttatacaggaacccagggtgctggagttgcctcaatgtaatgccctcccaattaattagctgttgcgatcatacaaggaataaatgctgtctgccttatttatcattttcttggctgaatctgactatgctaattccagacttcagacccacaatatacagtgaaggaagaagaaccattctttccagtgtctttgtctttctgttagcctagagggcgcatgtagattaattaggaaacatatccccttccttgaacccccacgctggatgctttctcacctgagggtgacttgtgtgcattagacaacaatgcccatttgctttgtgtaaagacaaaagtgttctttctgggtacctgcctctccacactcctcatgggctggtgagcagaaatcatatgggtccaccctaaatttcctgggctgtgtgctgttgcttcaaaccctatctcaaatgccacttaatttgcttacactgtatctttaaaatggaaactttcatcttccatcatatcttataattatttgtttgtatttaattccccacatctgacagtgatctccacagtgtcttttgcaaatgttcttaaatgtttgttcatactacttaatctctacggaatggtactggatcactttaactttaggaggtggtgccttcttagacctgataaatcaagtttagcttaaagctgcctccttacatattttaagtttggtctaaaggtttctccatacattgtaaactctaacctgactggatgtgtaaatagactgtaacctactcttgtgccactcactgagctttggtcaatcacaggtgcacaactgttcaagtcatgttcaaataagacaaactgagctgtaaccaatgggctgtttttgtacctcattttagttttctgtaagtcactttccttctatccataaatcttccaccatgtggctgtgctggagtctctctgagcctactctggcttggaagactgcctgatttgctaatcattctttgctcaaattaaactctgttaaatttagttagtccagggttttttttttgtttgtttttttaaaatcaaatcttcagtgactctttatggtggtcaattatggccaggatggataggagactaccatgcagaaaagtatgagagagacttgaaaaccatgcagtgatctttaaaaccctctgaatatgtattttcaaatgctgctttcataagtcattaaccataatttattgaatgtgtactatgtgtatggcattgtactagatcctttataaaccatatagaatttttatagtaaccttgaaaagtatgtgttattatatccactgtacatattggggggactggaggcttagaaagtggaagtcgaggcttgcacacacttattatgaaaggccagctggcatgatagtggttcaccctgaacagcagatggaactgataacaggcccattaaattatgggccaaatagtttgcaaccttaagaaatccctgtgaaatgttcatagaatattaacttcttatcttatcaaagaaaattttaacccattgaaatataagatttgtgttagggtctgaatggccaaccatttttttttttctgtatgtgtttgagaataatgtgttttgcaatttttacatgcagtattttatataagcttatggtacagcttgtttattgtataatttaaaacttccttgtccttactaacttttgtctgtttattctattgctaaaagtggtatagtaaatacactacaataatgcatttgtcaatttatctttagttatgtcactttctgcttcatatattttgagaccatgttattaggtacataaaatataataattatatttttttctggcaaactgaagcttattataaatgaccctctttgttgcgagtaatgccttttgcatttacaactgatggagacaggacgcagccaaaagtccctggtgaaaccccgccttcaagcctaaaacagcctgaaggatgaaaaaccagacttctggtgcctgatgaagcctgccctttcctgactgattctaaataatgcctacctgccaactgggaaggcagggtggagccttcggaaattcatgaccttcgcaggggagaggagcttggcctctcctattcctgtgtggtgacctgggattcaaactgtgaggcggaaaacctgctagcaggagtctcgctttgctgagagttatttttcttttcctttttatccaataaattccgtcttctcacgcttctatgtgtctgtgaccctactctttcctggtcgtgtgacaagagcctggttttagctgacctaagaagaaagttctgcaacatttttggtgtccagacgtgagtcttgaggaagggtgagtacatgcaaatcaaaaaatcttttttttttcctttcgcttctaagcctttttgtccttgtacctcttctgggggtagaggaaactgcgcaccaccccaccccaagggctgcaggtgtgtgcggcatggaccagtgaatggcggctcccccggtcccttcccggccagggctggagtgtatggctcgaggctgcgcaccagcaggctggccagcactccctccacttgtccatggaggcttcccctcccctggccaaggggacccactctgtccgacagcaattaagtttctttccctggtggaggaaccatttgcataagaataagaggttcttccccaggcatctttttcttttctttttttctgagaggagtctcactctgtcgcccaggctggagtgcagtggcgcgacctagactcactgcaacctccacctcccgggttcaagcgattctcctgcctcagcctcccaagtagctgggattgcgccaccatgccctgctaatttttgtatttttagtagagacgaggtttcaccaggttggccaggctgatctcgaactcctgacctcaggtgatctgcccgcctcagcctcccaaagtgctgttactacaggcgtgacccaccgcgaccggctggcatcattttttttttcctccaccctgtcagcagttaacacagccctgcatttaagctgtcttttccttttctccgccgggtcaggagttaacttttaagtgaggctattttgctttttagaagatgttttactaggccaggaccccaactgtcactgtctatattctctgtaaagttttaatgatgaaaaaggatttgttaggttggccttaaattgcagccaatccagtgtgctttgcctggcattctgcatggtcagcagcaaactttgctgcgggcctccatcttgttttacctccttgggaacctgacctgtaaccaggtgacaatgcttcgtttagcctcccccattttaccatggcagccagattcagtcctggcttagggaatgagtcctttctggtttggtgtctgtgcgacccttgctatttgttgattctcttcccctcccaaactgccttggattttcctttctctgagtctttagtaaagtttgaaagtcagaaatattgtctgcttggtctggttaaagtcaggtaataggggatttaaaaagattttcttaaaaagcacccagcttaattaaaagtggatatccaagtcacaggtatatttaaaaggcctttatgtttttcttttctaggacctcattttgttgggaaaaggtgtgtttttttttttttttttggtcggctgaagtatttttctccattttgccttgccacttttaatggacacatgagaagggagagacctctgtttttctcctggaaccccaggaattaaaggcagatagacccctctcaaaatttgtttttgcttcccagttatgcctcttatgccttaaaagccgcacattttcctagcctaactcaaaagtcttccctccggaggccaataatccaattaggagattggcaaacgaaaaaatcttatggctgctggattttcttctgcttgtctgtgtagttatatatgtgttgtgtgtgcgagatgtccataaaaaatagctctaattaattggcccaaaggaagacaagtgctaggatcaaatattttttaaagggaagataaaagctgtggtaccgtttagatcacgactttaatctgagaaataaaaacagccttaaaaattattggtaaaatgcagatgtcatcaaaatgtaaataggtaaactaaattatgcaggtcagatactagatttgctaagtgtattgaggttataaactgcctttttggtctttaagagcttttcaccttgcaatggcatgatctcggctcactgcaacctccacctccccagtttaagggattctcctgcctcagcctcctgagtagctgggattacaggcacccaccaccatgcctggctaatttttgtatttttagtagaggcggggtttcaccacgttggccaggctggtcttgaattccggacctcaggtgacccacccgcttaggcctcccaaagtactgggattatggacttcagatgttatctgagagaatgcacaagacagacgcagaggacgctgagcagtggttgagtaggtgaccctagagatgaattccaatgctaagcttaattaaccagtcagcacattggggattctaaagcctctatctcaaattcttttcacatttgtcacagtccttttgagccaagaagttcaccctataggagagagagagaaaaaaaaagaaaaaaaaaggaaggaataaaaaagaagcagaaagttcaccctataaatactggaagagggtagagttttctttttttttaattaatttttattgaggtaaaatatacatatataatttaccatctttaccatttttaagtgtacactacagtagtaataaattagtttacattctttttttccttcattcctcctccccttctccatcctggcctctgggtaaccacgaatctatcttcattagatccacttttttagctctccatatgcacgagaacatgcagtatttgtctgtgtttggcttatttcacttaacataatgtcttccagttccattcatgttgctgcaaatgacagaacttcatttcttttcatgactgaataatattccactgtgtatatctactacattttctttatccattcacctgttgatggggacttaggctgagcccatattttggctattgtgaatactgctgtaataaacatgggagtgtagatccttctttgatttcttttctttggctatatactcagagtggagttgctggatcatatggtaattctatttttagtttttgaggaacagccagactgtttctaatttacattcccaccaacagtgtatgagggatcccctttctccacatcctcaccaacatctgttgttacctgcctttttgatataagccattgtaatggggtgagatggtagttcatttttttttttttttagacagagtctcgctctgctgcctaggctggagtacagtggcacaatcttggctcactgcaacctctatttcccagtttcaagcaattcttgtgtctctgcctcccgagtagctgagattacaggtgcgtgtcaccatgcctggctaattttttgtattttcagtagagatggggttttgccatgtcagcaaggctggtctcaaactcctggcctcaagtgatctgcccatctccagctcccaaagtgctgggattacaggtgtgagccaccatgcctggcctgtagttttgatttgtgtttctttgatgattaatgatgtcgaactttttttatatatctgttggcaattttttttttttttagacagggtcttactctgtcactcatgctggagtgcagtggtatgatcatagctcactgcagcctcaacctcctgggctcaggtgatgctcctacctcagcctcctgagtagctgggactataggcatgtgccaccatgctgggataatttttattttttgaatttttgtagggacggggtttctccgtgttgcccaggctggtcttgaactcatgggctcaagtgatccacccatattggccttccaaagtgctgagactataggcatgagccactgtgcccgacctgtatgtctccttttgagaaatgtctgttcagatcttttgcccattttgatttcaattattattattattttgctgttgagttgtttgaactccttatatgttctagttattaatcccttgttcagtaaatagttagcaaatattttctctcattatgtatgtggtctctttactttgctgattgtttccttggctgtgcacaagctttttagcttgatgtaatcacaattgtctatttttgctttggttgcctgtgcttctgaggtttgacccccaaaatctatgcacagatcaatgtcctggagcattccctcaagttttttttttctagtaatttcatagtttcaggtcttagattcaagtctttacattgagttgatttttgtgtatggtgagagatagaggtttcattcctctacatatagttatccagtttccttagcaccatttattgaaaagactatccttttcacattgtatgttcttggtgcctttgttgaaaatgagctggttgtgctgggtgcggtggctcacacttgtaatcccagcactttgggaggcctaggtgggtggatcacttgaggtcaggagtttgagaccagcctggtcaacatggtgaaaccctgtctctactaaaaatgcaaaattagccaggtgtgctggtgtgcacctgtagtcccagctacttgggaggctgaggtggcaaaattgcttgaacccaggaagcagaggttgcagtgagctgagattgttccactgcactccagcctgcatgacatagcaagactctgtctcaaaaaaaaaaaaaaaaaagaaaagaaaagaaaaaaagaaaatgaggtggttgtaaatgtgtagatttatatctgggttctccattctgtcttattggtatatgttttcatgccagtaccacactgttttggttactatagttttgtagtaaattctgaagtcatgtagtattatgtctctagctttgttctttttactcaggatttctttgggtattcaaggtcttttgtggttccatataaattttaagattgcttttcttatgtctatgaggaaagtcattgatattttgaatcccttctctcattttccctccctccttcctgcccctctccttcctttcttcccttcttcccttcctttcctcaactgctcaaaagtatatctagtgagcactgcactttcaatttcactaagaaaagcagccaaatagagctagctaaggtgggcagcagtgggtggtatctgagttttggtggctgaatccatgggtcccctatcttcctctactcctgcgttcctgtccttcaccctttattgctccacatctccatgattggtgaaaaatgtcctttccacacagttttcaacaggcaaatgtgatggcatctaatgcagcttaattcctcttatgtccttgcttttcattttctcctttcgctcttcttcctcactttctctcctccaggatccttttggcttgtctcgaagttccttctgattcctttgggctgtcagctccgggggccgtgtgaggggcagggggaagatgtgtttgggtccatgcctgctagctggcacgaggagcacgttgtggggcacacgtatgcatggagccattgggaaaagctctcacatctaactgtgtttccctagacaagtacagacaatcaccaggaactaaggaacaagaagcatccaaccctgcatctgtgggtttcctgaggtgactctcaattgtcataggtgagcttgctcccctcctgctctccacccttacactgccaagagcaagagcgtagaaagacataagggatgcggtggagccaaaaagctaaaagtttttttctgtctgatttgttcaggggtgaagagtgagtgaggaaacccttggagcacttgtttgcttcacagacatcctgacctcctttcaactgtaaagacttagtcagaggacggcggctccctcagcctcattctgcagttccaatgacactttttacaaaggctctgtacttgtctgattcttaaatattccagtttttgaactttgctgcagtagttgtattcgaaatgggttaattgtctcattttctttttaatgcctactctttcaaggctcaaatcttgaataggtcaaaaagagcaagaggaaaatgtcagagaatggagaaaggcaaatacagagaagcagtgtgaacatccacccggcgaggtgacctgatggtgctgctccatgtcagagacagtagtgtctgggaagagggagccctttccacagggtggagcaaaaggcctggagctgacacctggctcctgggcccactcgcccaccacctcgagcaactcccttccttaacgtctgcccgagtgttaagggctgagcacatgacctcacaggaggatgtgaggggcagcggtaacatgtgtctagcactttgtcccttataagtcactcacaaatacttatatccttattatcttcatccttttctcttgagtttttctctaattctttaagaaggaaacacgtagccaggaagtggagagcctctcacatacttggggagttttcatatttcccccatcagttccttttctggcctgagctcatgctccctaagatcagggcttgggctttgttttagtctgtgttgttataaaagaatatccaacagtgtgtaatttataaagaaaagaggttgacttggctcatggttctgcaggctgtacaggaacaagcttggctccagcatctgcttggcttctagggaggcctcaggaagcctttactcatgggggaaggcaaaggggagcaggcattatgtgagaggaaggaagagagaggcaggggaggtgccaggcccttttaaacaatcagcgcccatgggaaataacagagccagaactcactcattaacttcagaatggcaccaagccagtcataaggatccacctccatgacccagacacctgccaccaggccacgcccagtatcagggatcacattttaacgtgagactcggaggggacaaacatccaaatcacatctggccccataacctttggagacctcagctctggcgctagggtggtaggtcccctaagggttcgtgctctctgaaggaattgggttacattacctgggagagctttctggaggaagtgagctttgcttctcacaggtttctataaggagaaggatgggctgttggaaagggagtgagtgtgtgtccaagtgagggaaagtgaggttcagcatcttggtgctcttggctcagcttccctttctatgccatgcacagtgcctccaggatgccagggggtgccatccctgacctgttctggggtgggtgtgcaagatgcgaaatggctaatttcagttcactggtaactctaacatttggataataattggccatagcattagctttggttatacatctccaaatgtgttattacattatatatatatatatatatatatatatatatatatatatatgcacacacacacgtatacatatatacacacatctacactgtattgatatgttgatatattgatgttatgaattattttaaagagtattctattgatgtagaggataatatgaaattcaatattttctggcactctttttaaatgatacttaggccatctgatgaaaacagagctcagtaaagatttcttattgataaatcaacattacaaatgaagactagtttcattgccatgatcagtaaattaagggtcataaattaactgttgagttattttctttgcactattaagccttccactcaatctttctacagtctttcttatttagcaaacggtgttacttgatagaaacctctgctgtgattttgttttttgaaatttaataagaaagctatataatacaattctcgggggaaaacaagcaaggtaggtttttcacggtaacctccaagcagagaaatggtttcagtgcgcagtccagtgaatttcctccatagagtgtgctggaagaagtcacctggaagtgatcaccagagtgatattcagtttgactctcattggtttgtatataattgattatatataaaaacaaatgccagggtgagggtgggactagagtccccctttcaggctcctccccttgcatttccatctggtcttgcagcaagttaaccacggtcctatcttcaggttcaattactccctttaaaaaataggttttaacacctatgtatctctcaacattatattgttttattttgaaaaattgaataataaccacacacctagctttggaagcaagaggcttcatggccaggatcagataaatgatcctcttagagtgggtgggacctcagcatcccagagcgtgtggaagagtgcctgccaggaagccaccagacaaggtcctaagtacatgcatggaaacactgggcacgatgctgactgtggcatgggccaaaaagtgacatggggcagaacttcagtgggaggaggggtgctctgtacgttcagcttctaagcccactgtggccttcctcttagggtttcacagagccaagcagaaaaggagcacaggtgaccttggcaggaaggcatgcatgggagagcaggtctgcactctgggacaccagcctcaacaggtctgtctcttgatcacgctggcgacaagctgtcatcgtgagatttcctcccctcctggggattgccttggcctctgtctctgttgaattgaatcccgtttcctccattctagtggggtttttttttgttttgttttgttttttttaacaaggactcttgctctgtcaccaggctggtgtgcagtggcgcgatttcggctcactgcaacctccgcctcctgggttcaagcgattctcctgctgcagcctccctagtagctgggattagaggtgtgtcccaccatgcccagctaatttttgtatttttagtagagatgaggtttcaccatgttggccaggatagtcttgaactgctgacctcaggtggtccacccgcctcggtcttccaagtgctgggattacaggcgtgagccactggcatccggcattgcaggtctttttctctcttagttttttctctcactttggtgatgagcattctcctggagatatttaagaagttccaaaagagatacattttttttgaggttttgcaggtttgaaaatgtttctatgcaaccccccatgcttcactgatagtttggatatggatttctaggttagaaatcacttcccttcagtgttttgataggttgctcatttatcttcttccttcaggctgttgagacattcaaagctattttaactcttcatgctttctatataaattgttcccccgacccctgctttaagactgtagaattttctccttggccccaatattatgaaatttccagaaaatgttttttgttgtgtgtttgctttacacattttgttggacatttggtgggtcctttcagttgtgggaaactttcttgagttatttcatctataatttcttctaatgcactatctatgctctctctttccagacctcctatttgaatattggacctcctgatctagttctttagttttctcactttatgttttcttcaatattccatctctttgttctactttctggagagaacttcaactttaccctttaactttcttaaactttcttttgtgttttcattttgagcttttacttctcaagtgtttttcaaatgctgtctattattctctgtatgtttctcttcatagtatcctgtttttctcatgcatgtgatatcttattttatacctctgatgacattaacttttggctgatgcattttttttttgcttaatgtcaattttatacaattgcttttctctgcttgtcttcttttctgctctctatgttatcaatttttctcatgaacctggtagtttttgttttgctgctcatgattaagaggaatctgaaaatctcaccagaaatgtttgtgtacagcagtgacttattgattttgagtttattataaggtaatctgagtgggcgattcactgattcactaggtcttttctgttaaaagtctgtggaaaagactctatgcatcttgtgttcttaaaagttaaaggtctggcttctagcatcctaggagataggatgcaggaataaaaagactggacatttaaaatttagcttttaacacccctataatcatttaatctcctttttgtctctataggacacaactccttttatttgcaaggcatcagatattccttgtttaacttttactgtagaataaagctttaaacttttggggtggggttagatcagtcacccaaagagcactgagtaggaaagatatcccgggggctaaaagcctgtcaaggaactttcaccccatctctatattttcctcccttccctctatccttcgttccagaggtaactggtgccaccgctttctcatcttttaaggattctgacatttaaattggtttggatctcagctttctcttctggaggcactggatttagttctcttgagctgctaattactacttgtccatctgttgctgctgtctcttatcttctcttcatcatccagcacatgtgtctttgtgtgtgaatgcagttttaaagaagtttcagcagggagcaaaattgtatgcacgtgtttaattaacttatcttaacacggaaactggcctgcagtctttaccatatcattcattttatttatgttctatacagagccacagaattcagagtaggaaaaaattaaacattttatatactctaatgccctcattctgtagatgagcatattgtctccaagaagaaaaacagcatgtctaaaatgatatgcttggtttgtgttaggatccagatttaagaagtcaagccccaatctctaaatactacccaatgtccaaagttgctaatatgtcttaatttagtaatttagcaggtcaatttgagttgtagagaccaaaattttgtcctatgggaaattatgatatttgccagaccacaaaaattgagcaaagtatagaagtgctccaaaatcaaacaaatagtggatgtaatccagaaacaaataattagtttggataatgaaagtataggtatattttacatttaaaccaatgaacaaagaatcagtgagcaggaaaaagaaatcctgtgttttaaacatgtcagcaaaaacatggtatgtgcatggaatattcccatctgctccttttgagttctggatttcagactctcttctcagccctccagggcctaagagtccctgtgctctccaaggcttcctccatttctaaggtgctgggagttcctctatctgctctctgctgtctccacccacctgcctttcattctatcaacaaaacaagacaacacaaaacaaaagcaccttaattgtgatgagttttgccccataacagcctttctccatgactgactaattaaaaaaaaaaacttttggtatgatcctgagtgcctgcatggaacttggtgatgagcatgaggcgaacaggattccagtccttacctgtcatgagtcatgcgacttggcctagatacttccaggcctctcactttcctgatttgcaaagtgatctttcaagctctagtgttttagaaccatgaaatttccaaatgattttaaataactattagttatttagaactcataaccaaaggaatgcatctctaagttggaatttcagactccactgtggaaggttatatgtgtttgggtttggagccatgagagaggaactactggaccacgtcatctaggtggctgtccatcctccaaggatagagagcatctaaaaatttgaggttcaagagaaaatgggtgattttgtggctataaaaaatcatgaatgagtaaaaaagaaggaaaccctgccatttgagacaacagggatgggccttgtgagcatcatgctaagtgaaatcagtgaatcagagaaagacaagtgctgcctgaccctactcacagatggaacgtaaaaaacaaactcatggaaacagacagtagaacagagattgcagggctggggagcaggaaaacgggagatgctggccaaagggcacaaaccttcagttacaaggtgaatagctctggagagctgatgtacagcctggtgactattgttaacaatagtgtattgtgtacttgaaatttgctaagaaaatagatcttaaatgttcttaccaaaaacggaacagaacagcctaacagtgtgaggtgtggacatgttaactaacgtgattgtggtaatcacaatgtgtacctctatcaaattatcacattttataccttaaatatatataattttatatgtcaattatatatcaaagctgaaaagaaagaaaaaatgagacacaattttaatctttatatactggggacagatgtttattttatagacatacacctgattatttaaaattaagtcttcactcatgtttcttttgaattaataatctaaaaatgtaaatggaaaataaattatggttgaattgtatcttccaaagggaaaatgacatttaaactgtcataaccctgataagcaaatatttaactttccaaccaatggatgataaatcagctatttatttaacagacttttatagtcatggcttgggattttatagccatttggttttgaattaggctgactgtacattgtactaagaaagaatcacataattaaaaaaataaaatttatggggttgataggtctcacatctgagttataattattatccttctgcttagttgtcttgttttcatgtggagagggtgactgggagttttatttaggctttgcttttttctacttttagaatacgagttttgaatttttgaattgctgttaaaactttcatcatgaacactgaagtgagtgaaaagagacttttgcagtcatttttttggtaagcctattacctgatctgctctgagtaattagcttccttgctcaccgagccatcttctatttctgcttctcacagtctcaagtcctctctcccgaggacatgtgcctcctgagctgcaaagcatggtatgggtgttgtccagggtgggggttttcaaaaatggggagacccccaaccagaaatattcagatttcggctttcagcaggatgacaggaaggactgggatgcactttgtagatacttgttaaacttcaacgaagaatttgaagatttgtataaatcatgggttttaggtcaatagcatctagttagcactgaggtaggtacctggcaaaggccttattcctccatgtctgattcacactgttggacatattctcttttcttttctttcattttgagatagggccttactccattgcccgggctggagtgctgtggcagacacagctcactgtagcctcaacctcctgggctcaagtgatcctcccatctcagccttctgagtagctgggaccacgggcatgcactaccatgcctggctaatttttgtatttttttttttagagatggggtcttactgtgttgcccaggttggtctcaaactccaggactcaagcaatcctcctgcctcagtctcccaaactgcttggactacaggtgtgagccaccacaaccagcctcattggatatattcttttgtagctaatttttgtgtttttagtagaggtgggattttgtcatcttggccagactggtctggaactcctgacctcaggtgatctgcccacttcagcctctcaaagtgcagcggttacaggcgtgagtcaccgctcccggccaatttaatttcaagaagacaaaatacaaaatggaaaaataaatttgaaacaagcacttacataatgaaataattatttatttggggagttataatggaaactattttgatatgcgcccgggttttgttgcatggttcacacacaaaaattctttatattttttcagtctttgatgatttctaataaaatgagaagagtttgttattgaacatcactttgcttttcttctttaattggctgcagaaatgccagttcccaaggagaaagcatttgccagtttctcttcagtgttttaattttccagttataagccatagctgccagatatttttctcctgtgaatatcaataatgtatgtttaactagatttacattttgtttcttttttattattgacatttttcataattagatgattgtggatttaacaataggaaaaaaaaggcaaactgtctttagtgttaacgtcaatccctgcctcagaacaggagtgcttcagagtaggggcattattccactcagcacatgagcatccgctcagcatcatatatgcaccaaagaagatgcactgcatgaggcaatccccttagcgcatatcctttcagatagatgagacaaatacacataactgcaaatgagaaagatacaaagtgttaaggaaacgtggcagaaagctttctgcaggtccacagttggattacattttccatggggggctatttcccagaatgtgtgccacttccatgactgctatacaaaccctccatgaatgtcctttgctgtccttttctgccagctggctgcagatgacagtgacaccctgggagttgagaaatgcttgtaagatggaaggaggctgtgtccctgaatgatcacctggaagagagccaccttagccaatgaaactcctgctatgaatgtttgctgagcaagaaatatacttactgctttatatgcctttgaagctataggttcatattgttaccacaatttaaagtgctataataaaaagagttcaggaagcaggcacatggaagcaataagagcaacaaacatttacacaggtattgtttaagtgcttttgtttaacaatcactatagctattagtagcctcattgtaataatgagtaaagcttagagattaaaaagtatttcttataacacagttatttgagaagactgcccagctgaaaacttggcctatctaattataaagaagagccagtgcatgttcctaaaatactagggtgatatgattagaataagctggcttatcaccacagatccacttaagggcaagttacaaataagtcgatgtttacaaaatcttgagagtccactgaggcatattaccatatgtttgccaggaaactctttttaattgtataggtaatattcacattatagaaacattttttaataaatagaaaaaatctttttcatcaacccacaatcttaatataatccttgtttgtattttgatgtacttctttctatactatttttctttttcttttctttttttttttttttttttttttgaggttgagtctcactctattgtccaggttggaatgcagtggcctgatctcggctcactgcaacctccatctcccgcgttcggtggattctcatgcctcagcctctggagtagctgggattacaggtgcctgccaccacacccagctaatttttgtatttttagtagagatggggtttcaccatgttggccatgctggtctcgaacacctgacctcaaatgatctgcctgcctcggcctcccaaagtgctgggattacaggcatgagccaccgtgcctggcccatactattttctatacatgtttttaactaggctataatcttattgtatgtacaattctgaattttgctcttttcacctgagtatatcacaatcattttccatgttattaaaaagttttcaaatgttttcagtataaaaaatcatatgtgccaattaaataaaattggatgaggaaaaaagtagggaaattttctctcttgcatccatcactcaagaagcaacgagaatgttctgctatttcactcaatattttgtcataacaatcttctaatgctttacataattttaaaaagctaacttttattagtaattgtaaaccaaatacaaattctatgcacgtagctgaagaacacagaaaagcacaaaggcaaaataaaatataatcttactactttaagataaacatttacagtattctattaacatatatgtatatgtgcatacattttaaaagatagtgtatcatatatattgttttgtagcattttttaaaaaaaattcagtattctatctgtaatggttaatttcatgtgtaacttggctaggctatagtgcccagttgtttggtcaaacactaaatgttgctgtgaaggtatcttttagaagtaatacttagaatcagttgacattaggtaaaagaggttacctttgatgatgtgggtgtaccttgtccgattagttgaaagcctaaagaacaaatgctgaggtttcctgcctgagtttccagcctaccatctggtattacaaattttaaacttaagattgcaacatcaatctttgcctgagtttctagcctcctggcctgttctacaaattttgaacttgccaactcttacaatcccatgagccaattccttaaaataaatctctctgtatttatatatgctttggagagccacagaatgatgttacaatatcgttaacattttctacctcagtattcttttacaagattttaatggcttcctaatgattaattaaatggtaatcatattaataagatcatagtattcaattgaatgatgttccatagtttacatatccattcctctactgttaacacctctaacaatttttttattgtggtagaatacatattaacaaaaaatttgccattaagtgtacaattcagaggcattatttacattcattatatggtgtagcataatcataatctatttccagaacttttgcatcaccctaaacagaaactgtaaccaccagatcatataccatagttgttttaagttgttaagttttgtaatattcattattccaaatagccatagataactgataccaaagttagtaccatgagtagggtgctactgaagaaaatgtaaagcaagtgtcattgtttttaggactggacagtgagtgatgctagaaaagtgatgaggtggcaattaggactgttggtgtgagaaaataactttttttttttttttttttttttttgagacagagtcttactctgtcacccaggctggagtgcagtggcacaatcttggctcactgcaagctctgcctcccaggttcatgtcattctcctgcctcagcctcccgatagctgagactacaggcatccgccaccacacccagctaattttttgtatttttagtagagatggggttttaccatgttagccaggatggtctcgatctcctaaactcatgatgtgcctgcttcagcctcccaaagtgctgggattacaggcgtgagccaccacgcatggctgagaaaataactttttgaggctggaaaagggtgacctgtgttatgtagtaggggaataactggcaaatatgtcacctgcagtaactggaagataggaaatgccatgttcctaatgaattcctgtgtctggctaaggagatctctagacaaaatgttgaaaaggccagttgggcagttctgtgtaggtatgacaatatgcacaatactataaagaagctatagagagaactgtttgatttgtaaacaaaattttgagaaaataaagaagagatagtacttgctgggttgaaaataaaactgtttctcatttaccacattttcagtctctccaactgacaaaaggttcttaaaagtaagaaatagcctcagggtaaagaaacataaaatcaaagttgtggctaggggacttctgatacctcagaaagatttaatgtcatgccagaccctcttagaagacaaaagggcttctaaaactcttaagagtgtcttcccaaagcaatccaacagaccaaaatttgaaagaagtctgtctcaaaaataagtatgtttatgaaatttggggcatagagtgaatcccacaaagttgtaagagagtcatatgaatgaaagcatggcccaattggactaaaaaggcaaaaacatttgaaaagaagcttccagaaccccaaatttttatgtaacgagagtagtctaagaaagctacttagctacagacatggtccatttcctgttgaaagatgtctcagaaggtggagctaagcatagagaacaacggattagagaatgacttccatggagcagaatgaagctcaaatctgtgttcctacagaatgggagaccccaacgacagctgatgactgggtttggaattactgtagagcagtgtggttgctatgtaactccttattctgtgcctttggaatgggagtgtctgttgggaatttcctgccctgtgtcttctgtttaacttgtgtttgtgagaggcagataacttggctattcagttctcaggtccctggaccatgaagggccacatccaaggagctaccccaggaggcctctcatttgcatttgtccccgctaatgcaggacagagatcatggaagttgggcccgactggatgagatttgggggtctttggaagtggagaatgtgtttgccctggggaagagaggtgatgtctaggagacctcttcactcagggcaagctctatgacctgctttgactccagaatgtggtagaagtggcatcacataaattgcagagcctaggcttcaagagaccttgcaacttgcctctcactgacttgaagtgctcccatcagagcatcttgtaaggagcaggtggagcatgtggacaagccatccccaccagcccctgagacatgtgagagaggccagaacaggccatccggaccccactgtgctggtggatgagacagcagaaggaatatcaacctaccaacagaatcctgagaaatgctcactcttacttcaagctgctgcattttgatgttatgaaaccataaataacttatgaagtcatctttgctgacttaaagttttccataactttattataacatatcaaaattatgaaaaatgtgaaaagtagaaaactgatgaattttgcttcttcatatggtctttaagaatctcaaaggcactgaagttttttatcttttctgtcttagaataaaaaaccttgaatgaaaatctgcttcttggaaaagcagcaaggtttatgcagaggcaatctggtatttgtgtgcactggcagctgatcatacccagcatgcacgcactctcagggcagagtctgatgccccacataatggggcatggtaaggactcccatgtccttgagataaaatgataaggaaaatacacactgctattagaataacaggcccagcttctgcacattttaattcccaaagttttcatgaaagacaatgattttttggtaccatgtttaactctacaagaatcagtagtgaaaactaaaaatgatactttgtgaaagttcattaattttgttttcagccagtggtggccttggtcagatagaatcaaatctatgatactttttatcagaaatgcttatactgtgtacaaacccaaagtgatggctttcaaagattgaatttgattattttctgtatggtgcagatgaaaaattactacacaggagaaggtgggttggaggtgctcacgagtaaccaggaaacagtctgaagtttttctgatacttctccttggtccaaccaaatgtgagatataaacacaaacttgggattccgttcttatgttttggttgtttcagtctttacagatgtatcgaaaggctgtccaaaaatgtctgacttctgtagtgtgccttcgtagcactagagggttctgcagctgtgaaactgaaggcattggcaagaagccctccatcttcaaaccactttctgctaaggtgtggctctataaaaccactatgagctgggcttcactgagactgagttgtttcagtaggatcttccggaaaaacatgttccctcctttacctgggttgtcattctgagaacaatcacacctccaattttggcttactaagcaatagcgttttaatgattttaagccaggatttgctcctcctttcctcagtatgagagcttaaccactggaggaaccaagaattcatgctggttgggttctgattccactttaacttactgtatagcctcatcccttgtttttctggagattctctttttctgcttcactgatttatatttacattaaaatcaaatgaggccatgtttctgaaatcacattgtccctacatggtcattacaatgagtctgtaatgtgactgaaagacagccatggatacaggtagaggatatcaggcaattgaatgctcatcaagcattcaattcagggcaaatggcataaggtatgcagttggcctcttctgatatctgtgtcttaatcctttctttagcctctgttttctggaccaaggctaagatattttctgggcacagtggctcatgcctataatcccagcactctgggaggccaaggtgggaggatttcttcagcccaggagttcgagaccagcctggggaacataggagacctcattcctacaaataataaaaaaaattagccagctctggtggcgtgtgcttattggtctcagctacttgggaggctgaggtgggaggactgcttgagcccagaagatcgcagctgcattgagccatgattgtgccactgaaccctagcctgagcaacagagcaaggccttatctcaaaaaaaaaaaaaaattctgagccttctaattttttttttctttaattaactttctgtaagcccagcaagtaaataaaacacttattttatgaagcatctagttgcttttaggggaagggacatcctccgcatagtatctaggccagctcactttcttctccttactgttgatttactctctgccattgaatcttctgtgccaatgttggattaatgtttccgggccctactttcatcatgctcctctgtattatcacctgttttggtttacagcaatgatttttaaggtaaggcatggtgtgtccatcatagtcacatgggaactttttcaagccatattaaaaatgtcccccattcatcattctgcccctggaacagtgtgtgcagttgggaccttcaagtaaatctactttgttgaaacccactgatcagcatggtgtatttcataactctttgacttacattcaagaaattccttaacctgaactccattttactctttttttcattcattcaaattaagaatattgcctgaacatgaattatctgctagacgtttttctaggtgcaggaggagtaaggatgaacataactagccataactatagctatcaattgtggagtgtctgttatgtgccaggcacttttaagtgacctactcgatttacttgcatgacaaactgtgaggaaaagcccaatattatcccctattaacagatgaggaaactgaagcacaaacagcatgaatagtttgttccagattgcatcataagaggcacagccagctttcctaccaaagcagccctggcccagagtccgtactccctcctcccctgcctctgcctggtggataaggtcaccctggccttgtggaacttatgctctagtggggacaaatagttatagagaatgaccgatgttactaagaaaataaaagctggtaagaaaacagaagcactgaggaggtgactgaagtgagcatttataattttatgttatatccattgtaaaatataagtttagctttctcataccagaagcagggctcagtccacccttgactcagtttccaatactgttccccatcagaatggctcttgctggtggccagaagtaaaacttagaaatatctctctcagagacacctaagcaggctgggctccccggtttcctgttgcttcctttaaagaagctcttcagacatctgcacaagaactcaaagtgaccacctctcagcccagcatgacctactggaactaatgcctgcttgctttcaacctaccaattaaagctccccaggaaacctgtttagataacaccctggacccaagaaaggtgctgggccatgggtttcttctctctctccctatctgtgctccctgaccccctgtgtgtgtgtggtctctaggcttgccttctatccctgagggtctgtaaatactaaaaacacttaaactttcatattgtagttgtgtctttgaagccaggtccccatcccgtaccttgagggcaaggcctcctggaagggacccatgtaggtggatcccctgctgtccaggcctcttagctgctggggtagtgaccagttaagtggatagagtttcattcaaaacaataatcattcaactgtatctcacatcaaacctctgctctagtttatgtatctactttatgttcttagaagactgtgcaaacacattgtcttttttgagtacctgtcttgtcctaggtactctgcttggtacggggagagacgaatcttctgtcttcaggggcttccactccagcagggagaacatgactaatagtgactgcctgctgctgtaggtaataagtggctcccactaggccctccatttggtggccccctgtccctctcactggtggaagcctacctgtcctctaaggaccagctcactaatgtcctagatcctcacggaccagattgcttttctcagaactgaagagcacttactaatggcacctcttgtcatatgccatcccaggatttgaattttttttttttttctgtcttgtggcccaaataaatcctgaactcctcgagggctgggagtgtatctagcagtttccttatactggactaatcagatgctgactaggtagcagtgagaaaaatctagaaattcccttttagccacatcgacttacacgaggggatgtgtgtaaggtactatagctctttaaacaagaggtggtctcgtttgaagggtggattgatgtgggtgttcaaatgatgtcacaagtggctggtttctctgtctccatttcttttttttttggctccatttccaaatttcccagatagcacagcaagttggccccagcagctctagacactccatcttctcagggcatagccaacacaataaaatatttcaagttcctgaaagatagctgaaataagccctagaagtttctggattgggagcagagccaaacctgccagctcacatagatgagggcagggaatagggtgtctcacgatcacagtgtcctgccttctgatttgcctgggactgtcctgttttggcaccaaaaatatctgcatcctaggaaaccctcaggtcctgggcaaattcagacagtgacttgccctatcagaagcaaagcaaggtgccattacctgaggtgggcaaattcagacagtgacttgccctatcagaagcaaagcaaggttgccattacctgaggtgggcaaatggaggctgggtggccagtgagtgaccaataaccccagcattggagagagtggagcagcccttcaagaagttccaacctctgcccaggactggttttaccaacttcactaggcttagaatcgtaggaagtctatttgggacttgcgagtctcacgtattcctgcctaaatgtttatggatacctgtttagagctgaaatcttttcagctcccataatatgagggaattaggtctcaaagaagatcatgtattttgatcagaccttatagctgagcagtggaaagaaaaaaaatcagtgtgagatctcccagggttccgcaggagtggcttccttagtccaactggcagcctatcctggaatattgcctgggagagaggttagttgcttttcctggtgctaggaactgaatggttttacatattgatcaatgaaaatacttatttggcctacaataggtgcaaaaatactgctaattactaacagtatctcttctttgctgcgtgccagacactccactgggcattatgcagttaatatgtaccatgaatttcccgtggttagcaatgatgtcaggcatagaaaagacatgaaattatgatgtcaaatgaataaactggaaaaaggaatttcttgaattttctccagctgtcctaagaatgtatctatactttgatcctggcctaccttttcaacatctaaactttattcccccaagcttctagatattcaaagttaagtattaaataaaatcagtaaatatatacaagcttgtttggccattctgaataaggttatatttccaccacacaatctccaaattctctagcagaagggatcagtatgttatagataccccctttccttccctccctggcaagccaccacatctgttatgggtactcaatgcagtggctgcacctgggcctcactcattaagcagttgttgattgagtgactgaattgaatgcctgatgagctcgcaagtaagattcagactgtgcctgcaaactaataggatccctccgctttttattcactactgctgaggtagatctcaggccagcctgaagtttaggtctactgagaaataataagcctcaaaaatcgagctttgcttcacccagtctcccagtaaacactaagaaatgttcacattatttacacatcctagactgcctgtcttatggaccaaatgtttgtgttctccccgcaatttatacattggaatcctaaccctcaatgtaatagcattaggtgctggggtctttgggaggtgattggctaatggacctggagccctcatgatgggatgagtccccttatcagaagagacctgagaaggcttgcttcctctccctgtgctcttcatgatgtgaagacacaagaagacagccatctgtgggccaggaagaggtcctcactggaacccaaccatgctggcaccccaatcttgaatttctagcttcaagaacttgggaaataaatgtaagccagccagcttatggatttgttacagcagcctaagctaagtcagagtctctagaacagctggtctggggcagcggtgaagggaggtgggtgggcatatgaccctgccctgcacatgaatggcaaaggcaactggagagcctctcccttttggtgagatccccagtccacaagggcatgttcatccatagctttacttcccgaagcaaattctggttcctggggcctgtgcctccatagatggcatgatctgcagcctcctgtggtaatttaccctcttcctaaatttctgagtcttcacatttaagcaatcctagttagatatcctctacctgtatccatggctgtctttcagtcacattacagactcattgtgatgaccatgtagggacaatgtgatttcagaaacatggcctcatttgattttaatgtaaatataaatcagtgaagcagaaaaagagaatctccagaaaaacaagggatgaggctgtacagcaagttaaagtggaatcagaacccaactgtagtccattatttgtttcaatcctgctcttttctaccatatcacccagtttccaaatcgttcagcaaattgccatggtcaatgggattaacctttcccttttattctcaggaaatctcccttgtccattttgcaagactgtgtgattctttctactgttacaaggaataaaagccttcctaaaaaggtctttggtgcctttattattttacggatcatttctgagggaattattgaacttcattatgtaaccaccccttgggttcaccttgcccactgcctagacagagccaatttatccagacaggagaattgcaatggagaaagagtaattcatgcagaactggctgtgtgggagactggagttttattattactcaaatcagtctccccaagcattcagggatcagagtttttgaacataatttggtgggtaggggcttggaaagtggggagtaatgatttgtcagtttgggtatgtaatcataggtggtcgaagtgagtttctcttgctgtcttccattcctgggtgggatggcagaactagttgagccagattactggtctgggcggtgtcagctgatctaacaagtgcagggtctgcaaaatatctcaagcgctgatcttaggttttacaatagtgatgttatacccaggagcaatttggggcggttcagactcttggagccatatgctgcatgaccctgaatctgtaatttctaatcttgtagctaatttgttagtcctgcagaggcagactggcccccaggcaagaagggggtcttttcaggaaagggctgctatcaattttgtttcagagtcaaaccatgaactgaattccttcccaaagttagttcagcctatgcccaggaatgaacaaggacagcttaaaggttagaagcaagatggagtcagttaggtctgatttctttcactgtcatgatttcttcagttataattttgcaaaggtggtttcacttagtctcagagatggttggggctgcttcagcatgggatgcatgaaaggtgctcagctgtgggttggagcaggggcctccactgttctgctcttagctcctggtttagggaggagcccactgacagttgctggatggatggctgctttgcttctggacttcacagctggttttgtgcacagagtttgtgtttaggggttaacttcctcttgtcctcacatttccctgaagaaagtagaaattttgctcctctcctgggtgtgagtatcatggtgcagatgggggcagttttagagtaaacatttttagttttgcgccctaatgaccttaccctcaggcatagatgatccgactgctttcattgcaaagaagctgctaattggctagctcaatttttgcgcttgttgccttcaaagtatatgaaaaaggcaacgtgcaccagcctctttccctggcttcctccttaatgtgtgtgcatctggaggccgcaagactcctgcttctagcaggctccttgtgatacacagagttctcgtgccctacctcaggcctcctcagggcccagggctgcattttccagcagctccctgcccttcagcaaccaggcacctctggttcagagccccaggagtaggcttggaattcaaagaggaagagattggaagccctgttttagcttcaggcctgtgttctatctttcaaacaagctttattgggaaactctgtaatttagtagttctcccgccattactattatttcctatttggcttctgtgtctagtccacactccttagagcacggaagggagcaggtgtgagggattggccatccaaccctatccaagtttggatttctgttaactcattctcttggttttgaacccccagcctggtagcctttggttgcaggcaatctctcctcgtaaaacatgagagtgtttttttttgtttttgtttgtttttgtttttcctgataagggaagactgccactttctcaagctctctgcttcaccaagttctgacagccttcccattcaagtgtaacttattcatatcactcaaatatttgctcagttgtgctgccagcatgcaggatatcagagacctggtaagacagttggctgcatggtgctgtctcctgctatagaaatagttatggacagtcattctcccctggccagggagctgtgagtatttctggtgacttcatgacttcctatggtggcaaagccatatggtatttcatttgaagtgtcaagacttcctcagtgctgcccaggggaatgtcaggcaactgacaagaaaataggtaacacattaccaacatcaatagtaaaaaaagaagatacaattaaactttactaataactttatgccagttactttattgactaaagtggataaactccttaaaaaacgcagattagcaaaactgactatgaagtaacagaaaatttaaaaagcccgaatttatgagagaaattgtatttgtaatgagaactctatccacaaagaaaatttggggctcagatggcttcaggctgtattctgtgaaggaacaaataatactaatattacacacaatctttcagaaaatgaaggagaaatgaaaccttcaaaatgtattttatgaggctagtatacccttaatgccccaaattgacaaaggtataagaaatgaaaattacataacaatgtccctatattagcaaataaaaattagcattatccatatgatattagcaaatcaaatacagcaagagataaaaagggtgatatatcctgacaagacggatttatcacaggaatgtaagattgatttaatgtatgacaatcaatcaatgtaattcaccacgtactttccatatgataatttcaatagatgtccaaaaaatatttgaaaaaacccaacaccttacaaacaaattaggaatatttaggaataaatataaataaaatgtgagatctctatttttgaaattggaaaacattgctgagatatattaaaaatttaaacaaatagagatatactaccatatttatgattgaaagtttctgtattattagtatatccctgcttcctaaattgatttatagattcaactcagtctctataaaatcatagcagacatttatgaagaaattggtaagctcatgctgaagtgttttatggaaatgcaaaggatcttgaacagccaaaataattctaaaaaagaacaaagttggaggactcctactgcatgatttcaagatttactttgaagctacagtagtcaagagtgtgagatatttgtgtagggagagacacataggtcaggggtggagaatagaaagttgtagattagatctacaacatgtagttaattgatattcaaaagatatgaacacacactttacaaaaaaatgaatgtccaataaatacataggaacatgctcaacacaatcttcaagaaattgtaaatcagtacaataatgagataaaattccacatcagctagaatagctaaaatcaaaaagattgacagtactaattgtgggtactctcaattgtgggtattcttggacattgtaaaaaggtccaaacactttagggaattgttttgacattttcttatcaaattaaacataatctaaaccacgatccagaaattccactaacataagtatttactcaagagtaatacacattgatgtgtacaaaaagacttgtttgaaaaatttttatagcagccttattcactatagccccaaactggaaacaaccgaaatagctatcaataggataatggataaacaaattgaggtctattcatacaatggagcaatactcatcaataaaggctgagaagtcttgacacagacaaatctcaaaaacatgatattgagcaaaaggagccagaaaaaagtgtgctctatgtgaacctatttatacaacttcatagaacaggcaacattaatctacagtggcaaaaatcagagcagtggttgtgatagatgcaggaggcagataaaggcctaggcagatagggaagagcccccggagaaacttcaaccttccccacaaatatttacaccagatgttttgtgcagataagggaagctgcacagggagctttcctgggcatgcccacagcagactggagacc

SEQ ID NO: 2593 - DNA, 36811 bp, Homo sapiens
aaacagcagagaaagaactggccgagcgagggggacggggagccggggcgccagagctagagacagcgggcgggcaaggagctggcagaggcgctggcattttgaaagcgaagcagaagccgtagaatcagcggcgagcctgttgaaagaacccacaggtgcatttcacagcactctgggcgaaaattggatgtgaaaatgaagccagaccgaggtaaatgatttgtttaagtagggcttgttcccccacccccttcttttctatgcctcaatttagaagtgttaacctaattctgcagtaggatcaactatttctgtatcatatgtgattatctgtttttgtgacagattccagctggtgaggtagagaaaggcatatggaagagaaggttaagcgtttttacaaaagtgcttctgaagcactagcttcaagagagattctagtgtatctcaaaatgaaagtaaagaatggtatttgtatctgttgccacaatacaggtatcattttagagttgtacttgctcgtttttaggtagtcaatctaacttcaactttcaagaagttcataagctttttaaacttgaatgtgaacttgataaaatgaagagaaaacttaagcttgagttgacaactgttattttattactactttgattagttgatttttgtgctttaagcaaactccaaaagtttgcagagtactccagtattcaatataccagcatatggacagtttgggccactgaaatccctggtgataagtaaatgtcacttcttttctaaacctgtattttcaggatttataagaataatatatacactgcttttcaaggacttcaaggtaattctttatcagtcttctgattaatggcaagaaccaattttagaagatgttaatatagtagtggttagtagtgagagcttttcagtcagatatgagtttgattccaaggaacattgtgaagtggggattattttatttggtagggggctggactagatgacagatttccttccaaatccaagtctttaggattggaaatgttaatttatcctacgaattagatgcttattttaaaatttatatatattaaactggttgtttttccatatattttttcaaagtgattagacaaattttctgggtaaaataggtctattgaaatgcaccagaaggaattggagaaaaccatacttaatttagtgatttaaattagttttaggtgttggctattacatacaatcaggcagcagctatgtatgtatcaagtattagtaagtgtattgctcctgagcaggttccttgtgtagaatgccaagtttagatttttagattacatcaatcactttggaaaaatggcaccaaggttagtaattgattctcagaataaacaagcaaataaaatcaaagtcactatttattttgaattgttgtgaaaagttgctttacagtcataagcagttttaaaaatagtatttgcagccaaaactagtgttaaacacaataaaatgtttagttacgtactgatatagatttttaggggaaacaaatttattcatcaagatttccaaagaagttttcaccttaaaaattgtagctttctttagcattctcaggtaaagatgatgggattgtgagtttagtattgtgattatattccataataataacataaacctttagacccatggctttttttttcttttactaaaaccagtgtaagtaatcttttacttagcaaactagtacagaaatattgaaataagcttttcacaaacgtacttacccttactgtgcgcaatgtaatgttgtattttctattctatttcacgttttgaaaaattgctgtcaccacccattgaattgatttcttcaccaattaatgggtcatgatgacctgcaatttgaaaggcagagttatggacaactcttaacgagaaaacagttacacttcatttttttttttaaactacattggtgtccaaagaactatcctatataaatgaattttctggataattgaaactttttaaacgtcaaaatatttttagttgtaatcatgatatgtggagacatttaaaaaatgttcacgcttctggtttgagatttttttgtctctagtttaaaccatctcagcctatctttttttattctgatttttatgttccctggctgtcaacagtttttgttgttaatatatttatccttgtcaccttttaattttcctgcttttagtctctgagctagataattagataaccgtacttaacactaagttttctctctttttttttctttttcttttttttttttgagacggagtctcgctctgtcgcccaggctggagtgcagtggcgcaatctccgctcactgcaagctccgcctcccgggttcacgccattctcctgcctcagccttcggtagctgggattacaggcgcccgcctccacgcccggctaattttttgtatttttagtagagacagggtttcaccgtgtaagccaggatagtctcgatctcctgagctcgtgatccgcccgcctcggcctcccagtgtgctgggattacaggcgtgagccaccgcgcccggcctaacactaagttttctataagatgaacataaataggagaacttctcagatgctcattcagagtgtgagtaaagtgtggattttaatgtagagactcagattatagttttgtgaaagacagctgtgcttcaaagagttaaagtttctaaataaatacaatagcctcttatcgtacatgattgggtgtggtagttggttggctaactgtaaaagtttaaggtgggggtcaggaaaaatgccttaattctttttctattggctgtttttatggaaggtgtggggagcattggtcaattctgctccctacagcctccataaaaacaaactgatagccaatagaaaaaaattatctgaaggtcaggagtttctactgtactttgaaataagatgttatggtatagcatgatagatttcacaatagtcgatagtattttactgtacgatagtattttactgtactgtaaaaaaaattaattttaagcaataatataacattacttgggtaacactgccaaagatgagtcttagatgttgtcattagcagacctgtgtttttatacttgttccattacttgcttgctctctaatcttcatcacataatctctgagagtctcagtttccttgtctgtaaaatgggaataattccaacttctcacagttagaatgaaatatgaccgtgcttggcacatagcagatattaaataaataatatcgtttattatgttaaataaacattacaaatgcttatatattggttatataagcttatatataagcattacaaatgcttatatactggttatataagcttatatataagcattacaaatgcttatatattggtcaattacaagatatactcaacaaaggtaaataaataatgaaatgtttaataacctaatgctattttgttctgttttgcattgatagtgttcaaactgctaaggctcgagcagattaataattttttaatatatagttatctgagaaaatataaaagctacagaaggatacttgcagtatatgtataatgtatttatattgtcatttgctattacaattatggcttctatatgtagaggatgacatgggtggactaagctttctggaataattagatttttaagtgatgttaacagctgactagagctgggcagctggaaaatttaatgttattccacctttgactcaaggatgtacaagtttggacctggttctagacctgtgtgtatattgaatacctggtgtttcaagagaagtctaaggtgtggtccacggcctgttgcggtggctcatgcctgtgatcccagcactttgggagcccgaggagggttgattgcttagagcttagaagttcgagaccaccctgggcaacataacaagaccctatctctatttaaaaataaataaaatgtggtcttagtgtagaggtaattaaaaacatattaggttatgttctaaatgtatttctaattttgtatttttaatatctgagcttaatcaaaactgctatgaaagattaagacctataaaataaatcataaattagtaatttaaatctactgttttaattcatatttaaaaacattgtaggctgttgatctttaagttaaaactagtagtgcaaaatctgttccacaaacaaaacaccacactattttgtggtttttgtttttgaggttaaaatagagaagtgcttagttttttcctccatttggctatattacaaatttagacattagccttagaatttcagtggcttatgaacttaactatagcataatgcaaccctgttaacctcaaacaattcactcctgggcaggtgaaataggaaagaagtgttaaggactagaaaaatgtagcaaagcaattaggtgcattgcttgctaagaatagttcattgttagttgatgtaaatcaaacaaaagaaatggcagatgttggagaagaaatactgactagattaaataaagcggccttttgctaaattcccaggtagaggtggtcatgatagtatgagtagcaacagctaatacttgttcatactatgtgccaggcactgtcttaagtacttcacatatataactcatttaatcctcacagatactcaaggaaatagatgctattgtcatctctgttttatggataaacgaaactgagtcatagagaagtttggtaacttacccaaggttacacagctaataaaagggcaagctcaaatgtgaagtgaacttgagcatatgctcttaagctccctgactggtagcagtaagtaatgttaaaataccataagattttgggaccaaagtggtttaaaaatacttgaggaaaactccaaacaggtatttggtaagtattgtgatcttggaaagctgcttgtcctctctgcctcagctttatctttacaatagggaaagtaatagtacctcagctcatggttattttgaggattaaataagttaatgtgtgtaatatgcttaaaacagtggctggcacttagcattcaaatgtaaactgctattatttttggacattttctaaagaagaaaccagtcagttagtgaaagctgaggaagacaaaagggggctaattcagctgcatgttttgtatattcagtgtgatcacaagttaaaagctggctactgttgttctttcatccatttatgttgatgagtcttggcatcagtagctgtcaaataatcaatggcttgatacaacttctgagattcagatactaaaggggttgacgtagagataccccatctatgtttttgcctgtcatccagtaagaaggaaatgattcagtggactaaaccctgtcatttctttgaagaatgagaaaaaaaagataattggaaggcagaactgaaaggcaaatgtgtatataaggagagtgacttaaaaattgattttctcttcaagaactgaagaaacccatggggtctgagccttctgcattgtgaacaaatatagaaaaaaattagttgttaaagaatatttatattcttttgcctttctcgcctttggatctaattatgaaaatgttttcaccctttttgaggctggggattttaaaaactggaaatattaaactcagactaacaatactggtttttttttttttggataatgaaaaggcaaaattgtagtacttggaaacagtacttcttagtaggtaaaccaaagtcaatttgttaatagttaattctatctttgctcaaataggtgaaaaatcagaagagttcctcatgttagactttttctttttctttttcatgggatggggtcttactgtgtcactcagactggagtacagtgatgcaatcataattcactgtagcctccaactcctgggatcaagagatcatcctgcttaagcttccagagtagctgggactacaggtgcacgccactatgcctggctaattgtcttttttttttttttttttttttgagaaatggggtctcactatgttgcccagactgttctcattctcctgggctcaagcagccctcctggctcagcctctcaaagtgctgggattacaggtgtgaggaattgcacctggcccagactcttattaaagtaaaacaggatggaataggtaaaaaatgccagcagataatcaaaatattagcctaagagcccatgtgtaataccacaattcctagcaataatttgagttgagctttctcatattttcctttccatgtaaaagatactcatctcttccccttgtttaccatatccagccccactagctgccttttaggtttttgattaccacttaggatctggtatgcgaaattccttctgcctaaaaagcctttctccccagtcatcacattggtgtctccttgttgttcttttgttatagaacttaaccgtcattttttcagagaggttttctctcactaccctatccaaagtgctcagtgaatgttaattgctgtcatttattaaatgagatgtcccttgttattctttgtctgagcagcctgtatttccttcatagcattgaccacattttgtaatttcttttgtttattgtctgtctctacagctagattttaagttttgtgagtccggaaaccttgtctcttattcacacctgtattcccatcatttagtaggcagtcttgtacatggtaggtgcataggtgtttaatacatatttgttaaatgaaagaatgacttgtatgtctcagtatttgtggagcagataggaataggagcagctgggtagcaatatttgattgttttactgataccagctgaacttctgccaatttagggattggtttgaattaatgactgttaggctgttatcacaattttatacttaattttttgaaaatacagttaaggatactatccataacttaaataaaggttatatttcttaattaatcatatcttattgaattaaaacactataaaatatcttaaaagtaggcaaaagccatttagtgacaatggtttccagtttatatacgtctaacaaatgattcatacacagacatttgctagaagctctctgatgtccaccccctgtgctgaatttgctcctattgctgtttctgagagagagggagaatgtctgtatgttcaaattggtaaacctcaggtttatgaatataagaaagtacaagtcggatagactaatggaaaaaaaactcaaaggatttagagtttagatttgggacccattcttggattaagtcccaaacctgtttacttatctgtaagatgtagctggctaagggtgttgcttctgagcttcaactaagataatatgtcaaagaacatagtaagccatgagatgctatataaatgtggactaatttactctgtgggcaggattatttgtatagatgtgcaaagggccaggtcttcccaaatacagccagctgcatcttagttggtgctattcacacagtatgaggattttattacttttagtttcctcttgctatcctgacagaaattataccaactagagattcacttggattaataaatgtatacttagttatacatttttcgaggactgttgaaatgatggtcatattttagtttaaatggtttccttttagcagcgtactataatgcaagaaaagttaagacactaagcttttaggatcaaatttggattgaaattctaacttcggaacttaccagccaaattaccttgaaaaaattacatagcctttctgaacaacggttttgttttttgctctaataccgtcaaccttaagccttgtgggaaaggtaaactgagaacatatggtttggcacttaacatacgcctagcactgggtagggattgctaaatggtttcctctgctaacaagaatacacagcttggaacagctgcactgaggaaatgagtgtttcagaactccgttttgaaaactggttggaacaagcatgaaagatcaatggacacttatgtcactgtcaaccttgtcttctgaaatatacaataacatagaaaaaagtcaaaaccagcattgaactacccaatctttaatgcaaatgcaatggagagggaaagtaggcaaattggaacacagcccactatttctgggtgatagtagaccctaatgaacagtttagagcagcatcagggcagagagtgaggcagaggtgggaactagaaagaggctgatggaaaatagagtggtgagatgttgcccaaaactgcttttttctttgtttcagagtattacctaggattgattcagtgcttggagcatggcccttctgcttccatgacccagaatttagatttgttccatgatgctgcaagatggccattataggttaagaaacctttggtagactcttctgggaatctaatcataactcatattgcttgtcagtaatatttaagcctaaataatggtcagacttaaacatatcccctttgggaacatgaccaatctgtatttgggaataaacaatatttaaagttttcatattttggtttcccacttaaccaaatgtatattcctgaatggaattaatttagcgtcagtatctgaaattaggctatttgtaaaactttatcctaacatctagaaagtgcatttacatttttcatcaaattagcaattttcttttgtgaagagagatcatggtttgtgagagagatcattggccatttctacttaaatttataacagtaagagaatgtataattttagcccttgatattggcaaacttctttttgtttattttggtcttaaaataactttaaaggtctatatcatatttggtgtgtttgacagaaggatgctgatatacaaaaaattattcattttatgaaagaactaaccataggatttctctaagttaccctactttgcttgctctacaattattataattaaaaatttcaggccaggcgcggtggctcacgcctgtaatcccagcactttggaaggctgaggtgggcggatcacaagatcaggagatcgagaccatcctggctaacaatggtgaaaccccatctctactaaaaaaatacaaaaaaattagctgggtgtggtggcaggcgcctgtaatctcagctactctaggactgaggcaggacagtgaggcaggagaatggcgtgaaccggggaggcggagcttgcagtgagccgagattgcaccactgcactcaagcctgggtgacagagtgagtctccgtctcaaaaaaaaaaaaaaaatttcaaacccacagaaaagttgaaatactacaattaacatccatttaccttttcatagattaattgtgaccattttacaacttttgttttatctccatataagtaggtgggatgggtgggtgggctagatagacatggagttttgttgtctgtttttttctatttttaatgcaaagcctttttgtttatttcaaactggtacttttttcagttgacacattgcaattgtatatatttatgaagtccagtatgatgttccaatacatatatatgttgtgtaaataattaaatcagggtatttagcatatctttcacctcatgcacttatgatttccttgtgggtgggaacattcaaaagcctcttctagctattttataatatataatactttagggttatccttagtcatcctactatgcagtagaacaccagaatttattcctcctatctaactgtaattttgtatctgttgatcaacctcttcctattctctccttccccttacccagtttctggaaaccactgttctactcgctacttctatgataacagcttttttttaagattccacataagtgagatcatgcagtatgtgtctttctgtgtctggctgattttactgaacacgatgtcctccaggttcatttatgttgttgcaaatgacagtattttattccttttgtggctctatagtattccattatgtgtgtgcgcacgtgtgtgtaccacattttctttatggacacagattgattccatatcttggctattgtgaataatactgcaataaatatgggagtacagatatctcttcaacatgctgatttcatttcctttgggtatatatgcccagtagcggaactgctggatgatatggtagttctgtctctgatattttgaggaatgtctatactgttttccgtaatggctgtaataacttacagtctcaaccatgtgtaactgttcccttttctccacatccttgccaacacttgttttcttttgtctttcttttgtctccagccattctaaccggagtaaggttttatctcattgtggttttgatttgcatttctctggttattagtaatgttgaacatgttttcatatacctgttggccacttgtgtaagttgcagatgtcttgacacttcagccccagatacaacatgtatccagcagtatgctacagctggcaggtactggcttgcaaaagccgattgtgtatatttcatttcaactcttcacctagttggttacttgaaatcagccatggtaatggtatttataccatggaaattggcagtgctacaaaccaaggccttttttcctctctgagccagccgttaaacatttacggccataccactgcatgtgtcttctaaaaataaaagtattcttctgtatacctgcaatacagttactgcattcaatctaatacttacatagtactaatatctaatatacagtttatactcatattttcctagttgttccaataacatctttagtcacattgccttttaaagttgtacattgcttccttttacagaaatggagttagaccctgatgttagacaacatttacaaaagttttggagtatgccataagaatatgataaaaaattagatcatgtaaatagaacagctaattaatattttagtagatttttcctctagcttttaagtatttaggcaaaatggattaaagagaaaagtgaatattgttgaaatcccagattttattccattgataacacattaaacaattatatttttaaacctaaagtctcaggctgactgacctcatttcctggtgatttccaaggttccctgcagtctagccatattagtcctgttattcttcagtcactacaagcacatttgacactttggggcctttatatttgatatcttcgctcagaatataagtctcctggctcttttttttttttaacttggctttctgccatcaaagaagccttctcggaccatccttcaaagagtacagctaattcattctccctttactctgcgttactctcttcatagtccttacattgtttaatctggtattctgtgtttatttcttttcccctctccccaacaggaatataagcttcatgagggcagggaagggatttagtggcatttgttcactgctgcatttccccatacacagacaggtacctggcatttagtggctcttcaataaatgtttagtgttgaatgaacacttggcatgcattttaatatctttgtggtgtagcataaaacttattacttgacaacgttatgcattctcttttctgagatttgttagtttagtaaccctaagatctaattctccagtgtcaagttttttgcttctaaatggaaatgtttatgcccacttcacaaggttattgggggatcaaatgagatgttatacatgaactccctatatacaagatagagtgctatgtaaatataagtagttgttcattctctaagcatttatgtttacttatcaggtattgtgcgaggttctggaaacatacagatgaataagtcagcagggtactgtgtgtgagtctggggggcaactagaaaaattcttgactcctttggaaatgtctcttgctaatgtagtgtttgtagtttgaggaatcatggcctcagatatattggttccctaaactaagacattaacatccttcaaagtcttatgaaatagtagggaatttttcttctatcctcttaaaaattacactagtaatatgagtctgtcaaagaagtacaaaatttagataagctaaaagaaaaggagaaaatacccaatagtaatgctcctattctgtgattagacagttcatgttttgggtgccagggcggggtgtgtgtttttccttctagtctgtaaatgtacgtacatattaatagtatattttttaattaaaccatatatactgtttaggaaactttttttacctaatgtaatttgtatattttcatgtcattaaatattcttcccttatggtatatttaatggtcgtatagctaacttttgcatgcctgtgtcatttggccaatttatacttcttaatgttttaatttttaactgtggtaaaatgtggataacataaaatttatcttcctaaccattttcatgtgtacaagctttttgttggatacttaagcttcaagttttggctagtataaacagcactgtaatgaacattcctttaacttaaatcctggtgtatttccttatcttttccagacgaagttctaaaagtagaattacttgatcaaagtatatacaaacattttttgattattgtaaaaatcacattttttgattatggtaaaaaaaaaagtgccaatttttggtcaccaacagtatatgagaagaaaaattgtatttcccctacttgacactcttgttagctttaatgtatgagcaaaactcacacaaatgattccaaatttgatttcgctttcttatagatattcttgaaagaaaatgactaattactatctgatttgtatcttgttttccttcacgtacaaatagtagacatcttttcattctccaacattatatgcccaagctaaattctaactaaaatcttcagtctcccctcacccccgtaatttcaacttttattttagattcagggggtacacatgcagattcattacatcagcgtattttgtgatgcttgggttttgggatacagatgatcccatcacccaggtggtgagcatagtacccataggtattttttcagtctgtacctgcctccctccattcccctcgtagtccccagtgtctattgttcccacttctatgtccatgtatactcagtgtttactcccatttacaagtgagaacgtgcaatatttggttttctgaacaatagtttttttcttttggacaatttctagctggtattccttcccctgcacccccccacccccaacacccagagatagggtttcctctgttgcccaagctggagtgcagtggcatgatcataggtcactacacccttgaactcctgggctcaagtaatccctccacctcagcctcccaagcaactaaaactataggcgcacaccaccctgcccaggtaacttttaaattttttgtagagactggtcttgctatgttgccgaggtctggaactcctgtccttgagcagtcctcctgcctcagcttccccaagtgctgagattacaggcgtaagccaccatgcgcacactctagatggtattcttgatttgactttcaggaattgttgtgtggcaattagggcagtggaaagaacatgggtttggagctggacaactcattgttcagacatcaacattattactagctgggtgagtttagtaaagttaaactctccatgtcttaattgcccggaaatctgtaaaaatgggaatagcaattcttttctcaaggtttctgcgaggattgaaagaaatagtacatgttagcatacagctcaatgcctgggcacaaagtgggcaccagctttctacgaaaacaagttgtcacgctgaggatacagggccagtattccctaaatctcctttttccaactaggattctagaactgtaactataataaagtttactaacagtagtacttagatctagaaaatctatggggtataatgtctaaagtctttagtgctgtgtaaagagcaaatgagaatttgctgtcatgacagttgtgctcaactgcagatgctgtcagtccatggtttcctactttagtaaggactgagcacaaggcagagtggccttctgtgaagttaaactctggcatcgatttcctttgttgattcaacagtgtttcagcttactctaattttggataaaaagaaacttatgcctgctctggatggatagaattcaaatttgctctgcaatgaatttgaatttttgtggcattcattttatgtagatacgtatatctatttcaactacaatatttcccaacttttttgatatctcactaaggaaagttttgattaccgaggtgggaagattgcttgagcccaggagttcaagatgagcctgggtgacatagggagaccccatctctacaaaaaaacttaaaaaaaaaattagctgggcttgttgaggcatgcctatagtcccagctcttgggatgctgagatgggaggatcacttgagctgaggatttaaggctgtagtgagctatgataaagccattgcactctagcctgggcaacagagtgtaaccttgtctcagaaaaaacagttttgattaaatagttaaattaatgtaatatgtgtcatcttaacaatatgtacaactcttagtttatcttgcaacaattaggtaatctgaaaaaagtgatggttttgtgcacatgatcattgggctaaatttttttcttttcattcagtagtatttattgatgaactattctgtggtatgacctctgagatatgtattgtattctctgccttatagaaaatataatccaagaaagaagataagtataatgcaggacatttgagaactgaatgaatggtaaaagtaatgtttactatcaaaggtcatagggaatgattaattccactggagaagttaatttaggtctgggactgtcttagcagagacagcagctgagttgatccttcaaaaactgttatgatttggatagataaaaatttagagattggggcagggaagggaatggaaggaaggacattctgatcagagggaatgagttaaggtgtgaagataggattccattgtttaacggtcggcagatagactaatgtgaatgggaagggttgctttggaatagggagagattagagttttaaatgttaagctaaaaggagtttgagcctcattcatttgctagtatcagacagtcttaaaatcagtttttagctctcaaaattacattatcgcccgctgttataaaaattacccaacatgcatctactgttagctaattctttttcttctccatttatttttccctttgccaccattctttgtttataatatatgaaggatttgtgttttattttacaaaaattcttgggaatattaacatggtacacaatactaataatactatgtcttttttttttttttttttgagacggagtcttgctctgtcgctcaggctggagtgcagtggctcgatctcagctcactgcaagctccgcctcccgggttcacgccattctcctgcctcagcctcccgagcagctgggactacaggcacccgccaccgtgccctgctaattttttgtatttttagtagagacggggtttcactgtgttagccaggatggtctcgatctcctgaccttgtgatccgccctccttggcctcccaaagtgctgggattacaggcttgagccaccgtgcccggccctatgtctgttgttttataatactctttttgtcagagtagtaagctgcactatttattttgaaatagctgtgtgttaaaacaaatggaagaaaaatacagagtaaaactggagattccatttttcattccagataattgctggcagaagtttgaattctatgggattagaggctttcatacccttcagtttcatgtaaggtctgagaatgcagggagtccccatgatactaataagctttcctagctgtgttaagagtagagatgtatcttcttctctctccaaccagataaacactttcacactaaagctttaaaaaaaaatggtggtcataagagtgaggtttgttcagtatattgtggtagagcactaagaagcaatctcagtttcctagtcttggtttgccactatctgtgtgaataatcaccaacctctttgactaccagttgcctcatctgttaagagattagattcgataattttggaggttccttctgggtctaagatttgatcattcattactccttttttttgctgtttttttttttttttttttttggcctggcttgtaagatttctgctggcataactcctttcttaaatattgtttatctaagcatgtgtgtccttcttaagttggcatactaactattcagaaattgaagtaaagaacatacctatgcctttgaataattattgtgttgattgaatgctggttctgcaggcacacttctgtggtccaggaggtcgtagcctaaccatggcctgtaccttttgttgtagcttatggtgcagaattgaggtatttaccagggtactctaagttgctaacaacaacaaaacaacaacattcaggttacacagtggtacatattaaatccactttaaaaagctgagggcgtgaaaataattttgttattctgaaattacaaaatcactctgtcactagaaaccacagttggaaagatctttagagtgtgtgagtttctttcatttttacagttgagaaaatgtaagacccagagaaaagcaacctgtccaactaaaaaagtaaaactcaaattccctgctagttgctggaatattttctgtattttgtattacttcatgcctctagcagagcacaattgcctctaggttctggcaccagaaatgaaataatgatcatctggcttttatcaggaaactggaaagaaacaggctaggtgattatattttgacattgttctcaaagtaatacatagatactcttagaagtaagtcgaatggtaataagtagactcaaagtaaataagacatttcatccttgaaactaggaagctgagaaagagatggatataaagaaataagaaattagagataattgtcaaattaaatcaggaaatggtataaactaattatttagaaatatagaggacaatttttttctttagtttcaatgtgtaaaaaatgaggctagtgataatacctacttaaagggctactgtaatgaggaaatgagataatccatataaggtgcttagaaaatagtatttaggccaggcacagtggctcacgcctgtaatcccggtactttgggagaccaaggcgggtggatcacctgaggttgggagtttgagaccagccttaccaacaagaagaaaccccatctctactaaaaatataaaaaaattagctgggattggtggcccatgcttgtaatcccagctcctcaggaggctgaggcaggagaattgcttgaacccgggaggcggatgttgcagtgagccaacatcgagccattgcactccagcctaggcaaaaaaagcgaaactctgtctcaaaaaagaaaagaaaatagtatttgattctgaataaatactcaataaatttgcctgttgttattgttaataaattagcatttcttcagtgcgtaagataaacacattccaagtgcgctgaaggaaatatacgaaggctaagagagtgactaagtgagagcaaggagaagtcctctttggttaggtaaggcccctgagaaaatgagcagaggatgagaaggcaccagctgtgtaaggggaaagaacatcccaggccaaaggtatatgtgcaaaggttctgaatttagaaagagtctggcatgctttaggaactgaaagaaggccaggtactatatgatagtttgtgcttccctcatttcttcatattatactgtctccttcactagaataattgttcttcaagggtggtgatgacatctgacttcttcccagctgttttcctcatacctgtcacaggttggcacagaattagtatttattagatgcttgataaaaaattaagcgcctgttgcttgctcaacaactactatgtaagttctaagatatcataattttatttttgggcttatatcagtgagtttcatgaaatacaaaattcacgcttaaaaaatttaacatatttaactgttttatatctctaactgtaccattaagttcaaactactttgatgggctgggttaaatgctacataggatgatcctggtttatgcctgttgtcctgtgtccaatcctatttcacaatggtctcctttcactctaagtgtgttaccactgtttggatcatgaattttacttttttatttttttaatatatatttttttctttttagagacaggtcttgctatgttggccaagatggtcttgaactcctggcctcaagcaaacctcccacctcagtgggcaatgaattttatgataaccctaatagtcattttactgttctgctagtgcactcaagtcttgtctttcattaactggtatttcattctgtacttagatagcttaaatatagattaaaatagctcatttgccccagctgtgttttgtaggatattgcatctaatattttgtaatttacatgggtccttgtatgaaatcaagggattgacaacatgggatgcttgttttgatttagtacaaaacacttggattttgttttagaaatgctctatttctaaaatgtttctaccaaacacccatattttgacaaaatgttctttttcaaagtgataggaattcttatgaatatttccttctgcaataaacagttgtgattatatagtcatattggttaaatatgacaacattttagaatttaactgttagaaatagtaaaaccttagacatctggaccattctccctctcttgttcactgaaacaagtataaccaagcactttcaatgtgcctggcacatatgtgctagaagtactgtgatgagcaagaactaacatggcctctgccctcagaaacttgtggtttgaaaaaaacaagaaacaaaaaacaaagtcctttcttcctggggcaacaggtgaatcagaagctgaggttaccctatgatgttttagaagagctgggggttgggggtaggggagctggcccagaggagtaagagagtatcagatggcccgtacaaacttacagaaattgtacactctactatccctttctttttttgttttttgagacaggttcttgccctgttgcccaggctggagtacagtggcttaatcgtggctcactgcaacctccagttcctaggctcaagcaatccttctgcctcagtccctgagaagctggtactacaggtgtgcatcaccatgcccagctgatttttaactttttttttttttttttttttttttttgtagaaacgaggtctcactctgttgctcagcctggtcttaaactcatgtcctcaagcaatcttcctgtatcagcctcctaaagtctggaattacaagcatgagccaccatgcctggcctccactatccctttctgtttgtggtggtctcctatattttgagtttgaatgggaagggagcatgcatgtttgatggtttgttttgtttttgtgaatgaagaatgaaaatttattcccattaagtgcgagcttcaattgaggcactcagtttatgaggtcttactgatgtttcctctcttaggtgctgtagttaaaatcttgctggtctaaaatggtgaaaactattgaggtattcaaatgataagtactttataaactgaaattgcattgaaaacggagagctcttgacagaaaggttgactctagcatttatataaggaaaaagacaactattatctccctctacacagaaagctatattcagtagttataggatttgtacattgtgaatccttagggatctctaaacatctgtgtctttagaagtagtgtcacctctagtaaaagagggccagtagaattgagtggtggcagcctgtgatgtatatgaattttggctgtacgtctctagcgactattttctccaactctatttagtaaaattctacctaatttcagctattgtgcttccaaagtccatgtttgttgaatatgatatggtaaaaaccaatatctatttggagacagtggaggggatggtagtaattgagagacagtgtcagatggagcagtgactttacaatttttttgactgcaatccacaattagacatttcacattgctcccccatgacaacatccctatcgacccctgcccaaaaacaagttatttaccaatcttgctataagcaatgatgactgattttttcttttttctactttatttaaaaagaaaattatagtctcaactctttatattaattttacacacattaattctacagattgttttagcacttagaactaaaagtgttcaagatttgattttgttaccttctctgtgtaagctaaagttgctgacttttctgagtttccattttattgattaaaactgggatagtaatagtattttacaccattttataactttattagaatgacataatctgagtgaagtggttgtgccaggcacttactaaacacacagtcaatgagtatgttctctccgaagtttgttagcttagggaattgggaggatgccactgataataatggtgactcttattcagaggaaaactaattcagttttagacatgctagagtttgaggtagccaaaagagtttagtcatatcacttggaagcaaaccaatgtgaaatagtttcaaataagcaaattttaaaaaatgttaaatgcaaagcaaacagtattaaagctttggggacttaatgattgagtctccttacacctacacaagattggctaaatacacatacaactgtgtcactctaccagatttctgttaacattctccagaatttaaactgcagaatcagtcatttgtatgactgtttgtctctattagcagaggtaatgacatgtatcagtgataggtaattgtggaaaaaaaaacagcacttggaattaaacctagagttggtgattcttacagggtaacccaacggctaccttaatttctatgattcagtttcttcatctacaaaatattatttcacaaagttgcagttgtcaaagggacaagtaaatatgggatccattgtcttcatggaaaaacttttcataaaatgttattttattataataaaaaatgtgtgattggttttcaatttcagattgaatcaaacatagcattctttgtaatagcaggagattaacaacatcccagaatatatctttaaaagaagtatggataaagaaaaacccgtatgcacctctgcacacattttatgtaatagtggtgatactaatttacaaagacaaagtatataggatattaaaagtgaattcttaatacctgatcttgattcttattaaatctgacttatgtgtatacaagatattattagatgaagtgtttgtccagtagcttagcttataaataacccccattctagctcattttaaacaatgtagtatgaatgatgccaaaaacaggctagaacattttcttctttccaagatcttagatttggtaaacaagctactgctcctggaactaatctaggtcatcataacccaaaatcttttgaaatatgagagtcccaattaagtctcttaggtactttttagcattttaattttaagaatgtgtttaactcttaaaacagtatattttggttgctgtttggccatttggtttatttgtaccttgttataatgaatgcaagtcagtgggtaatcattgcagcaaatatgattgctaggaatctcatgtaagtggaagtcaatataatgtatggcttaatttatccctgaactgacctaacatcacattttgttttttaataaaaactggtttaatgatatgataaatttctgtattttccacaactgttaataatgttatattttaactattgcttagtcttcattacaaattattcagctgttaaatgtgttgttcaatgtgacattatttaaaaacttaaaaaaaaatcagcttcacagaaatctttctttgatcaagagttgtctcattcccattgttattaatacagtatacaactaatgtatgctaatgtattgctgttatttgtgtgtgtgtgtgtgtatgtatgcagacatatggtcacatcatgtagacctgatgtctgcaaagggaaagaggaaacttcaaattaagagcggagtactgacctaggtggtttgtagcacttagagaaatgattattcccacttttcaaataaagaaatagattcagacaggttaaataatttggtaacacatcctataagtggaaagagcttgaatttgtggctttcctcctttatgtcttgctgctttaaggggtctttccaatcatgaggttgaattttgtacaagcgtgtttacactaccatatctgaacattatcccctatccctcaaagactattaggaatagaaatatcctatatgtgtagcacattgctactttgaaaataattttatcctgtcctattttatccttacaacataccaacattgcagacaaagaatgaggaatttcaaagaagtgcttaagatcaaaaagctgatcagagctaggatttgggccagaacccacatcgatggtccctagttcagtgtccttttcgacctcctttcactttctctggattaggtgatctgtgatcatgaagtagtgaagttttacagattgaaccttttatcgttgtctttgtgatcacactacagctacaaaacagctatctgtttgcagtcaaatcctatttttccatgttacaagcagtgtattaatggtaattttgaggtataatgaggctgtcgttgtggttattgaatgactaatacatgggaaatgcttatatgagatttctgtatttaaactttatttttgtgtaatgccatatttgccttacggcaaatagtaagtaacatatgtaagaaattgttagggaaaggatactagtggttaagggcacatatattagatttaggaagacattatgtttgaatcctggctttacccacttggttctagttacttgggcaagtaacaagccagttttaatctgtggggataacaactacctgaggatcagagaagagtacgtaaagagattagcatcatgcctggcccatgggccagtaggtagtggctatttaatatatatatatgatacatatatttagtaattatttaatatgcgtatatgtgtagtagccatttgaacattacctttgaggggttctttttttctatctgcaatactttttttgtttagaaagtctcaaagatagcatgttatctcttaaagtatcttactatcggtagatctcaattatttctgctaacagaaaacatagatgatctgaaatagttatttgaaattttcccattttatatttggaaaacatagttttgtttttaaaacttttgtaaaagatctactatcctatttgtttccctacaggagcatggtatgtttcctgaactgtccatttagagaacatacttaacgaccatgctaagtgtgttccggaggagcaggggaaggaggtttgttgtgattggggattgagaactgagaatctgggactaacacttgtgtataatttcatgttattcagattcttagtttgtagtcttgagatttacaaagtagataatgcgccatcattttatagcatactcattatttagttttgtgtaccaagatgagcaaactggggaaaagcaaacttttttcaaaaatgtatgaagtgctgttctgaaatttattggaaaactagcagcatagaggggagcatttcactaaataaaattctgtctcagttggatttaagtttttaaggtggcacatctatttggagtgtcttttatcatttataattacatgttgtgactaaatacatttaatgttttttctgtaaattctctttttatatgacatcaatagatttatattatagatatatcactaccctttaattttaaagtttaaggattataactgaaaggaactattccaaaacaaccctgggattatatattataggagataggaaaaggttaattttgaaatataaatttattaatccaaaaaatttttaaatttgatttcctttaacttctagttgtgacttgtaaattttagatctaacttccttatttaaacaatgaagatggtcaaataagatgttctacttgcactagtcacctcccatgattgtgaaatcaaatcaaatattgtataaaaatataaatggggcatggtgctaggtaaacaattaagtagacatagtacctacgttttaagcacttacagtgtgttggaggagactgtcattaaaccagtcattttgtaaacagtctttctacattctgtgcagtaagtgttaacgaaaaagtacagtgggcctgtgactagtcttggattaggaagttgtacagatgaggaaactgaagctcataatggtataataatcttatatgtggtctcgctgttagtaaatggcagattcatgttttgaacacagcttggcctacctccaaattccttactgtctctaccatgccattctttctctgagtcacctacctcaggcttattgtgtttccaagcacgtcttgttatttctcagggggcttagcagctctccctctggctaagtatggaaccggtgatcagattctttaatgagatttctttaaagcaataagcctcttccgggttgtatttcttctgtactatagaactccaggaatcctagaagcttcttcaggggtagaaatcttgtggattctgggtctgatatgaaattgcatgctatttgtggcttctcacttaaaaatagcctcatagtgctcatggggcactttagtaactccaacacttccatcagactccactccctaaccccaagacactcaagataaacaaagatctgagtaataaacggcatgcttctgctgcggcctcagcctactcccacaaacctttcctgtatggaaatcctagagccaccactgataatgcattttataggaagaatgcaaataaagagttccattgctttaaacgtttgaaccaccatcctagttgatgcgacgttcaggggaaatatttctaaaatgagaaatttttataattcatcacatctgttcatcccctactaccttcattgattctcccaaacagctttgtaagctggggagggatttttgctgttaaagtttgtggagacagtatgaactggtaaactgaagcccagtacttgaaacctgaaaaaaagtctatacttctatatctctgggtaattttatgatagcaaaaagtaaatgaatttaagctaaacgtcattgttctatgtatccagagacattttaccacaaatacctagttaaatcttgtattgtcagagattactaagtaactgataatttttcctttctgaatctttttctagtcagtctggtaacctgtttctttagtcctcttaaaaggtactgcatgcatttgaggagagaccatttcaggacctatcccattttaaatatgtaacaggttgtgcttttctaggaatttgtgaagtttgttgtaaaatactttatataaagttccaggtatatgaaggttgacaatgctttattctgattgttgtaaatttttgtatttatacattttcagagggtttcacttggtagaacctgatttaatttagatgtgaagtaactgattccttccacaacccttctttgtcttcagtttatgtgcatcactaactgaaataaatttttgtcttacgaatttctctgttttaaaagcaactgaagaaacacatttcaggggcaaacgctagaatactttgccattatcagtctactgttctttcctttcaagttgcctaaacacagctgagtttgtaagacgagcaaagaaaacatgacagtgctgccaagtagacaggaagctgtagtggacctagcgagcaggggaggttgagcacaccctctgtccaatcagctgtgagtgctgttgctatgtgcgctcttactctgctgcctttgtgaaaaaccttacacggagggaagcgggatcagcacccaacgctgaacatttgttttaaccgctgcagacatctggatccctcagttactgatagtatagctattgatagccagaaggcaacttcctttatacaaggattccagtatggttttcagtggaaacaaagggcttcacagagaaggtgtgtagtgaagtgttttttaacggctttatttttaagcttccaattttctgtagctgtttaccagttggctgtggtgcttgctttgcatggatttttaataaataggtctaggaaaattatctcactttgaaaaccattgaacttagagaattttctttagcttcatatagcctgttttctttgaacagcagtactgaaaagattattaaaatgctgaactgaacaatgagtaggaagaaaagaaaccaagtacaatgtgctcactttaatggggaaaaaatgtgatagaaatgagaatacagggaagagaatgtgcattagccagaagcattaactgtatgtgggggcaggaggtattttttaaattaaagctgttaagacaaatgtattttaaataagctgcatatttttaattgaattcatgtttctgaatttgacaaagattgtcagaatttaactaagtgagatttttgacatagtttaaggaattggtgtgccaaaatctttttataaagcatttctgaaaatcctacctcaaattgtgcaatctcttaattatttaatccattgactagttctgtgcagttcagataaagcatcataattcaaccgcaaagtcagtgtagtgttctattaaacatccatatagaaaactgaaggataagggattttgaagacaacatacaaggttaaactagtattttaaaattgaagtaggcctcctaaatgtaataattgcatatctgacttagttaatacttcaaatatagtcaaatcttattaaactgtactaatataatatatgtgataattgaacagagtgtaggttaccatttgtttatataggatctggaaaaattggtctgttcaacagattataggaaagttttaaagtgttttaataaacaaaaggtctttttgtatctttctcaaatactgtgaaattaaagtttacatatgtgatttagctaatggttcttttaattaaagcagagcagactaattagcatattgcccattttacgaaggatccgtattgagctaataaccggcttttcctttgctttttcgttttacatggctaagtggcctttagttcactcagtgatgtatgtctgatgagtaaagtcagtataagctcagagttaatattagggctttgttatctctacaaactatatagtttggaataggatgggttttgttgttgttcttttcaaaaaatacctgtcattagaaagtcttaacagtgttagcatttctggtaaggagagatatttcttttctttaaagagaactcaaaatattatcccatgcttttgtgccctttgctgatctttgtaacaatactatgtatataacatttgtattaaaaagatgtctaataattggtgaaaatttacaaaatagtccttaaagattaaaaaaatgttttacgtagacctacatgtggctgaagtttaaaagactggcatttcttagattttcaagtttgtaaggtgcagccaaaaacttgaatttgatagaagttataaaaattatagcaaaataaagttatattatttggacttggtggcctccacaatataaagcactcacttcaagaagagcagctgtgtgtagaaggggtaggggtatgaaagggagtttggagtgagaggcagacacaggcagagaggactcaagtttgttaaatatgactaaccacatgaaagtcaatctagcaattttcattttttagctgtaactcttatgaattactaattttattttctaattatagaaccataaaaaccaaagttttgtttaaattgatttgctacccattttatgttggtttatttcataaaaattaatagagcctccaagagaaaggctatttctcattcatatgctgcaaaagatgggggaacatgaaattgtaagaaagttgagtgtactgctgtgtcacacagaggctttgccattgtgttcaggaggaatattattggcagaattccagacattattgctgggcttagcacctaaaaatgttttatatactggagcatctgaaagttcctattcagtagcagaacttcagggtagttgaggtttataatctagtcagttataataacattgctagcatatttcagttttttggatttgtctattatttgacaatataatttttattgtctttgtctatgtcatatctttaaattggctattgttttgtgcttatggaaaaatactttaattctcaaaaacagtgatttcttttttgtttttgcctctttataaggaatagcaaatagaagtgctagtatttactagatgcagtgattgctacagttggttttaagtaaaacagattgtttttgattattttgaaatcagcccctaaggctcatacatggatgggcctcagattttgctataagcttcctgtcatctgtcatatgagagggatgctgtgtgaatcagttatgtatattcctgttctttaacattgctaaatttttaccattaaaatttatgttggtttctgttttcttaatattttgaaggtgttttgttttttgaggttcaaattttgggtggtgggtacaaacatacagttagaagaaatcgttctgtcattcaataatatgataggaaattatagttaataattattgtatatttcaaaatacctagaagagaagaattgtaatgttcccagcacaaagaaaatataaatgtttgtggtgatggatattccagttaccctgatttgatcattacacatcatatacatgtgttaaaatatcacatgtacccccaaaaatacatacaactgtggtatatcaataaataaaaaggaaaaacaattttgggtggattgcctgtataatttattatttagctgtgtaatattgggcatagtttcaccttctgggccttagtatccccctcggtatcatgagattttaggatgattgtgggatttaaatgaaagaatgtgcgaaactacttagattcattactacttattaattagctattataataaaatgtgagattgtattataactttcctttaaagttattctacgttaaaaacgtgaatatgttgagttttctcagtattttgagaattttaagcatagttttttagacctttccctaagatacacttctaggtttctcagtttcctaaggtacttcattaactggaaagccatggagatatggggattggggcagaaaaagaagacagggttcatgggtaagtgcatggctaaatatctgaagaaagataatagtcaatagtggtaaggaaagaatgagtaaaatgagaagagacatagaaggcaaaagaaacatttgttctgtttgtagtgttttgataacatattcatacagtttgattcttgtagtgttattgtttctgttgtgtgtgtatgtacactcgtgtgtactgacacccccagatttcccccacccctttgacccctgcaaatgctgagctgattgactagagttgctaaatcccttggtgatttatttactgggaagtaactttattctgacttttcttttgaattcctcagctagaactgagctaaaggtgacattgtaattgccttccatattaatgacaagggacaagccagctgcctggaaggcagaaattaaatatcatcacagatacgagtgtaattgtcttgaaatattaaaatttaagactaaaaatctaatggttttgtgaaaactcaaacttcaaagccaaaatgctcttttgtcattttcataagtacacaaaacttcagcttctttcaactgaccacagtattttcattgctttgagctgacatatgttattttgggagagaggtttaatctggtttccattctatttttcatattttgatcaagggtaaaatttttgtgatttttttttttttacataaactaatttagccctccaatttgctggaaggtgcaggttagcttaatgaaagagaacacacaaatgtaaaacaaaacaaaagtattttccaagtatactccattttatcactgtcattgagtccagtaatattaaccaattagcttctgcattgggcccagagactacttacagttgacaaaaggggaggagaacccttttaaaaataggtatcctaattttaaatgactacattgcattggtgtatatgtttttgggtaatgcatacttaccttaaatcgcttctctcaaaaatatccatgtagaaacagaatgattgctgtacgtcagcatcttctactgacccttttgagaatgtgctgaatgctatcaacccccttgctagggggaaaaacacatctatatttatgtacacataattttgtggaaaataccaaagaggatcataaattaccttaggttaagaactttttttaacataatttgtttatagtcagagtatgaaagcattaatatttaaaaattgaggcttaaaacagactggatgcaactttcagaatatgtatgcaagcaaagtgtcacatggtttttttcccccacttcaagggatatggtaaaatgttcccatatgtgctccatacattagtacccttgtagatgggtttgccctggacagtacccagtatccctttgtggactcctacgttctagatgggcttcaaatagaaaacctagcacaaaaggaccagcctggaatgcggtgttcaggtcttcagaacctacaggccacatctctgagttgtagactgagattagagaagacctaatgacacctcctttggccttagactgccacccggaatctcttccagaaatcattctgcacaagaaatgacaggtccactgctatgaatgtcacccagttctatctttgttcaagagaatcaagcagaactgatctgtgtgtgcccaagtttctcacctcttaattaaaaagacctgtcttccgtccactttttatttctccaggagttttagatttcacacatagacgcattcagtgggaaataggatgttgagagtactagaagtaggggtcattcatatggttgggagaaggatgttgaaaggacagaatgtattttgggaaaccagcctatgttgtaaccattttcccatgaggtaaaaatgtaagactaaactaggttaagtttaaggataattttggaaagtcatgtgccatttgtgtaggattaatgaagctgggggaaaaaaacagcactgggatagtggattgttgcctttttaacacagaatattcttatgagagtacaggtaaatctagaatttggttttgagaggcaggagtttgtttccttttgttacaatgttttctcagatctttgtctcagagttctttctgtatgaggtgtggagtgataacaccatataatcaggaatattcccacaaagaatagtgaaaaggacaatattttctacttgagagtcttcaggccctgagactatgatgaattgtgtctgatggtttacacagagcacagagaaatgaaattgaataggattagtgcaggtaagacagaaatgaattgaggaaaccagtaagttttctcgataacactgactagttctaagtcatacattttagatatcatacccactgggagctttctctgatgtccaagattgagttccctcctaaatattcccatagcaccttgatctactcctattttatttatcttttaaaaaattatttatttatttatttatttgagatggagtcttgctttgtcgcccaggctggagcgcagtggcatagcgtgatcttggctcacttcagcctccgcctcccaggttcaagcaatcctaccgcctcagcctcccaagtagctgggattacaagcatgtgcctccatgcccagctaatttttgtatttttggtagagatggggtttcaccatgttcgccaggctggcctcgaactcttgacatcaagtgatgtgcctgcctcggcctcccagagttctgggattacaggcatgagccactgcgcctgacctcatttatcacattaccatgaattaggcttatctgtgttctctccatacgactgccccctactagaagttagcaacagtagcttattctcccattgcctctggagaagagctgaatctcagacagtttttaacacataaatatcaaatacttcttttttctactcttctagcctttcaaattacttagaatttagttttctttgtatagtttgagttgccctcagctgctcacataagcattcaataggttgctgtgatcaatctataatcctttaaatgactgttgaggcctagaaattctagtaatcaatacagaaattagaactcaaagtgttctccccttttattttttatttttgacaatttttgcccttgatgtagagatttagtgattgcctaatcattttaaacaaatgtttccttatctcattgaagagaattacattgataatatagaaaaacaattggcaattaaaatatgaaatccaagagaagaataaagtaatagttatctgggaagggtaacaattagctttcatcactttaaccagaaataagctgaaactaagaaaacaaaatacagtgaaacattaaacatccatttgagtgcctacctgttcatgtcgagcactgtgctaagcaatagtagttggtcttaattctcataaagctcaaataatgacttaattttatttgtgctaaattctaagaaggaaaagtataagatgtcataggctcttctaacaatgataaaaagacatgaaagagggtaataggatcagatgagatggatgtaatgaagaattatgtatgtaagctgaaacagagatcatctgattgtttcttaccctaattttttaatctgaagaatctgatgaagaggtaaagttaaatttttcctccataagaatagaaattaagttagaaaatgtaggccaggcgcagtgactcatgactgaaatcctagcactttgggaggccgaggttggaggattgcttgaggccaggagttcaaaaccagcctggcaacatagaaagaccatctttccaaaaattaaaaaaaaaaaagcctttcacaaaagcaacaaacatctaatttttgaataaacttaacagatatattcaggaactttataaagattttaaaactctaccaaataatatttttaaagactttcatatatggtgagatttaaacctttaaaatacagggtttttttgtttttttttgtttgtttgttttgagactgaatctccctctgtcgcccaggctggagtgcagtggcgtgatctcggctcactgcaacctccgcctcccgggttcaagtgattctcccgcctcagcctcctgagaagctgggattacaggcacacgccaccacacccagctaatttttgtattttcagtagagacgggttttgccatgttggtcaagctggtctcaaattcctgaccttgtgatccgcctgcctcggcctctcaaagtgttgggattacaggcgtgagccactgcgcccggctaaaatacagtttttaaaaagttagttccaaaaaaaaaaaaaaagagttcaaggccaggtactgtggctcacacctgtaagtccagcactttgtgaggcaggaggatcacttgagcccaggagttcaagaccagtctgggcaacatagtgagatgctgtcgctacaaaaaaaaaaaaaagccaggtgaggtggtgcatgcctgtggtcccagctactcaggaggctgaggcgggaggatcccttgagtacaggagttcagggctgcagtgaggtatgattgtgccactgtactccagcctgggctacagagcaagatgctgggtcagtttttttaaaaagttcaagtgttttttgagtcactagctataatttttgggaaccaccgttaaatctgaagattggaaaagcagaaagcatgttaagagaattggaatattctcctaatgcatgaagtatgaatcactttctgaccacaaaattttttcatggtacgtctttataaggcctgctatgaggggagttctggaaacaggaggaattctagtgatttagtggaatacagagggtggggcatcttgtggtggccctgggagagaatgagtttggcaggtgtgatgggagcataaaagggagtgatggaaggtgaggttaaaaaaggtagataggggctgtgtgtggaggctcacaccagtaatcccagcagtttgggaggccaaggcgggaagatgatttgagcccagtagtttgtggttatggtgagctatgatcaaactaaactgtagcctgggtgacagagtgagactttgtctcaaaaaaataaataggatctttttttcacccatctctcattactcccctttatgcatccagcgttctggcctgtctgggaatggtgaggagtcagatatgggagattgctgaaatagcagtcagactttaacattgatggcttattggaaataagtgagagagaggaggcgtaagtgattctaagatttcaagtcacaaaaagcaaaacagctacagttggaacaagttttgtactctggccaacaccctcatgattatttttagtttgtggcaggctagatgtaagagttagtctgtgcttgtggccaaactgatactaacaataaatgggattctagtattttgtaatttcaaaatttggcttaagtagaattagataattggaattggaaggggccatctagtttcacataccttcattttacatgtgagtttgctgaggctcacagagtttgacttttcccaaggtctcagggctagtttattacaaaaatgaaattacaatccaggtcttctggcttctagtgcagcaattttcatactttttgcaagttgcttagcattattttcatttgatttttgttttattgagagatctgtgaatttcaggatatattatagctataaatgctgatctttaagatctgctatttagctatcaaaatctaggggaaagatccaacttaaatacagaatttaaacagattggcaaatttatcttctaaagagaggatttcataataacacaaaataaataattgcttgatcataatagttgtgcttagttgactacagttctcattgtgtgagaatcagctgaactaaaaccagtttagtttagaatatttagaaatattctatacttggctgcctgaagttaatgataatgaccacagagtcatccaataaaacattaattaaaatgttactttagcattaaatcccactacttgattgttatctttatcaaaggatactgcctttggcagagttactatttcaaagaggaaacagagcaatatgaaactactttgtggggaaaaaatcagaaaatgtgttgtttctgttcttaccaaccttatagcaaggtgatatatttacaactgccatttacaattataattttccatctcaaataattgatcttcctatatttgcacagagagtaatgaatgaatccgctcatacagttacaagggtggcattgcctgcctccttcaactggctgaatgactgaaggaactggtggatattctttcttgatgtgattacatcatctcattttctttttggcaagctatcattctcatacacttctggtccatcacccccttttttagaattgacagttttctgctttcgtggaacatggtctaccctccccatcattgctccttcagatgataagcttctcttgggctgatcaagatgggagcagtggaaaggaagagaaagaccccatagcactgtaggggggctcttggttactattcacacagagagtgaagtcaactttcagctcagtgccttttggcagcctttctcgtaaaatatccagtgttaattcataccattttttacaatacaggtttactttaaccagtgtttattaaacatacattttgatggaagtatttttactttgattaacgtacaaaccgattgactagaaatatgtaagcataagttacgaatgcagttcttataaacgcctgtacctgtagctgttttattttttcttcagataagaggtttgtggtaaatggtttcattctccaagactgcatgtcttttcaaaagacgcttaaaagaactgcaataaacgtgggagtacaggtatctcttcgacatactgatttcatttcctttgaatatatattcaataatgggatgctggatcatatggtagtcctttttttaattttttgatgaaccttcatagtgttttccataatagatatactatttgatcattatataatgtataaatacattgaaacatcacactgttaccccataagtatgtataattatgtcagttataaataaaaatttaaaagaagctgaaaatcattcaaatagtttgctcactttgttttcagatctag

SEQ ID NO: 2594 - DNA, 1609 bp, Homo sapiens
cacagaggaggagcaacctggggaactttaacagctgcccagggccagtcccccagaaaggcatggggacagcgttccaacaccatgctcatcactcacaccctctgccactttcacagacaggagggatctcagacacgagaagggtcatttcccttattttgtagatggagattctgacgcccagagatgggaaggggctttctgaaggtcacacagcacaacccaactttttctatgaggggctacatcttccagctgccaattcagaagactcaattatgcttaagttggaaccaggacaacccgcctcatgcagggttccatctgcaaagtccttgagcaccagtgctcgtgatctctgctcatccaagggggagggaccactgccccatttcactcgtggagagactgaggtcacagggagagtccgcacgaagctgggcctcagacctggctctgctgctctggggcctgtgttcactgtggacgagagggtttctggaagtcccttcgactcctacaaacacacgcgcagctttgggaccccacctcacctccccggctgacaagaatcagagaagggactgcagggtcttgaagttaactcacttctctcagccctaccgtgggcaggccctgtgctcagcaccttagctgcactgtcttatttaatccccttcactgtgcccattcttgtgggctctgagctctgcttgtgccatgggaaaccccaaaagtctggacaggagtgaggttaacacataggaacaacagagaaagtgggacagtcgctaactgcaaggtgcaggggacatgagtgagatgggatgactatgtaactcaccagtgctcccagccccaccccacatcccatcaaaagaactttctcttcacctgtgaactctctcccctcagtctacccctaccctctgagctgagcccagtcccaagatgtcttggtatcaaatctgaagaactggtagcagaggcgggacctgagggtccataggagaggacttggttgatctgggtagcaaagtcccaacactggggcaggaaaaaggtgacacagacaccgagcagggtctgaggtctggggagggacagaccctcaggcagccgcaggatgtgagagagaatgggtaagggcagaggagggtttggaaaaatgtctgctccaagatataaatggttgttggggatcaaaagttggaatgacacagtggccagggcaggcttctggggccccacatctgcagaaactcagccacatggtgccagcgaactcagcatgtaagagggaggcaaaaaaattagggaggacttcttggaggaaatgggacttgagctgagccttgaatgatgggcaagacttggaaggctaagaaaagacggttctagtgaggtcacagagggagcaaagctcaggtggagcctggcaggtgggggtgaggatgcaaggaccaccctccagccacacgacatcaatggaggcccagcaggtgggacccttaagacagtggaccaggaaaattaggccgagacatacagacctgaagcagcaagacagagggacagtgatgctatggaacattttggggtgggc

SEQ ID NO: 2595 - DNA, 80674 bp, Homo sapiens
caggccagggtttgccccggagccccgcggcgggccggggcgcgcccagggactcgttcctcggtgcgcagcagcgattgtcagcgctgacaggaagcgtggaggggtttgagggtcctgggggtgatcggggcacttctgtgcagggcgtccccccttgtctccctggacctctagcgcgccccagccggtgttcaggcaagtctatcctgcccccaagttgcgagccggcccggaaggcgcggtccaggagggagtttggattttcagtggtgctcgccagagcccaggcggctcgcggatcgacgcaaacaaaagccctgtcctcctggggctccggcggcctcgcatcgccaccgcccccggccctccggccctcccgagagtcatcatagaggccaaaacttgtgcgccgctgcagccgctgccactttgtgcaaaatgtgctgtcagaggcggcctgcggctccaaagtgctttgggtgtgcacgcgcgcgcgcgcgcgtgtgtgtgtgcgtgttacaaacaagagggggaaaagccatctaatgcatatttgattttggtaatctctaaagacaatcgcaacagttagagaaagacttcaccgcaagccggagcgtcttagttcgctgcgggaagctggggtccttgctgcgtctgagccggtacacaatgagagggaagagcccggctgagcctgtggagacaaccgattcattctttggaggttggagggggaaagttgattaaagtctccggggtctcgggcctcacttttaacatgcatcccttgagggggtgaggagcctttggattctgccctcccccactcccagccctaaacctgagcggataaatagatctctgctcttttatcatgcatctttcatttttaagttagcactgtgtttaggaaaagaaaaagttctgcgctacttagcagttgagaggaaaaagatgtattcactacatagactacgaatgcagaattagtttttactaaaagttagctgactttcttggtagaaaacacactctggaaggaagttgtgtgaaattttgatttcttagagatggtttttggaagctagagtagcattttctgaggatgatttctgaaacggatcctataatgtggtcgtgctaatctgaaagctcctgggggtaaatagagctcctaattgtaattaagatgtgcatcagcagggagtgcaccttcctgatgaaaaatcctaatgaaatgtaaacagcttggtcacatagatgttttgcttggtgatgccaaacatctggccttgcgccacaacacctgggtgaaaagtaaaaatgggccatgctgcctaagtaatgtaaacatccttctcaagttgggttgcccagcaaattgaggtggagataagcagggtgattttaactaaggtgggactcctggcttggggctttggttaattcagttatttcccctgtggactcctttactttgtacttcacctttcaacaatagttgcttttagatcatagccccttgtgggggtgggggtcacttacctttaaatacatgtccctgcattgattttgctcactgtaaacacccttcttatcagcagccaccccaattctgtctcctttaactgtttacagccttttagagttgtttaaaaaaggtattgcctattccattgtagcaggaggagccacagacaaaactcctcagacacccagtgagcaattcctgtcccttttaagggctcacaactctaagggggtccacgtgagagggtcatgatgggtacatgactgggggctgcatgcactggtaatcagaacgaaacagaacaggatagggatttttacactgtctttccatacaatgtctggaatctatagataacataaccagttatgtcaggggtcgatctttaagtaccaggcttaggtcaggcaggcccaggcctggtttcgggtctggttccttggtttcaggtctggttcctaggtgccgggctacctgcctttaatttcgcttctctttccttttctgagtataaaacaatataaaacaatatgagagggtctgtctctcttctctcaccatactctttagtaatgagctcaaatctgttattattgtcttatttgttgttttataaatccctttccattttgtgaatgtttgatcttttctctggggtcaagacttctggtagaactcacgtttactttctcctcttggactcaagattcctaaggtagcccagccagtggctcaggaaatcagcttaagcggagatatgtttcatgtatttatttaaaaagatacaaaacatttctcccatcatttttctattttgttagccaggagaagaaaacctttaaatttattttttctggtctgtccattgttgatttctcatctaccccctccctatgcaaagctcaacttctttaggaacctgaagcttaccttataactgcacccaagcccagggctttaggaacctacctggcctttctcaaaatcttatagattctgtggtttggctgctgggagccagagggaggtggcttgctactgtgtttgctatcattttgtaaaccttccgttgccatttaaataggtatttgtctgtacttttagaatagaagtgtcttgaaggcaataagactgtgagcttttctggtgaaaacactgagagcccaagtccactagtcccaactttattagagatgcctgaaaatcctccctggctggctagggggagccgaaccaaggtgggatgggcaaagggtgtggtcaaattgtctccttcagttttggaaatatttaatttccaatatagattcagtatacatggtaggctgttttgcttctctgatgcctgggataatctgcctgatatttagtgaggggtcagctttgccctatagcaccctttctcttctgtatcttgagcataggcccccagttagacttttggaaagtttctgaaagtgtcacttgctctgaaattagtatcaggtttggctggtggtttgatggtgaacatctaccccatttcaaatatttctgaaaattttacacagcatcctatggagaatggaacactttgtaagctatatgtactttgatgtaaatgtatatgtacagatagcatatgtatatacacacatatatagtaagtggtccatagatatttgttgaatgaatggagaataactttttcggttgtatgcaaaattctgatatatgctttgcttagtaaaaatgcaacatggcatattttcaaggatttttccttttcttgtcccatcttctagtatgaaagaagtgtagtgtagcagaacttgacagtaaagctaaatggttacaagcacaggctttggcatttaacagacctggatttgaatcttttctctgttgtatagtgggtgtgtcagttttcctgagcctttcaagagtgttatgagattgaagtgaggtcatgcatgtaaagtactggagaacagcacccagccaagaggtgagtgcgtgaaattaatttggggtacatgaaattaaggatatgtgaacttccagaaataatatacacaattttatatgcatttttacggttctgtatttatagctatagctataatcttattttccaagaaaagtgtcaacctctgaacgataggaactgctgacttggagtgtttgatgcctgaggcaatgggttgtcttcctggggaggctgaaaggagttgagtgttggtggctagttctaggccttatcccaggttaacacactccatggaggccccacttctcacctcccagtttcccttccaccaggcaggctgttaattgggcctgagagaagctgaagaatggtgccaagtccttgtgacctcaagtaagaaaatatgtctctgaatccaagcattctgagatgcaatttgtacagtttatttaacaaacacttatctaatccttacaatgggccaatcactcttctaagccttttgcaagtattaactcactgaatcctcacaacaaccctataagggagatagcataattagctcattttactgatgggtaaacttaggcacagagaggttaagttactttctttaggttacactgctaaaaagtggcattactgggcttacaagccctaacagttcatgctcttaccttagtggctgtcctagacattctttccttgtttaattcttacaatttatattcttttaatgtatggaacaaaggtggtatttcccaaggttttccaacagcagcaaagggaagcttgcttagctgtaatctagaggttataagaaattattggagacagccaatttcaatttcccttcgagtgctggagttccctaagacggtcttgctgaaactcagagatagactggaagcaccttgttggatggcctggatctctggttctggaagaattacatttttgtaatgagcttcaactttgatgtggtttgagaagtgtgctcgccagttttttccaactatcaataagctatattttgatgaagtgactttgtatttgcatcttggtggacaactgtggttgtaggctgagaaggcggggatttattagagtgctgtctagtgggacagctggcttgccagctcaaggtcccagtgaggaccagaccctggcaaatccagctccagctgagaaacactcacgtcttcaaggcctctttctcaaacagaagggccttagcctggcttcacccattccctggggtgtgacgggagagactgttcggtagaaactggaagagaaaggagagtctgagaaagttctctggagttgaagggggaggggatgggggcaactcttcgaaaatccttaactaaatgcagctgcttgttacacggagactgacttgcatgccaggaatatctaaaaagctaacgaatacaaaataaaaataaacagcagtaaaaaggctctctctttgttgcagtaagctcagttggggttttcagtttgtttaggaatgggataattgtggcatccactttattttggtaaggcagtgaaacgtggattaatgttatgtgattgggatgctaccaccatctgaactttttccttcatcccctgcccccagccacaccccccagaacacccaggcatggacatccataggacctgagtctcaaacagttgcccctgagtgaattacattggaagagggcagataatttaatgggataatcttggcagggccagcaaatttcacacctcatctctcactaatagaaaggcagcagaaggctacaacatcctcagatgaaaaggttgtataaaaaggctctgcttaacagtaactgtctgtccataaataaggttttgtacagtcttgatccaaaagctgttatgaaatactgataagccaagcctcataatgtttggcctccttacatttccttttcctgcttctctccatagaaccatagatttttttttttttaagagagagagggggactaaaaaaaagatcaacagtccaaactttatttttttcaagtatttctatacaggatggacttcctttgatagctgcttaaagaggtggcgtggagtaatggaaatagaatgggatttgagcctgatagggaatgggggtttgaattggggctttgttgccttcttgggcaaagttacctaaacttttgagcctctgttttcttatctgtaaaatgggaataacaataatatgtggcttactggggggttttgtgagaataaaaggatgttatgaacttatagcgcctaacacagcaccatggacttagtgaacgtgaagtatgttagccaccatcattatcaagggcttactgaagaaatttgaaaatctggcttcaaaacgatggtcctgctgcaaggtagcaaccaaggctcagagaatagcaagttttacaaggttttaggactccagagtgttttgttttatagggagcatgcagatgctctagatctgagcagtacccaggccagtgctggggacctggatggaagggattccacagtgcagttttgcaatgccttaaaacaaaggcttttttcagaacagcaagctctttggggaagagcaacccctcccaggtgcttagtgtaattccagaatcctacaatggggaatgttacatttcagggacctccacttgtaatctgaccgtttttagctccaatatccaaataatcttgctgagcacaacttgaaagagaaggataatggccggaggaaaggatcctgaggtgctctgtttgccatttaaattttctgagtagaagaaaaaaagttcatgttacccaaagagagaagagtaatgaagcgtgtgggaagcaggaggggtgataaagaggacttctaaagacaaagcagaggttgggtttgatattttatttttcaacagtgaagcttgtcactcagtgtatttcaactaacatttattatatatttatcacatgaaagatacagtattcgtgtccaggaataaagtattaactttgccctcaaggagagaggagaaaaattctcacttttttgagcacctgctatatgccaggtatcatttttttaaagctattaaatttatgcttctcagcactccttggagtttggacttctgatcctattttacagataagaaaatcgaggctcaggaaggtaagtatctcagccaaattcgtacaatgattaagttgggatttgggatttgaatctaggtattttgactctcagatgtatgctctttttgttatccttaaagtgtgattggggagacaccaatgagcagatgtggtaccacaggcaactatctctcccacaagtgaattataggaaagagttgtggaaaaaatgctgtgggaacatggggaagaatacattaattctcaggggattagagggtcagaggaagaacatgagtgcctccttcataggcttattgtgaagagtcaatgaaataattcatggaacacactcagactgtgcatagtgagcgctcagtgagtgttctgctatagttatgtagccagtgagaggcctgatcaggatttatctgcctctaaaacccatgtactcttgctcccctgtgcactttttaaacagacatgtgattgttggaagagtaagtaactgtgcagtcaccaaatgaaagggaagacaccaatacagttgctctggtatattcaccacctgccctaatcctggcttttaggactggactgctttgggtatgggaggggatttggatagatgtggggttggaaagaatcaagatgtctcatcatgaactatagcgctcctagaactctggccaggatttaccacctgccctcattcattcattgatcatacattttctatgcacttacagtgaaccaaatattctgatagtctcactggagatgtaaagatgaataaggttagatcattgccttggagggtttttcaaatgacagatttatggcagagattgctagctgatcaccaaatatgtttccatctcttccggtcatatgactagacaacatttctcagctttctcacagttaagtgaagccatgtgactaaatactagccaattaaatgaaattggaggtaatttttgtcgcttgtaggcttgacccataaaaaactccccaggcagaatcggtatgatccttcttcggtggcttgacaaccttagaagtcatgtgttgaaagtgtcacaacgtggaaagagcctgagactctcccttaatcactgtgtggtggaagccacacttgtttaggttttatgtgaaccaaaaacaagtgtccattgttaaggctgagattttgaggttttttttttttgtttttttttttgttacagctgctaatgttaccttaactaacatgaggttgtaaatcagtgtgtggtgagatcaatttagtgggttaggaccagcatttttagatagaataaaataggaaacctggtttgtgtctgaccacttcatgcagacctggggctccatccagtaaattaaaccccttcccaaataatttatggcacacatagggtgcctctagcactgtagagaatctagaagaatgaagggtggcctttacccttggggagtttaccttttaggggcagtaaaataggcactttatacagccagtgagtacagagttggcaattatatatgcagaatccctagaagggtgggtctttcgggaggaagtgtgatatgatgtgagccttgaaggaaggattgagagggtgcgggattgaaggatgggagatgggaagaggagttggacatttcactgctggaaaagggctggagttccacagcagcctgcagctgctctgggggtctccatggactcgctgagactatcctgagttcttaaaccaggccttcactgtggaatgaagctgatctccaggggatgggagagtgaagaaaagaaagacagcgttgaatgaagcctgttgtgtttttagcatatgaagggtggaggaggagagagaaggaagcagtttcactgggagcctgaagacttgtctttcttcccaaagggtgtcccagggagttaaaaatgttgtgcatttcagggctgcttgtcaaaggtatatgatggtgtcttattgtctctaatgcagccattttctcttatagtgcaggctacttaattctattccccctcttgtctgcttgatgaaaagaataatagtatactaataattaacacactgagcatactgtgggccaagtactattctaagttctttaagcgatttaacttgcatagtcttcaggacgaccctatgaggtaagccagagttctaggagcattattgttcactattaggcatcttgattctctccagctccacacctgtgtgaatcctccaccatgcccaaagcagaatccaggctaaaagccaggataagggcagatgggagaaaatacaagacgaactgtcttggtgtcttcccttctatttggtaactacacaactacttactcttccaacgaccacatgtctgttgaaaaggtgcacagcagagcaagagtatatgggctttagaagcagattaatcctgaccaggtctttcaccggctgctgaacactccttgaacactcacaatgcatgtggcagggtgctcagtgtgttccacgatatccccattttccagataaggaaactgaggcacagagaagtaagtaacctgcccaagaccacacagagagttaaatgggaaaactaggatttgaacctgcatatcctaaggcctgagttttgttcctaatcattattatgccaaactgcattgcagttttttttttcaactctgtctgatgattaaaattctctgtaagatcccagccaaatagctgagtcaaaataattataattaaatcctccatttgtatagggctttgcagcttacaaaatcattttatgtacagtattacctttaattttccaaaaaatacagttaaataggatttatttctctcttccttttaaaagtaggcaggtgagtttggcagctcacacaaggtcactctgtagctgtcagggcctgtctaaaacccagccccttggacttagggcccattgaactttctgctctaaagactacttttgtttggaatttgtgcctctaatatactgatatatgactattttcactactgtttcaccaaaaggtgaatttgcctgattttcacttgtttcatccacaaaatcttcaaatagctgttgtctttagaaacagttgaaaggcatttgtagatgggacctggctctgggatttctgtaacctgggaaaatttacttgcaaaaagacagagaagttacttaaaaacaggattttcctaagtggttggtgattgtggcagggagaggagccaggaagagaaggactttggcatcagatggactaggctcactactgctctgccaggtcagcaaactacgtaacctctgagactggctttcctcacgtgtaaaatgggagccataatggtgcctaccatgacagagggggaaggaccatgggtagtgtttggcacagtgcctgggccatagttggttgttggtgtgtgatcgaagctacatctctcaattgaatggagagcagcaattcttcctttaagatttttcacaggatgggatggggcaaaattgctagttctcagcgccttgttaggcatgattttataatacagttatctctgacacggactttcttagcacctggaaatcttaggttataattatattgtttctcaagggcagggactttcttatgctctgtgaaggttaaacatcataaggtaaaaatagaacatgctgcctgaaatcctagataccctggaaaggctcttatctgttcttcatgggaaactgacaccatttccggatgggtttagacaatgtacatgaaagcaacttattctactttttctccataagagagattatagccttgcttctaggatttcactccaactggggtgtttcaaagtttttacataattttcacaccccctggagagtattggctgtttttcttttttctgcctgaacttccattgtggtgatggactgtattagcctttcatatgcctaccttaaagaggtaatgcttaacccagtcatgactgttttatctcctcccttcagagaactgttgtgtgttgtatggggattttcagtcccaagatattgcctgttggagaccagtggtgtgtagaccactgaaaacaagcagcaactatatatatatatattttatttatttatttatttatttatttatttaattttttttttgagacggagtctcactctgtggcccaagctggagtgcagtggcacgatctcagctcactgcaacttctgcctcctgggttttttaagtgattctgctggctcagcctcccgagcagcttggattacaggcgcctgccaccacgcccggctaatttttgtatttttagtagagacagggtttcaccatgttggccaggctggtcttgaactcctgacctcaagtgatctgccccgctcagcttcccaaagtgctgggattacaggcgtaagccaccgcgcccggcctacgcagcaacaattttcgatgatgttcttaatccaccagtgatttaaacctctttttctctgtgcggctcatagcgctttgcccactcacatctggtgtccctaagtcaaagcattgaaaactttgcctgtgaccaggtagtcttcagtgggttagagtctgctgtcagggcctcccaggggacacgtgataactaatgtcctttttccccactgaggaaggggggagctgaactgagcatgtccagtctgtgctacccagctcatccctaagttgctgcctaggactgtgctccgggcctctgcaaggaggagttagtaaaggtgcagagaaagtccaggacttaacactgattagtcttcctccccagaaagaaagcacctggcacagggaataaagcatttccccccttacgctggctacaacttgattttttttttttttttttttttttttttttttttgagacagagtctcgctctgtcgcccaggctggagtgcagtggcacaatctctgctcactgcaagctccgcctcccgggttcacgccattctcctgcctcagcctcctcagtagctgggactacaggcacccgccaccacggccagctaattttttgtatttttaatagagacggggtttcaccgtgttagccaggatggtctcgatctcctgaccccgtgatcctcccgcctcggcctcccagagtgctgggattacaggcgtgagccaccgcgcctggcctttttttttttttttttttttaaggagcaattgtcagatttgatggttgtgttggggttaaaactatgtagataaggtggtcaaaaccttttagaaataatcctcccacatctttcctgagggcttaggtttagaaagtttcttagccatcccaggatgtgggtgaaagtggcttcccccagactcatcaaatacacagagcaattgatctgagtgctggtggatgggagggaaggaaaggaggggcccaagaggcgcagctccacctgcccgagggagacgtcctgtgtaaactaacaagaagtcactggtgcttcggtttggttaaatactgatttagcaactgaaagggatgcaggagaaatatggcaatatcctctccagtaagaagtttactgtttttgttagggaggcaagactgatacaccccaaacggtatgggaataatgaattgatccaaatgtcagtggcctgcccttggtttagggccctttgcctatcttgaagcctccaggaatttctaccctcacaccggcctacctccctggcatatccagctcagactctttcctcttttcatttcttcttgctgaattcttgttcttcaaactgtattgcatccacatccaggaaggcaccctggcctgtttcagcctgtcagtccttcttttgtcgtctcaccttccaccagtattctcacataggccgtctaaatcacacctgcttatgctgatttagcccaacacctttgcaataattgtcactgtcaagtattaagcattgactgtggacccagcacctggcaaggcattttgtattttgtagtggaatcatattattttctccctgtagaactattgcctttctttccttccttccttccttccttccttccttccttccttccttcctgccttcctgccttcctgacttcctttctttccttccttctcttttttttttttttcttttttgatggagtttcactcttgttgcccaagctggagtgcaatggtgcgatctcagctcactacaacctccgcctcccaggttcaagcaattctccagcctcagcctcctgagtagctggaattacaggcacctgccaccatgcttgcctaatttttgtatatttagtagagacgggttttgccatgttggccaggctggtctcaaaatcctggcctcaagtgatccacccaccttggcctcctaaaatgttgggattacaggcataagccactgcacccggcctatcgccctgatttcaatccctcatctgtcactccctcattctgggaaatgccccttcatcagtttcaaaaggaactaatcatagtctttccttgggatttaggggcagcccttctgggatggggaagctgagagatgcccttggtcatgtctgagcccaggaaagaagctggtgtgtaggagagaatgacttcatatccagagcaggcactcctgagaggcagaagaggtctgacagcctgccaatctcttttccacctccctggggtttccttatctgagccagtagacgctgctttcatgaggttattgtgttcctacaatgcacacagcctcacctcactaatcctcataacaaaatgaagtgggtgttatcctttttttaaagctaagaggaagcagtttgattgctttttctgatgagaacatttatatccattaaaagcaaattcagaaatgtataatgaaaacaaatttcacccattatcctaccattcagagataacttctgattgtgtttatacacgtggatttataaaaggaggttatgcttttattcccaaaagaaaactgaggctcagagatgttaagtaactcctctagggtcaaaaccagtgcaaatcactaaaacgtgttgactgtctgttaaattcaatgtaattaagtgccacagggagttacaggcagtaggttttgtggatcaagaaggaaagaggccggcattgattggaattactgggagggttttctgaaggaggtggggcttgacagagtgatctaatatatatattatatgttatatatatatatatattttaaggcttgttttattttaatggctgatctatataatcacagaagccagtatgtacagacaaagtggaagtttttatttccttgtctcttcctccttggacaaggtcttgatgatttcctccttcttgacctggaggcactctttatggcgcttgcatgcttccttggtcttagacctctgggcctcaacctggttagccaggagcttcatgcgagccttatctgccttcagcttgtggatgtgttccatgagaatcgcttgtttttgaacacgttccccttaaccttcaggtacaggctgtgatacatgaggtgatcaatcttcttagatatgcggtatcttctgagcagccagcacagaatcctcattctcctcatccacgtgaccttctctggcatccgggcattggttgtaccctttcgcttacctatgcccatgtgcctgcccttccggtaggccaaggtgttttcctggcatcgagcctgggaatggacagtcattggcttgcggatcatcagcccatctttgatcagcttccagatctgctgacaggagttggcattggagatttcattggtttcattggggtccaaccagaccttcttcttgccacaggggaggaccctagaggcaagcctcttctgaagcctgagcatactcatggctgtgaccatagcagtgaaaggtgagtgatctaatattgacttgattcctcccattaagtggcctctgagtgggcaaagccagtgaatggggacacctgagcactgcctgctgtcgggactgggcactgcctaagacaatgattacttttgagcttttctgaagtgaaaataagtcaatgtgaacatggcaaagagggacagaggaagagacttatggtatctagaaggaagttggcaggtaacagggtgccaggaaattaagacctaaagaaatagagtggaggagaaggagggtgggggcacaacagtggattgtggttttgcatttgaatcaggaggaggaaaaaaacacccatccttcctctccttttttttttttttttttttttgtctttaaacaggcactgtcactctcttttgggattacttatttatatgtttgtctctccctctgcactgtgagatctgggtgaggaggaatggtgtttaattttcatgcatatcttcagtgttcagcacattaagcctggcacaaatcaaagagacactcattaaatatttttcaaagcaaggatccactgacatgactttcaggcaggccctcccaagctgtctacaaccccctctgtggtctcatagggcacctatgcacatattggcttttcatgggctgttccctcccacagaagcacctttcccccacccatcagctacagtccttctgtcttggctcagatgtcacatccctgactcaacaggtgagattagatttccactcacatgctctcctagcactttgtgttcttaaataaccttcattataatttgtcattgaatatttatttgtgtaatgactattttttgggatcttctctatcactgggttggatgctccttacagtagggtctggttctggatctcctgagcctgggccagttgaatggattctgcttttacttttactaagcattgttcttccttcctagaggccgagataactccagcttaccttggtgtgactatctaggaatttaaaaacgcgtcttcgaacaactgaaaatctccaggctatctcttccaacagttgaggaatccagccctgtaaaaagtcaatcaggctaaatgacacctgctgtgagttctgtttgcaggagagcaatgggcagctccagagctgggctgttttcccaacatggagtctgtgataactgggttttgctgctataaattagggtcaccctgctcttaattggcaaccaattcagattctcccttacaatcctcctctttctcctttttcgtgtggactgtgtttgagagaaggtgtggaaaatcctggcactgtgctacagggacggtgcacctgcaagctgggaatagaggtggtgaatgctggctgccggccctcagcacctttttctccctccctgttgctctgcccttccctgtcttttctcaggaattttgaaagaggtctcattactagggaaatatcccctggggagctcttcctctctcttctttctctcaatgagtagaggggaaagtgttctcagttttgaacctgcaagccatctggatgcaaagatggccagaaatgcccccttgtctctggatttcctacagcaactctgccttagcctcccagtaccatctgcttcaggctgggacatctttccttcatgcaggagaaaggggagcttaataaaattttgctggggtttcttggggcctgaggcagtagtggggaggagagaagcctgggctgttttatttcttgcacctgctatgagtcaggagtggtccttggtcagcaggcacatggaggcctgctgggtgccaggcattgggcaggtgttggggctacaggattatctgctaggacctcaaagtctggccttgtgggcagcgtgaaaacaatgatggtgacacagtgagagtctgggcacaggtcctggaaggtgtggagagggagcagccaatgcaggctcctgttagagtgctggagacagaatcaggaaaggtgactcaggggagtcacctttttttcactggaaaaaaatatgtctgggaggcactaaaacaagagcccattatgtgttttaaaatgatattagtaataatgtaggggtttatttggacaaatgagttcacaaaattgtgctgcctgtaatgttgattcttgactgagggataaaactcacttcccaggcccctttctgtaagccagttcccaccatccccttgaacctcagctgctccaccagagtcaaagcaactcagaaggaggctgagacccccatgcctcattgctaatcgatgggcatggtggatgggcatgagggtggggttcaggaccttacctagcatctgtcttcccagaatgttgctctgccctttctggggataagaggtcttagtttctttatctctataatgggaattataatccattccctgaagattatggaagattataggaggtaaaggctataaagtcaccttgtaaacctaaaatcctatctgagatcgaggatttagatggcaagtaccattttgtcttcatttcttggtgaagaaggatccatgaggcctcctttattcactcaacagatatttacgtggcaggcatcattcttgatactgagggtaaagctgtgaacaaaacaaagaccctggtcatggaggagtcaggaaatacagaaatatacatgacagcaggtaacaggaagggccaagaagaatgagcagggtaaagagcttgtaaaggaggtggggtgggtgctgtcgcatggggcagtctggcaggcctctaggtttaggggatttgagcagagagacctgtgtgaagggaaagggtgacccctgagactgtctgagggaggagcagtgagtgcagaggcattcaaagcaaatgccttgaaatgggagtgttatcagtttacagtacaaccagcaattgcttctactaccactggtaatatttatagagtctatactgtgtgccaggcagtattcaggtgccgcgacaaccctattcggtaggtcctatttttatccttcccccatgtcacagatgaggcattcttagaacaaaccaagcatccagataatacgaagagggagcagttctcatttacatggggagtgtataagtcacagccctgcacagagggaacagtgtatggtttggaaagaaaaaaaatctcagtttgggcctggcctgctactcatctgctgctagggcaagatgtttcacctctctgggcttctgtttcctgatttataaaatgggctaataaaatctcagaggattattatgtatattaagtgagagatccaagtgaaagaatgtttcaaactgcagggcaccatgagaatatcactttattcttcttcttattacgccaattctcattccttgcctcttgcaaagagagagaatgagagaaaaatggaaacttgcaacttacttaacttccttggttctttccctgaaaacttattttctactaatgtctgtgggagtgaattaactagagtatccagttgaattaagtattttgctgaaagatgaagggactgtgagataaagttggtgccgaggattctcacatttctaaaggaatcacttgaggtgctaggactcccagtccactcttccacaataccagacaacctgtaatcctcagacccagaatcttatgacagctttctctgatttcacattgtgtagattagctacccaaaaaagtaagtggcctcaaatagtgctgccctttaaaattattctatgcatttgtcccagagtcttgtgggatgaatggctaaatcctactggattaggcgagatgggtattattatctggggctacagaatggaaaaactcaggtgaaggaagttatcccaaacttcataattgatggtgagcctggatactcattctcaaatctggtgaggcatcgttggcttctaccatgatggcgatggtaagctcatttgtcaatcaaatgatcgattggcagtagggtgatgacagttaataataatctattatatatttcaaaatagctagaagagaataattagaatgttcctagcataacattatggctatcccagttaccctgatttgatctttacgcattctatgaatgtaccaaaatatcacatgtgctctgaaaatatgtacatctattatgtgtcaataaaaaaagttaaccaaatgatcgatgaacacctactatgtgccaggcacagtgctgggtgctggcaatgcagtggtgaatgagacagggacctgggtgcttgctctagggaatgcccttaggagaagctcagggtatgtttttttatttggaatgcttgctgattcccctcccaggacctccagaaagaagtggtggttgcttcagcggtcacttggtgatgactggcaggtatatacctgtgtagctggcacatctggtgcctgtgatcagagccgagccatccagtctgagctttgtttttcccagtgcagcagtggtttcctgcagtaagctccatcttggttgtgctgccctccccgctggggttgggataacagcctcctggggactgtggctaatctcaggagaagcagagaccccagggaaagactcctgtctccgttgtgtgcacctaggattagatagaactgccgctaatgcagttaggtaaaggcaagggccctggttgctggggaaccaggaagcacagggtgagcttcccatctgctctcagtgaaggacgtcctcactgtcaccgcttcctagggccaaaggggcctctgacaaagctaatgtgaccaaagtcaaaatatgggctccgagagtcagccaaacccattcaactaactgtgatcttaggcaaacctcaaagcttcggtttccccatctgtaaaaattggggtactaatcatatctacctcattaccttttggtgagggcaaaaatcagacaatgctgacggtcactggcatgtcctgagtgtgcatggtgagtcgtccatcaacaagagctcagatgaccatgttccaggtgaggaacccgaggcccaccctggccttgatcagaaataaccaccctgaattcctcagtgcctgagtctggcatcgaaactggcttccccggcctccagcactaggccacgaaggaaccagcttctttctctcactggtggtggcctgctgtgccctgctggctgggtccagagagacagaatgaggaggagctcaggacctgttatcagaggccagagggcggctctccagctagactgctagcaggaccgcagtgatggaatcacctgaaggtcttcttcaatttcctcatctgtaaaatgcagtggcttgactgccccttccagccctaaatttgttttaggaagcccactggaggaagcagcgagcaagaagggagcagcggagggaacatatcaatatgatgtaagaataatagctcccattttgtaagtcctgactgtatgcccgggactgtgctgggatacacagggtccagaacattatccattttctaggggctcacgcactcatgaaactggtgatagtggtggggtgcagtcgtttggggtgggtggagagacataataaccggaggaattagaatttgttttggtacatgccttaagagagatctgcacagtgacttgtggaccccagacgaggctgcctgtgtgtgcagagcctcgaatgccatgcagtgaagggaggttggaaccctgcatccagggaagcggactttgtggttgggagggcaggttcaggaaggttctggtgggagggttggcagccaggctggtgctccagagggctgatggattacattcttcgagttagaaatcatcagaagccccgctgagagggctcttgtggctttggagctatgccggaggttccctcttgcaaggggaaaaattggctgtgcctttaagtgttatcctcctgtcctcttggtttcctagtgtggcaagattcaaatccaaagtatttgcattgaatttgttaatttcaaccagtggtagaatagaataagaagtctaaacagccattttttcttcccttggagggtatgttttctgaccttttaaggaaaatcctgtcgaaaccttgaaaacttgtgactctaggtgctggatctgacactgggtcagggacatattgtggacctgccgtgtgcttgggcctgagctgagcaagctcatggagtaagctctcttgaactcttaagatcgtgaaaatacagttccaagccacagaagccctttggagtgattctgaatggtgggagggcagagaggctttgaatgctgtttgaacacttagactgctaagtactactcttcaaacacttcacgtgccttagatggtctagtgcaaaggatatgcaggaacataaaatatcttgccgctactggaatagccttatcttctgcctcaatattgatttagaacaatagcttgttttgaactttctccccataaattaaattttaatttagaaaatgccattaggggaaacttagtatgtaagtacagaaggttttggagatgggggtggctgctcagaagggagtctttagagatgacaaaggtaaaagcattactctaatcagaacatttcattaaaacccccatcagactaatctgtcgacacatagtattttgagtatcttttgttggcaacattctgtgctggaaactgggagagagagagtttagctcttgtcctgtatgtatgtgcatatttatatgtgtgtagtattgtcttatatgggaaaggacgatgggatttttttttttcagaaacatttttcccttctacaaaggatgacatcagggcatagcagaaagagctctggactgaaagtcaataaacttgagtttatctcctagccctacctctaactagctgtgtggccccacacaaaacacttgccttctctgatcctcaggttctcatctgcaaagcaataaggttggaccaagccctgtgtagtggcagtgtcaacatcacctgggagcttgttagaaatgcagagtctcaggctcctctccagaactactggatcagaagctgcattttaacatgatcccaggtgatttatatgcaaattaaagaaccatggctttaaagaaccattcctgctctagtaatgtattattttgtgtttttttccaaatgcatattaaaatatagttacgaagaatttatccaagactgcatcaaacattctacataaaatgggtgtatcatctcttaccctttaaaagtttgtactttgtgagaaaaaaggtttaaaggcagaaacaggcacaagcagtcgtacattcagttccagtgctagatatacatatttcttccttttgcctcctttgtgttttgggccttgacagtgtggtaagggcagcggtggagagaggagaggaggagttgcagagtcgaggtgactgaaggtggaaatggcaatgcaccgagccctgagctggcaggtggtccagagagcagcgggccccagcccagctcctcagtatcattgcaagggttttgagaatccaacatcatcggtgatgagaaaaatgtttcacatttttcaagcatatatgaaagtgctttgatgaattgaataacaattcatagtgattttttgatgttctatattttttctaattaattgattctagatgttaaacctattagatgggaagaggactctagttcatttttgcattaaaagggttctttcttacttgaagctggtgggaactattggaagagggcgtaataattaataatgatgacaataactaacacatgccgagaactttctaggtgccaggcactgtgccttgcaaaaaaggactttgggcatctgttaattaatttatggataaggaaaccaaggctcagagtggtgaagtgacttgctcccagtcatcctatgagtaattggtggatccaggctagaaacccagtgtcctggctgtggggccagctttttttctgctgtgcccgattttgtggtttgtctctctggtgctctggagtagcatgtgtgggaaggctgaacggagagtcatgaattttcccgagttcctcctctgggaatcacagactatcagagtccggaggactttcaaaagcatgcaggccacaaactccatttacaggtgaacacatccagcccagcaagggaagggaacttgctcaaggtcaaacaattagtagggtttatttgttctggtcttcctctacctgaaattcagctctatttgaacaagtgaaacaagcccttctatgaaagcaaatgaacacggttttgaatattgtatctcaggttgctgtgagggctatatatatctttaaaaaggattcagcatagccactggtagttgataaacactcaaatgatgtttgttatggttatcatttttactaagcttcacatattaaatttagggacacctttgttgttgttgttttaaagcaggactgattgtagtcttgtctttttttttttttttccatgttctctatcttcaggataacctttgagaggacagacgaccaaattccttttcactaaatactgcaccacataatcattggaagccatatactggcaagggagaaagttgcccttttgagaggctgcattcttcatcttatgagcccatgccatgccagccagctctcattgagctgagaagctatctttttggcagtaggtctcctgatcatgaagatttgaatggaacagacattttctgagactcagtcaggcatttttccactctgcatacaattgttaccaatctagagaagtaggaactggtttagaatcagagccagcttcataggtatgcaacctgtgcaactgcgcagaccatccacattggagccccctggttgatttgacgctctgcagggaaattggaattcttgatattattttcaataagacgccccacttttttattttgcactgggcccatcaacttaagtaggtactcttggttagaataatctagaacaggaccaagagcctgtgaggaacaagtcagtgggggttgcagtttttgggggaggaggaggaggccacagacctgactccttgtgatgggtcctagtattatacatgggcttgagccaggcagcatgcagtccgctgccatagagaggaggtaagcagggtggtttgttgtcttgtccacccatcactttgccttgtaagtatagacaagacactaactgctctgcatgtctcctttgtatccccagccctgatcacacatagtacccagcacatagtaatcacttaacacattgtggctatttactttattgctgctctaaagtagtccagagatgaaccattattccaggggctttacatgtattatctctagtttttctgacagcctttcaaggtagacatgatcgtcccttctttacagatgaggcaactgagactcagaaacgttaagcaaaagtatctctggttcatctctggactactttgaaaaaatagatgaagtgttgtgtgagatgcattataaactttcctatttttggtgtcagcaccatactttatatcttggctattcaggggcttaacgtcaatttccctgctagtaacctctttcttttattgattcaacagctggattaacttccccagcatcatcatttattagccacgtaatcttaaatacttttgcttaatgtttctgagtctcatttgcctcatctgtaaagaagagatgatcatgtctaccttaaaaggctgctaggaaaactagagataatacatgtaaagcccctggaataatagtgactggcacgtagtaggtgttcaagtcacttttcttattataaagttgacatacaaacagctttcattgtgtcatttcccttcctcaaaaatatcttcaatggctccccattgccatggccatggtggatcaaagctcatcatgatctagccatagcctacattgtctgacttctctcaccagtgtttaaaaacttctccaatgctagctgtgtcttgttccccaggccactggaacctccttggcgacagaattccatgttatcacttgagtgcctaggagcatgcctgtcatagtgtctgtatggctggttgctaatcacagtgtatttcaggaatattgtgcaattctgcttttttcccatttgtttatagctcttagttccttcaaattggaaatggattatggttttgcatttgactcaggaagaggaaaaaaaacacccatttttcctctcctgtttttttttttgtttttaaacagctagtgtcactcttttgggattatttgtttatatgtttgtctctgtctctggactgtgaggtctgggtgaggaggaatggtgtttaattctcatgtatatcttcagtgttcagcacattgagcctggcacaaatcaaagagacactcattaaatatttgtcaaactgatgaatattggaaagctcaagtttttatggcagacgagggagacagtgggagctgcctttttattggaaaaacattgtttattagatctgtatggatcatttagaaaatatgcagttggttatcttttatggtcaaagaagaaaatcagtataaaatgcttaattaaaagcaggagctaacatttcccctagtaacgaaggcaggcttgtgaatattttcctttccttagctcaggagatgggcaggcagccaggctcaaagatggggatgcttcatagacagatgagaaggtttgacttaggaggactgagtcccagggttaccctgggtccatttttgctttaatgtttctccgcatggatgttgaaaatgtgaatgaagagtgttaattccttaagatattctgatgacaatgtcaacccctttaaggtgattttgctgttacctataaaattatcacttgtttgtgaattgattataatggcatattttcaggagtatgttttgtacttttaatttgagattaaaagccctaagaagtgtgggtctttttcttattcttcttggtgctcctgtgcctgacacagagcaggcccttaaaagatgtgatacctggagttcttattcacttggcctcagcagagttggccctttcctgggtgtaggaaactgctgaggactaggagctggggaggcagaaaaggcaatgatgttctgaatgtttctgccactggaaggaaatcaggccctctgagacagacaatgattggatgtgctgcaggacaggaggtctgagtactggcagcatccacattacctgggagcttgctggaaatgcagaatctcagatgtgctccagacttactgaatcagacactgcagttcatcaagatcctcaggtaattcatctgcacattaacatctgagatgtgctgctctgatgagaaaaatctgggaacttcctcaaccttgagactcgatagtctggattttcgtaattctaggatgtagcatggtgaagtttgactgaccttgaatcccagagctgccactgtggggatattaattaacctttttaatctcagatgtttttcatctataaaaagtatatgttgggtattttgctaggttttttttttttggtgaggattaaatgaaataatataatgctcttggcatatagtaggaacttaataaatattacttattgctgattttgttattttatctgagccctggtgtagatggtttatttatttattatgataggagaaaattgctgtattattatgattacaatgttgtaattttgcattagttttatgtcatttatatgatttaatgagtattcttaaagaattaaaaagcatttgcatgcttttgacctcttgttttaacctgtttttgaatcttctactcataacatggacgtattatgtggctgtatttatgggtatcatgtttttggtcttttttttgagacagagtctcgctctgtcacccaggctggagagcagtggcatgatctcggcttactgcaacttctgtctcctgggtttaaacaattctcctgcctcagcctcctgagtagcttggattacaggcacccaccaccacacctggataatttttgtatttttagtaaagacggggtttcaccatgttggccaggctggtcttgaactcctgaccccaagtgatccgcccgcctcagcctcccaaagtgttgggattacagatgtgagccactgtgcctggccgggtatcatgtattttttaaacaccactgaatcacttatatttcattttggagatttcttcctcccatttattctgataataatgattaagtagcctttttatccagcactcattagacagttaatgaaaaaggttagttaaaatagggagtgaggaaatagtgaagaaatgaaattaactattttatctcactttaactgcctagctgtacattcatttaatcatgtagcttttcctttgagctgggtctgatgtttggagggtgctgtcttctttcacaaccacacctaacctgtaatacattttctgtggtatccagctttgttttctctaaagtggatagaagctgaaagacacaagtaaagcactgtaaatggggaattcttttagatacgtataatgcccccccatgtgtttatccttgtcttagagttaacacagtggtaattatttggttgggggaggggaggaggttatttttatttcactttccaaagaattgggcttaattttcacagaagcaacaactcgtcttatactcttgttttattaatttaaattctgtaaagtacacaatttccaaaaaattatatagctgaaactgtataacaagctttgggatcaaaccctactgaatcttgtcagaatagaactcaagaggtgggaatagtgcatggcttgtccaggagcatccacggagcatccttggacactaggtggggtgctctatagagggaatggagagccctgcccgatctagtgagttagttatgtggaggttggttaaaaaaacttctatatttgtttatttgcatgctactttacagttcttgaagtactttcaaattgattttctcatttaatttttacaatgctcatgaaataagcaaggcaagaatttagaggtgggaaaatggaggttcatagaagttgaattgtgtgactatgaataagtaatttccttgaaggtgcgttggaagcagagttcagatttttcagtcttaagccagatctctaccctctcttctcgattgcctcttttcttgctgttttgaaagcagtgatgagactttgattttatttagatatttataattttcttatagcattatgttaccatcatagggcatatcagtaatagtaacatactacatatgtcaatgttagacatttaatcacctctagcaacctacaagcaaataaagagacaaaactcctctggaccagcactgtccaataaaattataatttgagccacatatgtagtttgaaattttcctttgggcacattacaaaacaaaaaagaaacaaataaaattaattgtatattttctttaacccagtaaatccaaaatatcatcatttcaacatgcaatctttataaaaattcttcttgtgatattttgcactcttctttttgtactaagtctttcaaatcaggtgtgtaaattgctttacagcacagcttatctcagactagccatatttcaggtgctcacttgccacatatgttgaacaacacacctctgaactttaagaagaatattgtaacaaatgcaggcatgtgaacacttggagatacaagcctctaatactttggggccatttaatttcgagacaaatagttttacagatttcggtggctcctaataatgactccaaatcattaaaaataagattaaattatctacattgtatttaagagggccgagtatggtatgaaatatgtatttagaaaactctccatcaaatttttttttttttttgagatggactctcgctctgtcgcccaggctggagtgcagtggcgcaatatcggctcactgcaacctctgcctgctgggttcaagcaattctcctgcctcagtctcctgagtagctgggactacaaggcgtgtgccaccatgcccgcctaattcttaatatttttagtagagatggggtttcaccatgctggcgaggctggtcttaaactcctgacctcgtgatctacccgccttggcctcccaaaatgtggggattacaggcgtgagccaccgcgcccggcccaaaaatatttttaaaaaaggtttgacatataacccagccattgtactcctggacatttgtcccagagaaatgaaaacttatgtccacataaaagcctttacaggattgttcatggcagccttgcttgtaatagccaaaatctagaaacaaaccaaatgcccttcagtgggtgaatggttaaacaaactgtgctacatccataccgtggaatactacttcacaataaaaataaatgaactgtcgatgcactcaacaacttggatgggtccaaagggaattgtgctgagtgaacaaagactcagcaaaactcagtgaaaataatgttttactgggtaaaaaattatgagacattaaaaaaagtacccttttgagattatgctgagtaatctctaaaggttatatttatagaacattcccaaaataacaaaattgaagaaatagagaacagattaatggttgccagggttagggactcaggaggggggcgtcctgggagggggatggctgtggctgtgaaggaggatcatgaggcaactctgtggtggtggaacagtcctgtattgtaattgtaatggtggttacatgaacctatatgtgataaaattgcacagaacgcacacactcacacacaaacacacatgagtgcatgtcaaactggtccaatctgagtaaggcctatggatgtaccaatgctgatttcctgatttttctattgtattagtgttatagaagatgttaccagagggcaaaactggatgacgggtatgtgagacctctctgtgctatttttgtaacttcctctcaatctatacttatttcaaattaaataaaagcctggtgcttgaatagatgttctattatttgtaaagcctccttcctagaactctacagtgaagaaccccagtgaagatgtatgaatgaggatgagcgtggacatctgttcagggacccttttaattttattttatttttaccgttctttatttatttttaattatactttaagttctgggatacaagtgcagaacgtgtaggtttgttacataggtatacatgtgcagggctgctttttctacaagcttggggctgggcttatctcagtgcagaggggaatggttgtggcctagctgcaatctctcccctaaataagaagggaccccattcttgttccagtttcttgttaaggtcactgcagcagaggatgccatctctaggctcctgaatcagaatgtcccctgaggtgccattgggctgtttgaccccaccttgggaatgctagagcctgagatcttgtcacttgctcttcacattttcatattaatgtgtcactggctttcagcagttgcctctcagtaatgcatttagtccctggtgagtatttcatagccagatgaactttaatccctgaatgcgctgaaagggagggttccttttcctcttttgaagattctgctcccctgtaagaaaagtgcatgatttaattagtggatgaaagaaaagggcccaaatggagccaaaaaagagtcagcagcattgccacccacctgcagacacacaataggataaaagcagcacctgatcagggaggggaaggaacgaggagggagagggacaggcttggccgtgggtgtagcccggagttgggaagcccgtggcccaggatcaggtcagccactggctcagtgtgaccttggagctcagcctctgtgggatttgttttctcatccttttaaaatggagatggtagtatagatccttcctacctccagaaacatgtagacagcagaaagaagatgggggcaaatctatgaaagtataaaatgcactataaaaaagtataatgcagtttataaatgattgctcctaatgcatcaactggagtgaaactagccagagtgtaagagaggaaagaggggaagatgcagaactctgttcttgtatcttttttaaaaagcacaaaaaggtgatgtcttggtaaagagtagaagtttgacatgttttgtcgtgataagaatagaattactgtggtgactgtccatttatccacttgggatccgagcattccaaagtataagatgcttcattacaggccgggtacagtggctcatgcctgtaagcccagccactttggaaggtggaagcaggaggatcttttaaggacaggagttcatgaccagcctgggcaacatagcaagatcctgtctctataaaatatatttaaaaaattagcctggtgcagtggaatgcacctgtagtcccaaatactaggaaggctgaggtgggaagactgcttgagcccaggagttcaaggctgcagcccaatatgattgcatgactgcactcaaggctgggcaacaaagcgagacgctgtctcaaaaaataaataaaaatgctccttggctgtataagacatattttattgcccttttggagatttataatgagcacattaaagttttggaaaaatcctgcaacaaagaaatccgttttactttgtttagttcagtaactccttagtttattatccatggacccctctcctgtgccctgtgacttcctcctaacttgttacatagcctggtcaagtgcgctggaacaagggtactgctctgcagaattctgaactgagttcctggggttttgttgttagcttgtttgtgactgtcagactatttttttttttttttttttgagatggagtctcgctctgtcgcccaggctggagtgcagtggcacaatcccagcccactgcaagctccacctcccaggttcacgccactctcctgccacagcctcctgagtagctgggactacaggtgcccgccaccacgccctgctaattgtttgtatttttagtagagacggagtttcactgcgttagccaggatggtctcgatctcctgaccttgtgatccgcccgccctggcctcccaaagtgctgggattacaggcgtgagccaccgcgcctggcccagactatttaatttttgtaaataatttagtgttttgtttttgtttttgttttggcctcaaggaaactcaaggaaaatttgtacctcatggttagtttccattttagaatactgtgacctttgtatctttgtattgtttttcaagttttctttccttgtcttgacagattcacaggccctgacttaaaaattcttgttactgtattgcttgttgtatcataagccatttcagaatctgcctggattgagatgggctatgaatataattaagaaacaaaaacaaactaataaaattacaataacaactcttttttgagggcctgtcatttttcaggcatggtactgggttctttgcataaatgatttcttccttaatgtgatcaaggtgttcctcagttttgtcctaggaggttttagatctcacggttctaatttagtttctcagagtcttacaactgggagggacttttgagagcatctgaccctaagaaataacctccagggagatgaaagtctaaaccagccaggacagatggtcttctgagactctccatggcaacctgcagctaatctctgcccttctgccacttctgggaaaattgctttacggaaatgctgttttaactgggagcatgaaatcactaatgatgggcaaggtgggggtggctggtttgtgtttgggaaattaaggttcagtgcctgtctctctggggggagcagctgctgtgagccaggattacctaggacagtttctgtctgatgagagaaggggacaatgccttcctccactcaggtgggtgaaggaggactctcacatgtgctgagtttgtgctagcatcagtcttttcattgccctgccttcacataccccagcatctcatctaagatgtgtcctgctgacatgagccaagtaatgtcattcttcctcatccagagccatttctggctgtcccaggctttagagcgatttccctcacttggcataggtctttgcaatattttgttatatcatctttccatgtgtaagccccatcttgtctccttgtgtagactgggcactcctgaaggcagggatgatgccctacgcatggttgtttctcaagttactgttcagtaccaggtgcatattggtcctggggtggggatatttattgttgctgctggttggcatcagtatttggtaaatagagtggagggatctgtgctggtctctggagatacaaagatgcgtggacacttttcagttcatagtaataactgagtttcttgaggggagggactgaaatttattcatgtctctccaacactgtacctggcatattgaactgtggcagaggctgctacttgttcttcccaatattattattattagtggtagttgtagtaatagtattaatagtagttttccctctccttctctctttcttcctcttcctccaactcctactctccttctctttcttcctcttcttcctcctcctccaatagtaataggaactttacctgggcacgtttgccagctttccttgcagctgaatatggtcatgtgaggttctggtgaaagagacataaacagaggtgataattgtaacttccaacttgtgctttaaaaggaaagcagtgggccatctcctttttctccttctgttgggctggagcacagctctatctttgaccatatgaataaaggtcacacttttgggatggcagagcaacaaagtggaaggagcctgggtcctcatccttgctgagctgttgccatgaccctagactgaataactgaactgtttttatttgtaaagtaacatttacatgagagacaaatatacttctatcttgtttaaacttttctacctttgggtacaaaaggcacttattatagctgcctagtctgtattctgatcaattcaggaggtattgataaatgtctgttaaatggatgaatgaatttctgccttcccttattattgagcagctttaatagtggtcagcgcatacatttaaattgagaaaggaggtttcccaggtgactttcaccgtatttcattggccagaaatgtgtcatgtgggtctctctggctgcaaggaggctgtggatgtgagttttattttccagtcactgtagatgaagaaggcagaaaaggggtaggaaaaaggaggaatgagtgaaccaatctatagtacctatcagcagtcacatataagaaaattagttttcatttatgtttttttttttttaaagaatataagccacctaatttgagtattgccaagaagagatgtacttcttatcctagttgaaccagattttgggaagacaagatgttttcaaaagagtagataattatcagcgtggaccttggggctagatgtagtcatcttgtcacacaacttgattcatggccatttggaactgtctacaatgggatggatgttgatgctgaggccacctggtgcttcagtgtcttaaatgctttctttggggccacagccaattccaggcaaggcatggcaatcccatagtttgtaggtgatatggaaaaggtagtgtcagggcagtcagaaaccctcagcaaatacttaagtacttctgtgcaccagcaatgctaggtaccagggaatcccataaatgatctctctgccatcaagagggagatgaagagataaactgatgagtcccccacagggtaatgaatgccatatagaatgtctgtgaagagtattgggaacaaagcgggagaacaagacagaaagtttccctggaagagcaataggaggtacctggagcctctatatttaatttctaaagagattctaaaacagtgggtctgaaatatatagtctgcttccaaattgggtttaaattagcatcttgtgtatcatatatacattgtacttgttactctggggaatggagagtttcaaagaagtctagagttgaagcattgtccttttctctgtctaggggagacgcttaagcaaacgtgaatgtacttccaatgtggcatctaagcagagagaccatggaaaggccaagttttaagaattgagtgtttctcctttcgattaaagaaagaaagttgctcatgaatatatgtcacttcaggcaaggggcatgggatcctgaaaatatctgtgtcagaaaatctttgcaaacaaaaatcctcttccacacctttccaaagtcaagaatacgttggacatttaacattttaggttttggattttcttaaagcaaggcacacaagaagatcaaagaaggtgcattgacatgttggcaaagaagaagcatgaaattcaattctgtggaactcattttaccagagaaatttcataaaacaaagtaaacttatcagtggtttaagttgccaacccttggattccaatgcaacaagcaggatggatgcaggcagcttgcccaggttcaatggagtttaaaggccaggtgtttgtgtaggggaaggaaaaacattgtcctgctcaggaaaaatgtattcaaataagaaacgagaaacccattttgagaatttagtgcatatgttcattttacaggtgtgttgggaaattatcggcaaatgaatggatttggtcacaaagcctttgggttgatttgggggaggaatgttgcttcttgggaaacagccagaggaggcaaaagatatttttgggaacattctaaggcattctctttcctcttttttgttgatggcttccaagttgtctagccctgaatctcttatgtgcattggggaattacatagcggtagaaggcacgcatcatttctttacttaactatgtgtccagaaccattgttgagttctggagatgaacagacacacttcagcctttaatgaactgctaggcaggagggggaaacacacatgtaatctaaataatgtaatgtaatgccataagtggtgtaaaggcttgtggttttggagaagaggaacagatgaactgtccagaggacattagagaagccttcacagaaaagattatatttgagctggatactgaaggatcttgaaggtgattgccaggaagaagggaggaaagggcagaccagatggaggtatccacgtatgcaaaggcatggaggtgtgaaacatgatgcctctaggggatgtctcatttagctggaacacgggttttgggaggcccatggaggctattttgggaaataatactggattgcaaatggcctgatatgcttgctagtctacaaatctaaacttaatcttttaagaagtaaataacttctctgtaggaaagtaactacaaacggtaaagaaagacatgcttgtcaaaaaggccagaactcctgaatgtggaccccaggaactcacatgtactatctggtctcccccaggttctgcaaggacatcaaagacctgaattttgcctagaaactgaccctaagagagacaggaagtagtgagaggatacagacccaaccgactgtagaaaactgtgggattgaggttaatatataatttgctttaacttgggtgaatgtggaataaggagagtggcaaaatgttaagttcatactcatctgtttataattgtgtgctctgagcaccctttcctttaaagtgggctgcacacacagagaaagaaacatttttcacacagtttggaccagtgcctgaaaagctcagactcggagcgtccaggagctgagatgcctgtgctggacagcccctgattggagaggagttaatgatcagtgcccctaaaattgtcacataggcagctgattatgagaaattggtccagctgtttaggttacttttgagatcaaaattttgtgttttgtcaggggagtgagttgtcacaaaccccatgtggccaaggagagactactagcctgcccttgtgccaaaatgttgcaagcttctgtgggcagctgattttagtagaccttatagggaaacccctcactccatcttttttttcccctccttcctacactgagatgtagcaggaaggaccctggcctttgggactggaggtgtggttagctggaagtaagtaaggttctgctagttccctggtgaacatagaatggtacttctttctgtctcctcatctgtgaggtaaaaacattcagagactcagtgtttcttatgacattgataagctaaggttccactcccctttctggcctgttttgagttttccctgtatactcagtgagtgcatatgatttagaaaggtctgggtggctcaggcagtgggtgtgagaagagctgcctcactttgggctctatgtccttaggtccaggttgggatcaagtccaataagctaaagaaggctttcgggaaataaaaccagaggtgttttttttttttttttttgagacagagtctcgccctgtctcccaggctgcagtgcaatggtgtgatctcagctcactgcaaccgccacctcccgggttcaagcaattctcctgcctcagcctctccagtagttgggattataggtgtgtgccgccacgcctggctaattttttgtatctttagtagagacaggatttcaccacgttggccaggctggtctcgaactcctgacctagtgatctgtccgcctcagcttcccaaagtgctggagttcgctaaccaaggcctgcaggccaaatttggcctgaggcctgtttttataaataaagttttgttggaacacattcacccacatgcatttacatatcatctgtgattgcttccatgctaccatgtcagagttgagtggttgtaacagagaccatgtgggctgcaaaggtgaaaatatttactagctagccctttacagaagaattttgctaactaacctgtcctagatcataaactctaggagggctggggacattgaaggtagtcagtaagttttgactgaatgaatgaatgaatgaatggatgaatgaatgaatggtcaggaaattggaatttgttggatatgtaatttgacagcagacttttaatgacacacttcaggttccattttccctttaaataaaataagaacagtgctacctatgaaacaggcagtacttaggaggattatttcccataatataactttgggtgtttaaaatgctattaaaaatataactaccatctatgaagctttgtatgtgttgagcactttattaagagctttatttttattacctcttttagtcctcaccgccacccactgtgagggaggaattattgatcctagtttatagatgacagagctgagtccagagaggctgagttacttgctgaggtcacagagctggtaaggcattgagcacagggtccaactccagggtgtctggttctaaaggcttcccatcatgccccattgcttctgagtgctgttaggtgcttcccaccacttttttaaataaaagagacagatatcaattttggagaggggtcttcaagatagaaacaaatggcaaaaaaaaaaaaagttggttatcaaatcttttaaaccatttatgtgatttagaaaactgtgaagttactcatcattagaagtgcactttaaaaaattctcttccttaaggttcagctcagtgtgcttcatggaaaaaactaaatgggggagcatgttttctttgggaaaaacaaaataggtaagttttagggatttgtagaattttcatttgtttagcaatggtgtacgtagtggtaatacacattcaaatgctgccttctcccagaaaccttctgccaattccgcacatcacttggaactgggtacctagcacatagcagacattcaataaatattgattgaatgaatgaattagtaccttctagcatttcacacatattgccttccagtatacttggttttatgtgaatgtgtgcccttacctattatagcataagcactagaagagcactggtaccctgcccacttctttgtaccccttatggtacctacctagcacagggctggaactgagtagatgctcaatgaacatttgtggaattatgctgtggcccccaaattattttgtggcccctaaagctttgcagctgagtgaatggcccattgaaaactagcacgatgatcagatggacttctctctgtctaagggcattgattgagacccacatttatattgagggtggaaatgtccaacaaagacaaagaaaagcatatttattgctttagatagaagtcatatttgtttctttcactctggaagatatagtcacataaggtcatgagctattttttcttcctacttaattgctagtctgtgggttggtgaaagctcacatgcttagcttttcagtgaaactttcacagtccatgtggctctgactcagaattttttcccctatctgcttcttctgttgccaattcattgtttatctcctttgtgttttacatctgacctattattttgcatgctgttttggattactgaggtagcaacatccaaatagtttctgtgtacattttagcttttgggagtcaggcagctgctctggggcctgtttgagtcaggtcagggtcagaaatgcccttctgcttttgtttccgtggaagaagttggcctggaactctctctgggcaccttctgcgccctctggcaaccagaaaagcaaagtcgttcatcaaaatctcagactggagcaactccttaaaacagcttccacagttcttgcacatactcctttcttgatttgttgcatatcatttcaggcacctcttttaatgcagctattcaggctgcctaaggcagtggtccccaacctttttagcaccagggaccagttttgtggaagatagttcttccaccgatggggtgggggtggtggtttggagatgattcaagcacattacatttattgtgcactttatttctgttattattatattgtaatatataatgaaataattatataactcacaataatgtagaatcagtgggagccctgagcttgttttcctgcaactagatggtcccatctgggggtgatgggagacagtgccagatcatcaggcattagactctcataaggagcacgcaacttagatacctcgcatatgcagttcacaacagggttcgctcctatgagaatctaatgccaccactgatctgacaggaggtggagctcaggcggtaatgcaagtgagggggagcagctgtaaatacagatgaagcttcgctcacttgcccacagctctcctcctgctgtgcagccaggttcctaacaggccatggaccagtaggagaccctggcctaagggaccaggacagtggccagtgcttttcatagcctcttagtacttctggtggagtgtctctattcccctcaattccctcctattccgctaggagtttgaatctgctttgcccagttctgtcctgccagcctttttcctttcactgaattgccttcactttttgcctattagctttgatctctttggaaaaaagggcactggggtattattactgcctctgtttgtttttgcaaatgcactatgatttgtggttggtcttttggctagcctgaggctacctgaccctccctcaacagccctagttcccccaggtcattctatagttttgcccatttctttaattaatgttggtgagagtctccgagcaatgaagactttttggatatggagagaagcagaaccagagggataccagtaattatgctaatctgagagcattaagtcttcaaatatacatttttggataagcaattctgttgtttttgaagtttggttgtctttttgtttctgggtggtggactataattttgtattaaggaaagaatgcctgcccttatatatccaggactggattttttttttctttttcttttcttttcttttctttttcttttttttttttttttgagtactcatgaaaggaaaccataagaatgtttgggtctaataatatacttgcttgtgtatgaagataaaaccaataataacattaataccacccttcagtggtgaaatgctttaacctttcaaaacaactccttttatgaacttactctatcagttggcaaggtgatttcagggctatctcctgtggtgatgatggatctgtgggagcttttctaattgtgtgggtgaatttgagagaccccatcccagtggttcttgttcaggggtgagtatggaatcatgtggggaaccgccatgaattacacatacccaggtcctgcccaggacctactgacacagtcctggggtgggggacctgcccacttggaaaacttcctgggacttcctcagctggaccctctggggattggggaaatgcattgcagtcacctgcctggggtagtaggggctgccacatctgtgactaggacccaaggagagtgatgatgacccttcttggaatcatgcagaacacacagtgacagtcccttttggaagctggccacaggctgcactttattcattattttaacagcaaccaaacatttgctgtgtgcccactggtggccgctagacagtcttcccaccctttagctcatgtagtcatttaaaccagttccatcactagagaaatgtgttactagccccttgaaggagagtgggccttcaactggattcaggagttgtggtctgaggagagtgattgatatggtttggctctgtgtccccacccaaatctcatgtagtagctcccataactcccacgtgttgtgggagagacccagtgggagataattgaatcataggagcaggtctttcccatgctgttctcatgacagtgagtaagtctcatgaaacgtgatggttttaaaaatgggagtttccctgcacaagctctttctctctttgcctgctgccatccatgtaagatgtgacttgctcctctttgccttctgccataattgtgaggcctccccagccatttggcattgtaagtccattaaacctctttttcttcccagtctcgggtgtgtctttatcagcagcatgaaaatggactaatagagtgatttaatgagtttcaccagcatgggtttctttagcctcggtttctttgtctgcagtatatgggctaatggtacacaccttgaggttgttgagggagaagagacgggctcaagtgctgcctttgtcttaccaaccttgtgaagcctccttgagcagccatgtcttcatttgtaagatgagaataagagcacctgttttatgggctttttgtaaggattgcgtgtgctcatgtaagaaaaaccccttgcaccctgcatagtaccttgcagagcaaatggtggtgataatgacaatagaaggagctctctttattgagtgcttactgtgtgccaggcactgtgctgggcactggactacaacagaggggaaagataggcatcgttcctgacctcactgcgcttaacaaagagaaagctctaagagaaagttttcaaagcattacccttctctgtatatttaagaggaaagctttaatgttataggatgccttctaaatatgtattttataacacagtgggtagaatgtggaatgtgtcttctgggagggaactggagttttgcatttcctgcctgcttgtgcttttgaatttgtggctgtaatgctgccctgcctgaggtttcagcagttaatatttcccagggcagcatgatgtcaacgccccgtggtctcttatctacaagaagggtatagccggggcagagggagagaaaggactattttcaaagcctctcttgaagactttgttgagctttaacttaaaattttcctcatctccttcctcaaacgtttgtgcttgatgtgcataaaccatgccagtgttttggaagattcaagtttgaccaccataaattggttcatatttccagcagggcagttatttaatttcctgttggaagtctacaaaatgttggcactgtttgctctttggcagaagaccaaaactcagtacagtatcattagcatgctctggtacatagattaaagcacgattgtctttaataagaggccatccctgtttaggatggggctttgggggctgcaagggtgcagggaagcacaacgagctttctaatcaaaatcaaagtgcagttactgggactcactcgagaagggttaaagggagggcagaattccgatttcttgtctcaatttcatttgtttgggttattttgctctagactctgggagagttttggaggccagggctggctggtttgtgggataccctggtttaagcctcgtgcttcttctgcattcctccctcttggcagtacggctcatgggagaagcccacctctgaagcccatagagaaatgcagagtgtctctacggaacccactgtagtaactgaaatgttataatggtgggcatttacagaggctctgttatcagtgaggcactttacatatgcatattcagcctttacagtaaccctgtgagatacgtattattattgctgttttgaggatgagaatactgagatgcaaaaagattaaagtatctgtagccagtgagtatctgagctggggttagaacccagttctgttccttggaaagattcttactcttctcatataccctaataagggcctggggaaggaaaggatctgagttttcaaaaaagcttgaaaatttgcctaacatgaatcttgggaaattatttctaggggcttcttaccagattagctctgtttttctttcgcagaggcccttcagtgttggctctttggtagaatgagcatagaaatgtatttttttcctacaaatattgtatcatgaaaaatgtcagacagattgaaaagttgaacaccacctacattctactattgctgttttattctatttactttatcacttgtttctccatctaacctctaagatctatttatatttgttagaacatcttttctctctgcccttctgttcctttgattgatggcaatggcctgatgggaagtaattcacaaaaccagagggaaagtacagtgcttagaacaatcttttttttaggaaaaagagaaaattgttcttatgtttaggtagagcccaaaatgggcatttttcccctcccctaggtctgttgtttaaaggatctgacagaaataattataatgaggctgatggtgaatacataaggtataacctattattactgtcttctatgcaccaggcatgatgctgactgcttagtaaccttatctcattgatcatttcaacattcctaatttacagatgagcaaacagcctagagaggttgatttctgagctgggatttgagactggtgtgtagagactatggtgtgatttctctgcatttcaaattatgcttccctatatttttgttccagggtctcagtgggaggccctagaaggttactactaataaggaaaaattgctaaagccctggaaattgaaggctaccagaaccttgtaaagattctctgggactagacctcattcctctgaggatccttgtcagacagtttccagggggtggggagatgttctgctctccccagagtgtcatagaaagtttctgtggctttcggaatttctcatgactgattcacatcttcttctccagcttagaagaaaatccaaacacttacctttggtttatcagttggttaatgttgttttcttttcatggtaggatcatctatggcctccttagacctatacaagtgacatcttttcttcctggggaagaagatggtttctgcaggcactgacttatgagggcaggtgcataccttttgtaagggatgaaacttgaaaaagaatgggtgctttttgatgtgtttatgcttgaacctgcttccttgttgagtgtgatcttgagcaagtcacataagcttcttaaactcttggcatccctgcagcagttattattgtgagggagatggaaaaaaggtatggatagagttctttccattagaaaatgtaatattcctcaggagcccatgaagaggatgctgctgaaaactgaggacatggcatagataggaattgctagagaaaggcagtagagagaagaaaaatacctgttggttgaaatagttgattggaggaataaaaattgcctggaacttaaagtttccttcgaataccagcactgtccatcagtagctgtataaattagcctctttggtcattaagtttcatcataaagtgggattattaatacctacatcatagtcttattgtaaggataaagtttacataatgtatgtaaatctcctaacagtagttcatagtacttggcgataaaagatatctcttagaagtaggaaatggggaaactgaggtacaccttgaaacctgagtaggatttggatgcgtaaaatggtccagttctgaaagtattttacaaatatcaccatggaacactatgcaggcatcaagaagcatggttgaaacccaaaactcttctttcttttaataaggcaaaggtggttaactttttgagccaaaagttccaaattgttcagtaaaatgtcattgataagatatcaaaatatcagatatcattttggttgaagctcaagttggcaagaaccaagggtggaattgctaagctgggtgacacatttgaagccattgtaatgttttagtgatctccacagggcacgtcattggtggctctccctgtccccctgcaagccctgcaatctggctgcattttctacacacttgtttggttgtttcatgaaatctacccccctgtactgctgcaggccacaaagaacagtgttcagtaaggtggattttggaaactgaagttgtgattgcactgtagaaggctttcattgtttgttttgttttgcttttagtttatggaggactgttgggagattaggagaaggaaaatgccccagtagaactgaaatcctagtctagcacctgaaaagagtgaattttgccttcttttttttctctgctaccttgcagtcatttctgctatatgcagattcaggtttgatgtgaattttgagtttagctggaattagttctttcatggccttggggaagatgtggataaaagaatgaacatactaagggttgacagtaaaattcaaaggtcaggtaaggttctgtatgcatcctctgcctggagtggttgtgtagtgatagtgttaggactttataagtctttttctcacatcatccttataacaagccttagagataagtattgtttttattgctattgtgcagatggagaaacagatgaggaatggagaagttcaataacctgtgtgaggtggtacagctaggaagtggcagagatgggacttgaattcaaatctctgacatgtaagcccttccagcaattgtggtggaatatgctatctctgttacaggcttctcttgtaacaagctgtgcttgttaatgctctataaggagcctctgggagcaaggaaaagggaaagattttttgtgttcactttgcatccacacagccctttttattctcaagattatgctggggggaggaagcactagaactaccgtgaattaagtgttcacattgtacctagattaaagcaaggtgctctgcataattctcacatttaaccatgctgtccttatccttatttcattgatgagcttcagaaagtcaggttccttgaccccagtttcacccacagaggaagttctgatggtgaaatttgaacacagaatgagtccaccaccttgccttcctcttcggttttcaatgacttctccctgacagtcctgcgatggcatttgtggttttaatttcaaagacccttacaattgttgatggttgatagcatttggtatccattggaaactgccaacacttttcactgctgcatttggaagaaaatcatagtgagttgatgtgttagtgattcaggacttctgggaaactgagagcacccgtgtgtacttatttggagtcaatactttatgaacaactttggcccaaaaggagaaaaatctgtcttctgaaattgagtgcaggtctcttagtggcttacctcagcagggagccagttattacataagctgaataccaggtccgtgggtttccctaacctgaaaaagaagcagcgtttgcagttatgaggaaaacagaaagacccatttctctgtggcatgatactgaacaggcagcttcagccgtgaggatattttggccggaggaaaatgtagcttaagaaaagtcccagctggttcaagtgacttaagcccagctattcatgaaatattatctgacagctcccccttctcctcaagtggctggggagtgagtcacaattgccccagaaacctgtgttctcatatgggattttggtattccaggtttgctctactttgcacactggacagcttcatgaaaagccatatttggtgcagacattttcttgtgatgataaaagcatttagtaaatgtactgggaagcttgccgtgatgaatccttttgttaagaaattaaccaacattaattttgaatgtaggactgtcccacgtgcccagcactgtgcttgctgatgtgggggttcagagattatgagacatgtgaaacactagaatggaatctccatgaaggcagcgatttgcctattttgttttctgatgaaactgtggtatatgtaacagtgtctggcacatagtggatgcgaaatagatatttgttgaacaagtgagtatgtctctgcccataacagcttacaacctagtttgcttgcattaattaatcaactaattattaattaatgaatgattttattcctttattctacttatatgagcatccagaagtcctcaattttattaggatatctttaattctttttattatttaaaaaggtaaacatgtgatgtgtttgttgtagaaaatgagaaaagagcaaagatgtaaaaagaaaaataattgagacaataattattttaatttaagcttatatcattagaaactttttccatgtaaatacctgattttaaaaaatgagtttaattctcttgcaagttgattttataacttgctttcctcccacttatcagtgttattgtgaacagctttccatatcaaaatacactgttctcaaatcatcaatttttaatcacacaatttagcattgtgtgtgattgcatcatagttttcttaatccctattgttgaattgttgggcattactcctctctctgtttcattagtataaacaatgctatgattatctgttaatttttgtgcatatccatgattattttcttggcaataaccctttgaagtggaattattgagtcaaaggtaaaagtcttttgatctacacaatcattgtggctaccataaaggttacagaaatgtattcccctctctgtgttctgtggaaataaagtggtttttttgtttacacataactgatgccatgtattgtcatttaaaaaaaaaacaactttctgggttaaaaaagggaatattattgttatttaagttaatatacttttgattactggtgatgttaaaaatcttttaaaatattttttgtcatttgtatttcttcttttgcaagttactggtttatatccattttcttactcagagactcgaggacagatcttctttccttggtccctcccaatccatgatgggacttgctatggaatttgtccacagttagccccagtaaatgttgaatcctcccatccacccactcattcatctacccactcacccatccatccatcgatttatatgttgattcattcaatgagtatggaggacctaatagatacaaggtttataatttaagatagcgctttgaaagtttttttgatattgctgctaactacagacattacttttttttttttttttttttttgagatagggtctcactctgccatccaggctggattgcagtggtgctatcatagctcgttgtaacctcagacttctgggcccaagtgatcttcctgcctcagcttcctgagtatctgggactaggagtccgtgccaccacacccagctaattgttttattttttgtggagataagggggtcttgctatgttgcacaggctggtcctgaactcctggcttcaaggaattctctcacctcagcctcccaaagtgttggaattacaggcatgagcccccacacccagtcaaaatcttaaacttttttttttttttgagacgaagtctcgatctgtcgcccagggtgcaatcccggcttactgcaacctctgcctcccgggttcaagccattctcctgtctcagcctctctagtagctgagattacaggcatgagccaccactcctggttcatttttgtatttttagtagagatggggtttcaccatgttggccaggctggtcttgaactcctgacctcaggtgatccacccacctcggcctcccaaagtattggaattacaggcgtgagctaccgtgcccagccccaaatcttaccttttaagaaaagacatattaatatgaattaatacaatgagcaactaatccaaaaagttttttttctcctaatgagttttcctttgggtaatggaactgatcttgtcttttctgtgcacccagcagggttgggtagacagaaatcaacaaatgttttctgtaaaagtctggatagtaaagatttcaggctttgcaggccatatagactctgttgcaactattccactctgctctaaaagcaggaaagcagccatagataatttgtaaacaaatgagcatggctttgttccaatgaaaatttatatatagaaataaaatttaaatttcatacagctttcatttgtcacaaaatattatttgtctttttttttcccccagtcacttaaaaatttaaaaaccattcttaagtttgtaggccatacaaaaatagacagtgagctggatttggcctggggtttgcagtttgctgatccctggggtagggtctcagaagcatgctttgaggctttgaggagctaatctggttttgcaaatttgctacaaacaaccccacaatggatgattcataaatgaataatagaattgagtttagctgaggcttggatatgtatcctacctcttaatgactggcaatacataattcttagtgtgttagcaatattttaagcttctaaaaatacttttattatatatttactcataaaaattttacagttatgagcaaagaaaaaacgctttcctatcctttgtcaatattttgatgtgtcttttttcagtcttcatgtatatatagggcttacgtatgtataatgtctttctttacaaacactgttgaatcctgctttatttctcttaataatatatggtaaatatttgtcagtgttgttgaatattcaaatataaactgaaaccacaataaaataccactacatacccacagaatggctatgattaaaaaaacaactaacaataccaagcattggtaaggatgtagagaaactgaaatcctcatccatttctggtaggaatctaaaatggtgcagccactttggacaacaatttggcagtttctttaaaaattaaacttagcatatgacccaggagctccagtcctaggtatttatccaaaagaaatgaaaacacatgcccacacaacgataggtatgcagatattcaaagcagcattatttataatagccaaaaattagaaacaacctaaatgttcatcaactggtgaatggataaacaaaatgtggtatatctatacaatagaatactatttagtaattaaaaggagcaaaataaagagaggctaccacatggataaacctcaaaaacattatgctaagtgaaagaagttaagcacaaaagaccacatattgtgtgattgcatgtacattacatttctagaaaaggcaaaaaactagagacagaaagcagatcagtgtttgcctcaggcaaggtgggaatggttagcgtcacttctaggagcagcagaacttttggggatgacggaaatgttttaaaagtcgaatgtggtgattgcacgactgtatatatttactaaaattattgaactgtacactaaatgggtgaatgttatgtgaattatacctaaatataactggtaaaaatattctttgaaagctgaatttttaatagtgtcatattattccatcatgtgaatgttttatttctttatcctggatgacttgggagaaatattcagtgtttatttccttttacgccaaaatccatattcagtaggttcaatttgagccattggacttaaacaagaatgattcagaggaatgaatcccaatccagttgtcaagaaacctagcgtggtctcaatcctgcctccagctgggtggacctcagttccctcatctataagatctaggacagaaataaatacaaggaaatactgggttccagggaatagaggattagaaatagaaaacatagtagtggcagtaatgaataagactgatttccctaaaagtaggaggccaggcactgattatttttatttttattttttagcttttaagttcaggggtacatgcacaggtttgttacctaggtaaacttgtgtcatgggggtttgttgtacagattatttcatcacctgggtattaagcctaggactcattagttatttttcccgatgctctccttcctcccaccctccaccttcctatatgccctagtgtgttgttcccctctatgtgtttatgtgttcacatcatttagctcccacttacaagtgaggacatgttatatttggttttctattcctgagttagttggctaaggataatggcctccagctccatccatgtacttgcaaaggacatgatctcattcttttttagggctgcatagtattccatggtgtatacataccacattttctttatctagtctatcattgatgggtatttgtgttgattccatgtctttgctattgtggatagtgttgcaatgaatatatgcatgcctgtgtctttataatagaatgatttctattcctttgggtacatacccagtagtgggattgctggattgaatggtatttccatttttaggtctttgaggagtcaccacactgtgattcacaatggttgaactaatttacactcccaccaatggtacattgtggagaaaaaggaatgctttctccacaacctcacaatggtacattgtggagaaaaagcattcctttttctccacaacctcaccagcatcagttattttttgactttttagtaatagccattctgactggtgtgagatggtatctcactgtggttttgacttgcatttttctaatgatcagtgatgttgaactttttttcacacatttattggccacatgatagactggataaaaaaaatttggtacgtatacaccatggaacactgtgcagccataacaaggaatgagatcatgtcctttgcagggacatggatggtgctggaagccgttatcctttttttcataatggttgctggctgcatgtatgtcttttgagaagtgtctgttcatggcctttgtccactttttaatggggttgttgtttttttcttgtaaatttaagtttcttatagatgctggatattagacctttgctgggtgcatagtttgtgaaaattttctcccattctgtaggtagtctgtttactctgtcgtagtttcttttgctgcagagaagctctttagtttaattagaccccatttgtcaatttttgctttgttgcaattgcttttggtgcctttgtcatgaaacctttgcctacaggtgctgtttatttacacccctgtcccaacctcaccccactccctttcttttgctggtgggaagtcagtaagaactgtgggtggggttctgaggtaatcaatacaaagaagaaggtaagaaattggaggggactcaggggagatggcaatgctgacaaggggttggatggaatttgttctgtaaactggaagcattctgcttggcctcaacacttgccaaggcgttgatgacacacaatttggatgatttaatcaccaggaaactatctaggtttcttgttctgaagtatgagaggacagcctattaaaggaagaccgaggctggatattgccatgaaaatagtaagttttcacgtttggcttccgaggggagagctggtgccctactcactgcagggaaatttaaactgggtgaaactgaactggtttccaattgcttgtgttctccatttccagccaagttccaggttttcctagagtacagccaggagcatctgcacctagagaacacagaataaaattgtggaaaccaaacttgtaaatgtttttctcattagcttcaggctcccagccaccaataaactgtaggctttaaaaaatcctgtattattttgcaagttaagagaatgtgcatattccccttatttatatgttcaggattttcttaaaatgttacacatcaagcatttatctgctaagccaccccaaaaggtaacagcattctagtttttgtacaaaagagaaaaaaaattccacttaataaacttgcagtaacttgagcctgttggtggtcttggaggaaacccaaatccaggtttggttgatactgtgtaatgtgaatgcaattagtagcggtttttctaaagtagaaagagatgtagaaaaataatgcatagcaaatttaggtcagagctgggaagcttataaatccttatttttgttttcattactttaagtaatagggcttttgtctttattatgtaatttccctagcaataatatgttttaaaacatttttctgttaatttcatacatttgatcagaaagccacagttcataaacccctgtgatgtggcagctgtcactgtttatatatagaggatgacttcttgttcatccctgggaggccaacacaaaaattactgatgggggcaactttcactacctgttttttcatttagtagaaggtttgcaaagcagttttcagttgatcaacatcctcctgataggctaaggagtgaactgacctttacatgcatggtttatttcagagcatgttatttgattccagcatatttaaacctaagcaactagattgtaaggtctgtaaaaacagaatttgtctttctggttttttactctattcccctggcacatagtaggtgttcaggaaatattagctactattctcctctccaagatgcagctgttcctctccagctgtcctgtccttgctgctcctccttgaacttgccaggctactcctgcttcagcactttggagaccacagaccagcagggatcactccctctcctcttctgggtctttgttcagattataccatctcagtgaggccctaactatctccttcctttctttctttatttttccatcatatcatcgccatctgataaactgatatattgatgtactgatatattgacttatttatttgggaatgtgagctccaccaggacaggtgtttctgtctgatttggttattgctgtatacctagtgcctagaacatagttgctataatttacttggatgttccgccacgtactggctgtgtggtaatagctaatgcatttgctcccttggatcctttgtttgattccccatttgtttcatatggcatatgtgggtcagatgagatgttgcacatgaaagctcttttatgctatgtgttatgcaaatgtattcacttatttattcatttaatcaaccagatgcagttcctgccttcacagagcttaataattggacaaataagtaatttcaccaaagtgggaatgcgggtgatagggatagtgtgatagggaatgtgcagcgtgctatgggagcaccgtcacgagggattcctaattcagatgtggggacaggaccctggaaggcttccaggaggaaggaacatagaagctgagatctggggatggaatgggcattcaacaggcgaagggagtgtgatgtaattgatggcatggagagtattgcaggtaggaggaataatgtacagagtctggaagtgcagaaccatagagtactggtggaactgaaagtaattcaatctttctggaatatccagtgtggggacagataagtggatagggatgtggctcgtgatatagtctggggacagatcaaggagcgctttgcaggccatgctggggagcttggacttgatcctaaggacagtgtggagccatggaagtcttccaagaaaggagtgacttggtctgactttcattttcaacagtcattttatggagtaagacagcttatttcctcgccaaggaacttgaacacaagctcccaggaagggaggttgtgaaaacagtgaaagggccttccagaaagtaaatccttaagctccatgaaattagcttaaattctgtttgaatctgactggtgaatatcatagcaatgaggccaaaaaaaaaaaccttcataaaaacttaattatctttgaggccgtagctcatacttgagggaagggacatgggtaacgctagagacatatatgtttgcattaacttttacgccactgtggggcagacaattaaagcaggagtggaggagtcagagcagttttgaatctgcttttaagtcccagagagtgtcacagtacctcctacccagcactggttgccaaagtaaaagaaagtggtaacaatagggcataaggtggtggagaagaggctgggtagaccttggccatattcttgctttgcaccttacactgctataaagaactacccgagactgggtaatttataaacacaaaagaggtttaattgactcagacttctgcatggctggggggtctcaggaaacttaaaatcatggcagaaggtgaaggggaagcgaggcatgtcttacatggcagaggaggagagagagagtgctaagagagaagtgccacttttaaaccatcagatcttgttggtttaaaacaaccactatcgtgagaacagcatgggggaaagcacccccatgatccaatcacctcccaccaggtccctcccttgacatgtggggattacaatttgggatgagatttgggtggggacacagaaccaaaccatatcattttactcctggcccctttcaaagctcatgtctttttcacatttaaaagctaatcgtgccttcccaacagtcccccaaagtcttaactcattccagcattaacccaaaagtccaagtccaaagtctcatctgagacaaggcaagttctttccacctatgagcctgtaaaatcacaagcaagttaattacttccaagatacaatggggatacaggaatttggtaaatgttcccattccgaataggagaaattggtcaaaacaaaggggctgcaggccctgcaccaagtccaaaacgcagcagggcagccattaaatcttaaagctccaaaataatctcctttgactctatgtctcacatccagggcatgctgatgcaagaggtgggctcccaaggccttgggaagctctgcccctatggctctgcaggatacagcacccctgacacacagctgctttcatgggctggcattgagtgcctgcaccttttccaggtgcacagtgcaagctaccagtggatctaccattctgggatctagaggctggtggccctcttctctcagctctactaggcagtttcccagtggggactctgtgtgggggctccaactccattttccccctctgcctgccctagtagaggttctccatgaggactccactcctgcagcagacgtcttcctggacatccagacatttccatagatcctctgaaatctaggcaaaggcttctgaagctcaacttttgtcttatgtgcactcgcaggcccaacaccaggtggaagctgccaaggcttggggctcccaccctctgaagcaatgcctgagctgtactttggccccttttagccatggctggaactggagtggctgagactcaaggtgccatgtcctgaggctgcacagaacagggagtgcaggagggacccctggcccacaaaaccagttttcccttctaggcctctgggcctgtgatgggaggggctgccatgaagatctctgaattgccctggagacattttccccattgtcttggctatcaacattcagcttctctttatttatgcaaatttctgcagctggtagcttgaatttctccccagaaaatagatttttcttttctacaacatggtcaggctacaggtgttctaaacttttctactctgcttcccttttaaacataaatcccaatttcagaccatctgtctgtgaatgtctatgactgtatgctttcagaaaaagccaggtcacatcttgaatgctttgctgcttggaaatttcttctgccagatatccaaaccatctctctcaagtttaaggttacacagatctctagagcaggggcaaaatgccaccggtctctttgctaaagcataggaagagtgacctttgctccagttcataataagttcctcatttccacctgagaccacctcagactggacctcattgtccatatcacaatgagcattttggtaaaaatcattaaacaagtctctaggaagttccaaactttcccacatcttcctgtcttcttctgagcccttcaaatttttttattctctgcccgttacccagttcctaaatcacttccacattttcagatatctctatagcaatgccccacttctatcaggaccaattttctgtgttagtctgttttcacactgttataaagaactgcctgagactgggtaatgtataagcaaaagaggtttaattgactcacagttctgcatgggtggggaggcctcaggaaacttacaattatggtggaaggtgaaggagaagcagtctcctcccttgacatgtggggattacaattcgagatgagatttgggtggggacacagagccaaaccgtatcaaccagtgatgtggctttgggaatcacttaacttccctgaacctctgtttccttttctggaacatggaattagtactactgatttttcagtgttgctaggattcaatgagataaagcacagtcagtgctgctataacagttgttttgaaaacacacacattttttcaaagctgattgatgtattcagaaaaatttgagaataatgcaaattttatgtttacttacatagtcagttttatccacgaaaagtactaggtggactcagaagacggcactcagctaaagtgagatgcatggcaatatacaaacacacacacctgaaacatctaccagctcctcagttcaccaggtgtgttgagttacactcgagttacactcatccacatctgccattacaactttctgtccattttctgataaccagccccccacccaccacttcacaataacccataagctgtaacccttacaatgcccatttccacaagaaagtagtagtgtgttccaatcttgttttcccataaactctgctgtttttactgcacaattttgcatagtgtggtgatttctcagaactcatatgttgtgttatagcagaactgactctgtctaacacaattcctggcagacagcagacactcagtaacaggtagctgttttattattaatattaatccacttaagtacaattgtgggttggggcagggatccctagttacaatgtttagctgctttgattagtagtgttaagtgaaatggactgcctgagtggaagggttttggtgcttttatcttttctaagtgtgtgctggtcagaccacccttggggtattaacagtgacaaaccaggtatgtccagaaaagagcaagccagaaaaggagaagacatgagaatgatctttaaatagttagagggccatcttggaagaaggattgctttgttttgtgggtcttcagggtgacaaggggaagctcccagggcccagggttctggctagctcggggacgagcctcagaatagtccctgggggtgatgtgttctccaagctctgattggctgctctgggaggggagaggacagagaagagtcaagcacgggtttggaggttctatctataaagttccttttcatttttttttttccttcaaggtagtgtgcaaagacagattctgctgatcagagtaaatttcagacagaaacaacccaaacttttccagcagtatttggacttctgcttgcctgcttgcgtttttttttcttttgggtgatctaagagaatagttagcacatgtgcatatttacgcactggttttttttctagttatgcccttgaatgttgcaaatataaagactatgctttacaaatatttatggcttctggcatgcttaggaatagtgaaattacatcaatgctttccgtctcgagggcttttttttgacttttcttcttcttcttttttttttttttttgtttgtttgtttccaactcagggaaaaagctcagttagttactgacctggcattgctttctctctaacatcctgtgtagcttttgtcctctccatctaagcaggctgttaagctcttgtagtaagaaagatgttaccctgggcttagaccctctcggtggagctgagatggagaagcctccggaagcatggggcatttgagctgagggatggcaggatctgcttcagatatttaaagtgggttactctgagcctgcaaactagagagtctagtgtggtgtctctagaagaattacttttgtacccttagatgaattaaaaagtaattatactgagtgttttatcttgcctgtatacggatgtataagattccaggtttctagttgatgttactgttaaaaacagaagatgttcaaacatatttgattttattaaattagttttccctgtagtcataggaggggtactgctgtttacatgctgaatcttagcaaaactataaaatagcatttttaaaaaatggcagctcttctgttctgatgctttgacaattaatgttatctctttttgtttctatgatgagcacatgggacttaggcttactcttaaaatggatttttccaaaaccaagagttattacatttcttcctctgagacaaagtattcaggcctcctcctcttctagcactcagtctggaaaatgtggttagtctttccatgtgggagctcttgtgctttgtgcattggttccaagatggcaagtggactactgttccaagatctgggcccaaggcatgtcgttgggctcgcctgaacttgtatataatgaccagaaggaattggtctgcactgccattaccgccagccactacctgatcaattctgcttgggaaatggctctaatcaacattcttctagacctgctgttcatggctgcaggtggcaggctcatggatcaataattggctggggcggttggccccactggtcaacctcactccttgagccctatttacctgttgctgcctcctccatcctcccctaaagtcacacagcttcaaataaggtggtcccatctattttggtgctttcccttctttcttaacctcccataatggaaaaagcacaggttccagaagcctggttttaaatctcagctctgttatttatcagctttgtgattttgggcaagtgacttaatctctctgagcccttgctcactcattttaaaatgatgtcactcatccctttcagagctgttaagaaaacatcatgcaaaccatctggtacagtgccagacacagagaaagccttctggaactggaatccacacacaccttaccaattactttttgagtaggtcaattgccagcatgtctccagagcaaaaagattagatgatcctcctttctttttgtgccaggttctgcccaggcccaggggctgcagagatgagtaagaggaagtccctacctataaaggcactcccagttttgctaaaatccatttttccaacaaacgtattttgatacctactgtgtgcaaaatttatgtgcctttggggaggatactgagatgattcagtcactcatttattcatcggtcatcagtcgtgtgccagatactgttagaagcactatgggtagaaacaacaggcaagacattgtccttccttttgagaagctcatagtgcagtaaaatatactaaagtatgggagaagtagatagaaagagaatatgatctcattgttaaaaggcacttgtgttgttggacaatatagggtgcacacagtaatgtggatttcatttttgcaagtattcagatcttgatagagcttcattgagacaaccgtctccttttagaggaaatggagcttgggagtggttaatacgtcacacatttaggttaaagtaaagctgacactagccccacagaaactttaatttgtgtagtgactaaagtgaaaacactctctttcttcttgattctattgtctcccagcagagattttataatttgaaaacattgttccttaggtagccccaagaggtagattttcagatttgctgcttgctttttgtaaactattgcattccttcctcccaatagccccactggggtcaggaccattttgaacttaaagaacttgctcaaagttacacaacttgacatacaaagtcaggatttgaatccaggtttgcctgattccagagtccaagccctaagcctcaacaccatagtccgtccatgattcacactcattgtagtgtctgatggcttttgagactttgtagaaaaaagcacatcttaaatcatttttaggacctgtttatctgaaccagtggaaaaactaaatttacgaaccataaatagtgtctatagatgtggaatgccaagtgagttaggatatattaataaataggaacaaaaagttatgaccaaaagttgtgttttcctatacccagtttcttaagatttcataattagcaggggggaattctgagttgatgagtataaaaaggcctctgcaggtagcccaagagacgatactaaagtccagaggttataaacagaaagaggaacagacactgtagatttttctctactccatgacttcttcttgcagaaattctgcacttggcactaatcagacctaaaattaatttcttaaaatcaccaatgccttatttaaagaggttaacattctgcatgtagctgctccactgccaaacaaaaacacccctggttcttttgtgaccactaatgcaattgactttccatctttttaagaatgccccctcctatccctccatctttgtctcccaattaatttatgtttattttgtaaaaagcttgtgggcctgttgagttgatattgctaaaggctgacaaccacatagaggtacctcttatagcgatgaagtgtgtgtgcgtgtttgaattatctgttaaccagcatcaagacatcggttccctgtcttggatgaatggcaggggaggctgagcttaacttggccaaagcagcagggggctaatagaatgtttctgttccccataaagaaaggtagtcaagcgtctgtactttccactgaactccagtttctatcctgctttgaaaattctgcttaccctttcagtgagagccacatgacaagtgttcagtatgtcagatttgttttcattttattactacgtatgaatttgacctccacagtagggctgcattcatttcccaaagctcttccaataattgtattcttttaaaaaatatgcatactattattctttttcagattgtgttatggctggtgttttgaaagtggttaaaggatgactggttgcatgtggagtaatgtgtacatgatgcacatttccagatggaaacagccctcaaagttccctatgtagtttgtgtacctattctactcatttcattagactgaactcagtactttctggccagtagagcaggtttttttctttgacaaaattaaatttggataaccttttctgaaaagcaatttcagtgtgtcatattgacatttatattgataattaattgtttgtggctgtcaaaagaaagtgtgtatctttgcttgaggccaggagttccagaccagcttggccaacatagtgagacgttgtttctacaaacaatacaacaattagctggacacggtggcgtgttcctgtagtcccagctacttgggaggctggagtaggaggatcagttgagcccaggaggttgaggctgcagtgaaccgtgattgtgccactgcactttagcctgggtgacagaaacgagattccgtctcttaaaaaataagtatgtatgtaattgtgtatgagctaagttactcttcctgtcacatttgtatggtagctacagtcaggcactgcataatcatctttcagtcagcgttagaactgcatataaatggtggtccaatagggttataatggagctgaaaaactcctagagaggctgtagttattgtaatgttgtagtacagtgtattactcatgtgtttgtggtgatgctggtgtaaacaaacctgccctgccagtcctgtaaaactatggcacctccagttatatgcagtatacctaattgtataatgataatagtaagtatatttgtgataatagtaagtatacttgataatagtaataaacaactatgttagtggtctacgtatttactatactttttattattattattttagagtgtactgcttttgcttctaaaataaaacattatctgtaaaacagcctcctgaaggacctgaaggcaggtccttcaggaggtatttcagaagaaggcattgttatcatagcagatgacagctccatgcctgttattgccccttgaagagcttccaggggacaagatgtggaggtggaagacagtgatattgatgatcctgaccctgtgtaggcctaggctaatgtgtgtgtttgtgtcttaatttttaacttaaaaatgtttaaatagaaaaaagcttatggaataaggatataaagaaaatatttttgtacagctatacaatgtgtttatgttttaagctaagcattattacaaaagagtccagagttaaaaaaataaaaagtttataaaataaaaaagttacagtaagctgtccaatttctattgaagaaagaaaatactttataaatctagtgtagcctaggggtacagtgtttataaagcctacagtagtgtatagtaatgtcctaggctttcactttcactcacactgattcacccagaacaacttctaattcctgcaagctccattcatgataagtgctctctacaggtgtaacatttttaatcttttatactgtatttttactgcatcttttatatgtttaggtatgtttagctatacagataccattgtgtgacagtcgcctacagtattcagtatggtaacatgctgtacaagtttgtagcctaggagcaataggccatatcataaagcctaggtgtgtagtaggctataccatctaagtttgtgtaagtacgctctgtgatgttcacatgacaacaagcatatcaactaagaatgcttttctcagaacatatctgttgttaagtgacgcatggctgtaattcatgcattaattggttacttgtaccctctgtttagggcttcaaaagtcagatctgtccatctaagatgcttttaagtaacatttaccttaaagaaatagatggttgattggtttaaagaaagagacagctgaattggacggggaagccagattttgaccatatttctaagaggagctgttctgtaatgttttggtaaaagaatgtctgtctccatatcatctatctatctatctatctatctatctatctatctatctatctatctatctatctaatttggcatctatttatccattaatctgtctgtaatacaaatattccaaacatttaaaaagtataagaaggctctgtagtgcaatggatagcacattgaactttttttttgtttttatattggcttattgcaattaaaaaaggtgcaaataatatatgtaccaaagaaaattcagaaaataaagaaacactgagaaagtgaaagactagggctcatattataaacacacaaaaaatcacttttaatattttgggtacatttccttgcaggcttttttgccctatgcatacatttttatccataaatgtaatcatcttgtctatgttattttgtagcaagcttttttttcacttaatacataatactattttttccaagtctttatagatattgtttttcttttcttttatttcttttatttagccatcactcagtgattggatatttagggtatttcatcattattttctttgaaaattaaataaaacaaaatttgatgaaaatccaaggtggcccaacacagtggctgaatatatctcatcagtctgttacattattctcatggaaatggaaaaacaacccccaaaactctgcatctgagaggagtatatattaagcttaaggaagtgcttatgaacagtaggaaatgagagttggtaaatggagtcattttatttcataaaggtgcctcagagctttaagcccaaagccctacactttgagtcactttggattttgtgcatccatccatgatgcactgtgattttgtcttacactgtgtttggtatgaagcattaaatcttcctccctttacagttttcagaatctgtgaaataggacctgagctaacctagaaaagtctctctgcttgtcgtttagtttttttttttttttgagatggagtttcactcttgttgcccaggctggggtgcaatggtgcgatctcggctcactgcaacctctgcctccggggttcgagtgagtctcctgcctcagcctcctgagtagctgggactacaggtacacgccaccacgcctagctaatttttttgtatttttagtagagacagggtttcaccgtgttggccaggctggtctcgaactcttgacctcaggtgatctgcccgccttggcatcccaaagtgctgggattacaggtgtgagccactgcacctggccttgtttagatattttaaaataatcttccaattctgagtaaatagtatttgtataatagttgtgagttgaaggcaaatagtttcaaagagttcagttcttttgtcttcaacatataagtcataaaaatgcatgattctccctgaggagccagcttggcatcagactctggagccagacagactgggtttatttcctgccccaccactttctgctgggtgaaccggagtaagttacttgacttgtctaggtgtcagttttctcatctagaaaatgggaataatactattcattcataggtttgttgggctggtttaaataagttaaaacacagtgttaactactactgttttcaacaggttcctaagggtctgtgtttctagcgctttagcacttcaatggcatttataatgttctgcattatctctaactgagtggtttttctatgagtatttctatgagtatttcttccccaactagtttatcatgatggttataatactggccaccatttttgatggagtattataatacatactctacatgtattacaaaatgtacgtctcattgccatttatgaggtatgcattttcactgttttctttttacaagtttagtaactaaaggttgtagaggttaagtaacttgctcaaggtcataaaattgctaaatgtggaacttggaactaaattccggtctggtgtatgtgccaccaccctgcttttgtaaattcctttaaggaagggacttttgtgctttttagatcccttacagatttcagcactgttccttaaacatagtaggtcctcagtaagttttttgttatgttgaatgaatgaaggtaggagtgatcctgtggataatagaacttttttctccaataagaaaaccaacaatattgctttttaatgacatgatattatgagtcttagaattctgttctgcttccatgttacatgtaagagtttgtaattatttgtgtatgaaactggttgtatttcatgtgaaacaaaagtacataccctgtatttgagactctgatttgagaaaacctggattagcattacacaagtaaccattgaagcaattttaatttaaataaaggatacaactaattctggatctgtttttagccatttatttaacagacatttattgagcatatacattgtgcaaagccctctgcaggggactaagggtttaaggatgaatatgatggtttctgtatgaaagaggattttatccaatatcatgggtttacctatgccctgatgctaatgacccctatatatctttaatccaactcttctccttttgccttcattattcagctctatgttggatacttccacatggatgtctcataggcctccaaactgaatttattatctcatccccagcacccactatgcctcattatatattacattcttgtacctgttatatatttcacctctgttggtgacaccactgtctaaagtaaccattcaaaccactgtccaaacttcaaccttcaaacaaacaaacaaacaaaaaaaccagaagtaatatttgattccttttttctccctaacattctacatttggccattcaccaatcctactgatttttttcccctaaatatcatcaagaactgtgaaggatttgagactttatcttacttgcaaatgaacttgcctgccacagttccatagatgctggcagaaggattcgtgggttagagacaaagaaatttattagtcatagcaatagcaatagccagagtatcaacatatttattcactgtttctccaagacccaactcccataggatgtcatgaagagggccaggtgacatccatacatgaagtgcattgcgttacaggagagaaactctgaacttagggaacccaaatcttttatattgggcaacaaagatgcttcacctttgctccagagggagatcatttcttccaaggctgctctccacataaacatctttgaaaagttagtctggaaccaagggcagccagtgctttgctcacaagatgtgcagaaacggaagggactcatggagaatgtctcccaacaaatatatcttgcatctgttccctttgctccttctttttttttttaatcgaaagtgccttactggtcctgcttccatgagtagcagtgaccaggggaaaagggagaggaaccagccagcacagggaggggtcatctccacaacattccatttatacacagaactgaacagcaagcatagagtcactattgtggttagaagttggcagcatgggaagggggaggaacaggttggatgtgggggtgttgttaaaaatataggcccctctccacaactggggtgcctggggggaatttggtttgcttcaacccaagaggaataagaagatcaaaagcagtttggcaagaccagaaccgtcagggatggagggaggaggaaaatccagggagtggggggatctgtttggcaactggagtgaagggattgccctccccctgctgggatccccccagcccctctggtctgggaggaaggggacggcctgcaacccccgagggcagatgtggggctgccagatgctccaggcaggtggccagaaccggctcacaaaggcttgtcctctagggagatgaccgcactgccccccagcttctctgccagggtgcagcggtccttgacctccttgtagcagtttgtgtgtaattcatgcttgatccctgtcagcttcttgacggcgtccttggagctggcatagatcattttgcttttaaggggagcagactcagggacccagaagataaacaccaggtcctcctccttgctctccttggtctcgtaggttgtgtcacagagggtgtagtggcagtccttatctggcagcatcctgacaaaggtggtgtaggggtcgtcgatggtctggctcacatcgcccaccaggatcttcttggtctcctccaggatgatgttcttcttgtcctcactaaggcagaagagcaccaccttcttgagcttcttcacctcctctggcattgaagacttatgcaacttcatgtcgttgaacatgttcatgacaccatcagacagccacaccagaggccatgtttccagaagtgaaaaggagagggcatggagagccgcagaagacaagagcactgcagccgctgctgggacccgactgcactctgttccttctttgcaccattagatcaggctgcacattgctcataggaagattgcaacaactttttagctgatttccctaactctgggtgggtccctcttcatattagtcctccacaccttgctgaagtagcctcctgagacataaatctgactcttccctgcttaaagccatttactgcctgcctattatctataggaaaggcccaagctccttagcatgacaccaaagggattttcagaccagcccttgctaatccctctagccttaggggggcagcatatcagagtgattatctcccttactctcccagtgacttaacctttgtagcctgtttcctcattgctaacattaggatgataaaacctacctcatgggttggtgaggaattaatcagctcacacatggttagccctcagtaaacgttggctgttatggttgtgtctttccactctctgcctcgcactttaagatctggctacatggttttctgctgactctgtgtcccttttcaccatggttagtgcctttattcctgccacccactcttcttgcaatgtcctccaaaccctgttgcctggcttcacgctggttaggcacatcctcttccttctcttggatgctccatgcatgtgtcggccattgagctgtaaatatctactaataagtcagttactgctgctagactatcaactttatggggatggggggtgttttatttatctttgtgttgctagcacatagcatgtgttgaaaaaaatggtgaatgaatacatgaaagaataaaaggaattcacagtctactagggtgtttggggtctagggatgaagggtggaaggcagctaagtagcttaataataacaggttagagaatctgggtaaagctggggctgaggtgagaattaggccctataggagtccagtgtagggagtttgcttgttgagtgtggtgcatgtagtgaggaagcctgtttaaagttatctcctcaatgaaataaagcagccccttctaggcaatcctaattactccctttcctgaaagaatatattgcaaatggaaggtcatgcaatctgccttcttgtaagatcttcaatttctcagaatacaatgaattctctattacctggaggaggggtagaaaggagcttctttttaattaaattgtctctgcagcagaaagtgactttatcctgccttttgaagtcttccagttgtcctcagcctggctcaaatcactctccttgaattcattgttacactagtgcaccctgctttgtgagttataatttaacgtgagcgtatctaattctctaatgagatggagactctttgggagtttatgtttttttccctgaaatgtttaatgtcatgcttttgaattaagaagggcttctacatatatttatagactggctgagtttctccatatatgtgttaagaactttcaaataattagagcacagcctgaatttcagaatgccagtgatcttctccagggcttcagcttccctgaaagaacagctactcagggcctattattaaatgtttaaggtatcattttttaactttgaaataaaaactgaaatatttggaaaatactgataaacgaacaaacaaaaaaacctgaactaaccctactagtagtagtggtaactactatacaatagtatttggagtatatctctgtagtctgtcttccttggctttgtgtctttgcttctctttctctttcaatgaatgaggtcatcttttatcactcatctggcaatctgctttcttctccttaacatcaatagatatttattaaaagtgatgatgctggagtatttcttttaggttcctgtttcaatccttgacccactgttttgccttgtttgccactgcctgccttttcttgatttctgtttgtctctctggattgacccattattgtgttctgatctctgatacctgcatgcatcttcatagtaacttccaacttttgggagtgtctgctgtgccccagatagttgtatgtgttttacctgctttaaaaatctcttttcggatagactggatatttgtagtctccatgtcacagatgaggaatttatttggtgtagagatttagtaatttataaaagatcatgaagcttagatggagcctgaacttatgtttttatactcagcaccccctctagtatgtgaaactgtcatctttagcttctgactccttctggaatactgatttttgggtgctgtgtctaatcagctttcagctctacaatattccttgaagggcaccgcaacccacaaccttgggccagcatagtgaattttatattttttatttgacagagagagagagaatgtgtgtgtgtgtgtgtgtgtgtgtgtgtgtgtgtgtgtgtgtgtgtgtgtgtttgagaaatcagcagctgtggttcttgctttcactcctcatggtgaggaggtggcctacccctcacatctgttttcagcccctgttcctcaataccagagttattttctattaactcaatgcaccttttctttgtaattcttgtcaattttccctccagccacctgcgcggtctctggcttgctctcaggctgtgagtaaattctttgtatacttgctgttttcgataacctcagcccaagacttaatgtcaaggtgggggccctattaaagatgccatgaatcatcttgtctttgtttgaagatttccgtgttggcaagtgggcagatagatgtaggtttcccaaccagatgtactggtagctgagatgggggcattcagctgaagtacattcctatcattatttggcaaagaaagagccactgagattaaaagcatgatccttgcttgtgatctggcttcatcaacggaatcacagagcctctgtgttggaaagggccttgaaatcatctgcaactgcgcggcttgatacttgagggaactgaggcaatagatacaggaagtgatgtaaagttataaatgccaaaccttcaagggacttttgacatgacgtaactctgcgctcttatgttttgggggaagaatagtaaggcctctagaagctcactaacactcctaatgcggcacagcgcgttactgcagagcaaggactctactgaccacaggcccaggacagcggccttggaggtgaagtcactaagggggatctgtaggatttggctggttacaagagctcacccgctatctcctccaggctggcttccgtgggcctctgttgaactatcagtccagtgttcttgcctctgtccccacagccctgcagaggtcttcttccacctgacagatggtgactgccttctccacagtggtaggagtgagggaaacagtgaggggaaatcaggaaacaggaagccagggagaggagcaagaggtgttggggctgtatgtgctggctccgtgccttggtgttgtgggtttctagagggttttaactttgtagtaaagacgggacttggaggaattctccctgtggtgggacaggagttttctccacagccttcacaaagtattccccgcaagaactactcatccttcacggtctacttctatcgtagcagttcagtcttctgctgtttcttctggtaccagcctatggattgggtaaggagaaagatcaggtttgtaaagagatctttctggtccttccagtaataaagccccttggacaagggccagggagattcatctcccagagactcctgtgctctaggtggtggtagaggcttcctgccagaaggatctgaggcagaggacgtggatggtgccatgctggcgtctctgtgcatctggcagcgcaacaaaggacttctgtctgccctgcgaggctgggtcggtaaaacccacttcaattgaaagccaccacactttagcaacttgataattaaaattctaatatgtgaattaaagaaaacaaggggctgtgttcctgccatattaaaatacagctgcagtgattccactattgtttcctttgacagagctgtggttttcctacacacctttgtttgaggctttgattcagatatactccctgctgctgataagtcccatgtgtctactcatcggttagatggtgcatggggatgattcttctgtgatgtggagaatgaaagatcgtgtcttcaagttatgtgaggtggctaagtgacatctcatcaagagcagagataaaaacaaaactcatggaaaaggtacttcctgagctccctttttgtttcctaagtgatttaaaacaataaaggccaaatcgaagagaaaacttaagaaccgatatagctgatacctggacttacggattgatttatttctgtgaacactctgggaaaatggccacttgtcgctctctgttattaataaagaggtcactttatcattaggcctttgaatctgtatttaatggctaaagcagatggttataatttctgacttggtgtggccaccttattaataaaaaagaactgatggaagcaaaaaggcgtcttcatttttaactccagaagcataacacaaatgctttccagtctttctttgtgtggagagcagaccaagtgactgcaataagatcctgttacacatttgaaaaaaagacttttgcagagtggaggtaactcagtttgaatccttcttttgttaaactttaaaagaacactataaatatatgcccctttccttgaagaaggtatttcgaaggaagcttcaggattatattttaaagtaaattaatattttaataacataaggaaactaaaaaacacctaatttatttcagatagtggaggcctgtggtactttctaaaattattctttttgcttaaactactataaactgcttttttggatttaattactaggcttagatgaatgtgccatgcatcttattttggttctttttaaattcacttggaattaaaaaaaatcaataatggcaaaaacgtctggtagtggatttctgcttgatttcatcaagcctgtatattcccctataatggtaaggagtttgaaatcgtggttatcatcctggaaattttttgtccccaaagggacaaacctacatttgtgaagacagaatgatttagaatcttaatgtactcagtaaaccgagtgaacagagcagaaaaatgctgggaattcttcacataggctcagaagagctctttaattcacttagataccaaagacttattgatatgtcaggctgtgggcggcatcctggggtctgttatggcaatgaattcctggtccttaggtgacaagaatgggatgagtgtgctatgcctggctctgagataaagaaaaaacatggaatgttaaggatcttaaagtctttacgggtttctttgcccactagttttcaatgttttttaattaatgatgcctttcaggctgtccatgggcccacgtttagaagtgttttgaatttcaaattattaatggtaattgttgttttctgttttcattaaccaaaggcatgtataacaacccattcagttcatttgtttattgatttgttcattaattcttcagtatttagcttgtatttacttttggcttggcaccatgccaagcacagggatgcagaggagtttgtgatggccaccagtcttatttaaaatgcctaaaatagggtcaggagcagtggctaacacctgtaatcccagcatttttggaggctgaggctgaaggatcacttgagctcaggagtttgagaccagccttggcaacatagtgacacctcatctctacaaaaaataaaaaaagttggcggggtgtggggtgggcgcctgtggtcccagctactccagagactgagttgggaaggtcacttgagcccaggacgtcaaggctgcagtgagcagtgatggtaccccacactacagcctgagggacagaatgagaccctgtctcaaaaaaataaataaaaataactaaagtgctccacaacagtggatggatttttgtttttcctaccatctcagattcctggatatctagaccaatccattgctaagccatcgtgctttgttttcttttttaaactttgaaatgttttaagtgtacagaaaagcagacaaaagtgacaaaacccatttcagatacaaatattttttatttgtttcagatttttaaaagaaataaaacattatagatacaacaaaagctcccagtgtacccctcctaaatcctgtctcttttcttctccagagataatctgtcctttaaatgtgatgtcttttcattcccatgcatgtttttatatttttgctctctgtgcataaatgcactgagtgctactaaaaatagtgctttgcctattttaaaattgtgtataaatgggaacttactgtacctgtcatacatcttgctatttttgctcaatgttgtgtttttggtattaaccttgttaatttaggaattgcatgttgatctaagaagttattttagttgctgtgcagtaagtatgctattgtatgaccatttcacaattaatgtacccattctcctgccttcatttttttgtgtattataaacaattttgccatgaaaactttgacttatctttctgtaaaaatgtgtgaagtttttctaggccaaatacctaggaatagaatagagtatgcatgtcttcggcttccctaggtgctgtggaattgctctccaacggccttatgccagtgcgagctccttcctacaggatataagttcccgttgctctttaccctttctaactcttgatattggaagtatttttagattttgcttattcaacaggtatgagaaactatcacagtttggatgtataaagatatgtcaagttgagtaaagatgttagagcaaagactggagatttttttttccttttcctcctgttctagctgtattgttctagctatattatagggcagatttgagtttctgcttgggtagaattatcctcatcaaagcctactttggccctaattagtttgctatacatccattgtacacagaacacattatgtacatttctaaggaattgaagagacaaagtccaaacttatagaacctatgttgggggtgcatagcaggagatactggggcccaatttacagtaggttcattgcactggccagtgaattcagggaccttgctctctatatcagcagagattgctgcctgtgtggttttttggttttttgttttgtttgctttttgtttgtttgtttgtttgagacagaatcttgctctgtctccaagctggagtgcagtggcacgatctaggctcactgcaacctccgtctcccgagttcaatcaattgtcctgcctcagcctcctgagtagctgggactataggcgtgtgccaccacgcccagctattttttgtatttttagtagagacggggtttcaccatgttggccaggatggtctcaatttcttgacctggtgatccgctagcctcggcctcctaaagtactgggattacaggcgtgagccactgcgcccggccgctttttgggttttaatgtccataaaatgagagattgcattagtcattccttcttcaagagcagattttcttttctgctttcaaaattccatgcttctaagtggcgttgacccttggtgctttaaaacgtcttaaaaatcactgatacttaattggtattgagaacagaggaacttaatgcaggagccaccactaagtgaagagcagttaaaaaatgctaagaagtcacctgcaaaattctaatctaattaaaattatgtaaaaaaagaccaccatcactcatgtataaagatgacagggaaaaattacaatgaatagactgtgggtgattattcccctcattgccctatttttctgttttccaaatcttttttaatggtcatggagtaatattcttggaataaaataataagcatatgcaaacaattataagctcatttggtaggaaaataagaatgtgatttatacaaaacatgtgctgggcaaaggggagaacacctgtatatgaaaaatgatttgtaatgattttgtaaataatcctataatccttccttgggttaagggttggtggatgataagtgtttttctttaggttttgctgctggaaagatccagggaagatggaagacaagtagactggcatcttacctaaaagcagtggcacagcaggtggtagaataatttgagcttcgctcattggattttaagaccaaaagaaaaggcagaactaaagagattttattcattaggtcacgtagatattcctattccaaaggcatatgacaaatccttcagagttgaagtaatcataatgcctacaatatattaagcattaaatatacatatatttttcaattctggaatagctgtgaatgtgggaataactgtactgactgacaggggagagatcagatagtttaagaaacttgccccatatgcacagctcatcagtggtgctgcctggactcagccaccatctgtttcactctgccggggcatacatgtatgtgtacccttgccctggcaaactcttccttttgtagagctgaaagcagccccctgcaactttcctatgtatttattctcatcctgccctcctgagcacccagccttagaagtctgctccctctttcgcacaacagcctttctgatcttcaaagagggctattgtgtccatttctccacttctcccctcttcggtctgtcatcttggaaaagctcagagaggtgtttttattcacagatgccttgagaaatttcatggtttttagactcatgctgagtttgtccagatgtgccaatatttgtcttatatgatacaaattaattgtccagaagaggaagaaacctttgtagacactcactaatgcaaaccagttcctttgagtattgatggaaggaaaaacactaaaaaatgaaacagatcattttcactgggagagtgtagttgttgaattcacattctacttttaggacaaatctgtagcatgacagttcagtcttaccacatgtattaaccatgggaaacctagggtgacatttgcaatagactcctgcttttctgtaaggactttatacagatggagaaagtatgatactcttacattttattaccaagttctgtggcccagggtttacagcataaggtggcaaataatttagctccactcagatttggaagagtaactattattattataagtaagatttaaacttagggacaggtacacactctttaaggagagttctaagactgagatgttgtatcattatcagtacctggcataaatatatgtatctgagttctctttgagaatcataagggaaaagatgtctaatatgatttaacctcaagacactaacaatgattacacctatcccctgctcccagcatcatagtcaccaactgtggcaacagctgctgctaatgttttttgaactcctgtggtatgcctggtgatgtactttatatcagctagttcattctcaaaacttgagaacacactacatataccctagtaagtactattgttagcctcgttttatagatgaaaaaactgagaggttaagtattctgcccaagatcatatataggttgggtatccctaatctgagaatccaaaacccaaaatgcaccaaaatctgaaacgttttgcatgccaacatgatgctcaaaggtgctccttggagcattcagattttggatttttggattaggaatgctcagctggtataaacgcatatattccagaatcttgaagacatctgaaacatgtctgatctcaagcattttgggtaagggatactcaacctgtatcttgtatatagtagagtgagagtctagcttatgctttgctcttatatcttgtttctttcttcagcaaaatagtctgtaaattgaacattaaacagtgcactggggacacagtaaggaatctttcattaccaatggagcatgaatgaaagtttccaaatatgaggtttccttagtgaaacactatttttaggaaaaactattaaaccaaggcttatgataaaggatcattccacatccaaatatacctctcctgtattagcataattctctactaaaatcacagctgaaattcattcactctaagagatggataaaaaccatacggtttcatgtaaagatcaccagcttcccagaactaggatgatgggaattttaactaatgctgctgtgactgtggcctagcctcttactctttctggatctcagtgggcccatctgtagaatgtgagcattggcctctgtgataatgaatgttccttctagctttgtatattgcatagtgcatgactgctagcttcaggaaaaataaaacgttttcaatggaaatatcagatcaccaacctgattccaatgaatttttttttattcactgaggctttatgtcatataaaaatatgtgacgtattactgctctgctgcccatctatttaaggcattcttcagtagacttgtcagggcttatctaaatcttagcaccacttacgtgtggctgattgcttggcaggaggaggttcctgcattttcttcctcctgtgtattagtgaattgaaatcaagggaaaaactgcttggctttctgcttccttccatgaaacagagctgtcagtcagtgctgaattagtgcctacctcatcatggaacatctcaagtgaactcaacaaagggccagttgaggcaggagactaatagcaggaagagagatggctcccagctgttcagctcttttaagcttgttttccagatccttccctcataaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcgtaagtacttttatctcctttcttgtcatttctaagtgtttctccgtggttttctagggcaaaagcaatgttgtcctcttcttaagccaaaatactggcttccagatgtcattccattttgccctgccctcattccattttgcttgttctctgctctaaagattcacaggagaccaccattggcagaattctcaagtgtagtaatgttgattctgaatgatcaaagcaaaaatcttccatttactgttttagaaggaatctaacatttagtggcaacaatggattgatttggtaaaatcaaacaaaaaatgatatagtgctggcataggaacctttactctcagggtctatgtttctgcaagcatttttgatgaattcattattgatcagggcaacaattaggtaatcactttattttttattccctttaaagaactcaaaagcagaagttctggctgggcgcggtg

SEQ ID NO: 2596 - DNA, 469 bp, Homo sapiens
cttttcctggccgatgcctcagtccttatgcaaagtgtgaacttggcctttacatccttctccgcagagcactgcaagcagccagtcccactggaacataagatgaagcttttgttcccatggctggatacactttggatcttggaatgcaataattacttcagctggatctggttcgtggagtacttggccagggctctgcctcatgccatggtcctacaagatatgtgaggaggtggacatctttgcgtagccctcctccagaggcaagtggattccttccataacccagagaaggccgcttgggaatgaggctgagaagccagactttttggcacacaaagaaaaagggagttttcaaagttgccgcaaatcatgcaggaagagaaaacaggacattagtggacactgattcttcccctctgctgaactctgagtccagtttaaatctttaataacataacacatg

SEQ ID NO: 2597 - DNA, 1146 bp, Homo sapiens
gctgcttgggaaatgagggccccattaacattccagtgcctctggctctagacctgataaaaccagagcattgtactgtgaatgtggacaattccctctccattcctgttattgctgctgagctggtcgtaaggaaaccgagtgagaagggaatgcaacagaagaaaaagaccaaagacctgggtttcagggctgggaaagaaagcaagacagaatggaggaaatgaggcctgcaggacatggcgtctcaaatgtttgcgtcgcctttaaagtagcctgtcacagctgccttccacgactcttcaatgccctcatcccttctccagatagaaatggagcagctcttcttggaggccaggcttcagctgatagcaagtctgaggccaggaggaaccagtgtgactccatgctgctcagaaaccaacagctgtgctccacatgtcaagaaatgaaaatgaatgagtcttcatcaacccaaattccagactacacctgagcctttccatgatgacatcccaacagaaagcattcactacagactgcccattctgggccccaggacagctgtcttccacggattactgacagaggcctacaaaactctaaaagagagacaacgttcttccttgcccagaaaggaaccaataggcaagacaacgaggcagtgagcggtaggagctcatcacctcccagactcccagagagaaaataacctcgccaagccaatctttgacactggcaccttctcctcacaattttctctcttctcccaaaagatgatttaattttgccttcctaagattgctggtattctagctcttacctctatgttctttctcacgtctcctaaagacaaaattgtttaatttacatgattataaagatctgtttatgaaaatggaacatggtaactgtctctcattttattttcttaaaggttcttctctacgttaaggtggaaaatgtccttctgtttctaagtcacaagttttctgtgaaagttatttcagctctttcttcaggacaggggccagagatggctccatgaaatccctcatgaattcagcttattaagaataaaggaataggctagatgtggtagcttacacctgtaatcccagcactttgggaggccaaggtgggtgg

SEQ ID NO: 2598 - DNA, 7124 bp, Homo sapiens
caccattctcctgcctcagcctcccgagtagctgggactacaggcgcccaccaccacgcctggataattttttttttatttttagtagagacgtggtttcaccatgttcaccaggatggtctcgacctcctgacctcgtgatccacccccctaggcctcccaaagtgctgggattacaggtgtgagccaccgcgcccagcccaaattgtataatcttgaattctcacaaattcgagatcttcccacgcacctctgtgtgtgtgtttgttttggtgtcccttaacactttccctgcttcatcacactgcccagagcttcccactgggaacatactctcacctccttaattcccatttcctttttcttacccaaacaggaaggagtagccactattcatgccattgtcaaaacctcatggcaacaaaacttccagggctggaattgcaaagatgattacaaaggggagctccacaatcaggtgatccagcattgataagctagagtcagatgattataagtccctggaatgatgatgccacaagatggaaggagtctagctacatgattcattgcatgggtgttccaagataatgaatacttccatagcaacaaaagtctgacaataaacggttaccttgattttcacattttcaaagaaaaatccctcaatggcaactagaccagaagtctcaacactgaatatgcaataatggctacaaggctgtctgcaagctgaggatcaatgaagccaatccgagtcccaaagctgaagaacttggagtctgatatttgaaggcaggaagcatccggcacggagaaagatgtaggctaggaggctaagccattctagtcttttcatgttcttctgcctgcttttattctggccattctagcagctgattagattgtgcccacccagattaagagtgggtctgcctttccccgtccaccaactcaagtgttaatctcctttggcaacaccctcacagacacacccagaatcaatactttgcattcttcaaaccaatcaaattgacactcagtattaatcctcacaatattcttcacaggaataaaaaaaactatcctaaatttcatattgaaccacaaaagacccagaatagccatatctatcctaagcaaaaaggacaaaaccagaggaatcacattactgacttcatattatactagttatggtaataaaacagcatggtactggcataaaaacagacacatagaccaatggaacagaacagagaactcagaagcaaatccacacacctacagtgaactcatttttcgacaaatgtgccaagaacacacactgaggaaaagacagtctcttcaataagtggtgctggaaaaactggatatccatataaaaaagaatgaaactggacctgtatctctcaccaatacaaaagtcaaatcaaatggattaaagacttaaatctaaagcttcaaactgtgaatctactacaagaaaacattggggaaaatctccaggagattagtctgggcaaggatttgttgagtattatcccacaagcgcaggtaaccaaagcaaaaattgacaaatgggatcacatcaagttaaaaaagcttctgcacaacaaacaaaacaatcaacaaagtgaaaagacaaactatttctcacaaaatagaatgtgagaaaatatttgcaaactatccatctgacaagggattaataaccagaatatgtaaggagctgaaacaactcaacaggaaaaacatctaatagtataattaaaaatgggcaaaagatttaaatagacatttctcaaaggaagatatacaaatggcaaacaggcatatgaaaagatgctcaatgtcactgatcatcagaggaatgcaaatcaaaactacaatgagatataatttcattccaattaaaattgcttatattcaaaaggcaggcagtaacaaatgctggcaaggatgtgaagaaaagggaacccttgtacactattggcgggaatataaattagtacaaccactatggagaacagtttggagattcccctaaaaacaaaaaataggacaaccatatgattcagcaatcccactattgggttcattccccaaagaaagcaaatcagtatatcaaagagatatctgcactcccatacttacaatcgccaagatttggaagcaaccaaagtgttcatcaacagatgaatgaatgaagaaaatgtacatatacacaatagagtactattcaatcataagaaagaatgtcattcagtaatttgcaacaacatggatggaactggagatcattatgccaagtgaaataagccaggcacagacagaaaagcatcgtatgtcatgttctcacttatttgtgggatctaaaattcaaaacaattgaactcatggacatagataatggaaggatggttaccagatactgggaagggtagtgtggggcgggggctgaaagggaagtgggaatggctaatgggtacaaaaatacatagaaagaatgaataagacataccatttgacagcacaatagagtgactatagtcaataataacttaatcatacattttcaaataacttaaagagtataattggatggtttataacttaaaggataaatgcctaggggatggataacccattccccatgatgtgcttatttcacatcgcatgcctatatcaaaacatctgatgtaccccataaatatatgcatgtactctatacccacaaaaattgaaaattaagatttaaaaatgtaatgaaatgctttattttatttttctggaaaatgtgattgtggctttagggggctaataaataatactcctctctttcctaccccaatagatgcaagaatctgatagagattaaagcatgaacattattgataaaagctagaatggaggatgtggcttaaatattcagcctcaatagatttcctaacagtttgctccatattgaattttcctacaggcagtaatggacaactgtatgcatttcctgtagagacactcattattcactcaataaatatttattgaatgtaaactatgggccagatactgttttaggtgctgaggattcaacagtgaacaactcaaagtcactgcactcagggagttcacattctaagtagtgaggagatcttgagtctgctaagacttgagtttggctgcagatctagaggaaagtagagttttggggggtaggtcctgaagaagatcagcaatatcttggaaggcaactacctcaggggaaaccattgcaggtgttttaggcaaagcgagactaacttcctgaggaagagatggtagggctctttcttctggtgaaaaaggcttggtgtaatttataggttcaagacaccagcttcgtcacaatctgcccatatgtcttgattccagtttctgagaatgccattccttccaatcaatgccgtaactttaacaaaggggccctgtgtggttgggcattcagttgacattgtaattcagccactcacaaggtgagaatgttttttctttcattttcataaacttcagtcctgtgcctacagaagataatggtttcagagtaaacatagaagattccaggtcccttgtgagaatgttgagctaagaatttaaagccctgagcttataattttctttccctaagttctcaggtattgttagaagcaaccaaccaactctatcttgctcattttcactaaaatattctattggtagcaaatacttgaaaacctgaaatgccttttataagcatttgattgcaggtatctaaaggagataatttgagtaacttttttggccatgaactaccacatgccatgaactactagtgctccctttaccactggagacatggtcattagtgcctttaaatctaatcagatcagagggccaatgctagaaaacccaaatccaattcagataactcatccttgagattctgttctctggaaccactctcagtatgcaattctgttatcaggattcagtcagagaagcagacccactaggaggtgtgtatctatatatacatctacctatgtatctatttatctgtctgtttgaatatctatctatctatctatctatgtatttatcaagacacttgttacaggaatttgatctttttttttattttttgaaacagtctcactctgtcaccaggctggagtgcagtggtgtgatctcggttcactgcaacctctccctcctgggttaagctattctcctgcctcagcctcctgagtagctgggattgcaggcatgcaccaccatgcatggctaatttttttttttttttttgtatttttaatagagatagggtttcactatgttggccaggctggtctcgaactcctgacctcaagtgatccacccacctcagcctcccaaagtgctgggattacaagcatgagccaccgtgcccagccggaatttgatcttctataattgtgggagcagccacacacagtctgagtcagattgttgtcttcatatctgaagctggaatatgaagtccgcaagacagtcactagggaagggacggtaaatgtaaatgggggcaaaaaagattaagctggaccccaaagcacaagatggaacccatgagaaaggactaaaactcttgacagttcctgttgcttctgactacagtaatatagatgtttggaagatgtgttctgaacatacacagccgcatacaagtttaaaatctaaaggaagatacaaaggaaggggagcagttgcaggcccagcaactatgaagatgagctagccagtgaaaccacatgtgagctacaaggtggctgatgttcccctgcattcttactagaatagaaacttactctgatagagatcttccttcctttctgcaatgtttctgtcaaaactacaattcatggatttcctgtattctacccagcatcatctctgaccacacagtatcacaacaaggcaaggaatttatttcatagcaaatggaagtatagcaattaactcatgcttatggaattcatgaaacttacagtgttctcctttattctgaagcacttgacttgttagaatggtaaaatgatcttttgaagactcagttactgtgtgagctaagtgacatattgtaagctcttttctccagcattcagtagcaccctaaatcaacaaccattatatggtgctgtttcgctcatagacagaatttataggtccaagaatcaagaggtgaaaatggaactgtctcctctcactaatggccttagtgatccatgagcaaaacttttgcttttcccccgtgactttaggtttagctggcctagaggtctttgttccaaaggatgtaatgcccctactaggagataaaacaatccattaaactgggagttgagactggctctcaacactttcagctctgcatgacactgaatcaacaggtgaaagagggggtgactgaactgctaaaagtcagtttctgactggtgaaaatagaggaattgaggttactttatataatgagacaaataggaagtttgttggaatacagaagatgctctgggacacctcttagtacattcctgagagcaaagtccatggaaaactgcaacaatccaatttaaacagaactgctaaaaactcagacccctcaagagtaaaagttaggaccacctcacccaggaaaaacatcatgaccagttgagggacttggttagggcaaaggaaatagagaaaggaccatggaagaaggtatggaaatacctgagactgggttatgtataagaaaagaggcttaatcagctcatggttctgtaggctgttcaggaagcataatgctggcatctgctcagcttctagagaggcctaaggaagcttacaatttattactataaatattggctatgctatgtgaccagttgtagaaataaggactgtcatagttatgaattttttatttttatacaaatatttttgttttattgctcctttaatcctttataatttaacgtaagacatgttaatagtggttgtctgtatttaagttacaggatatcaaagtggagtgtgaaccagccaggaggagaacgaataacacccaaagacaaaaaaggacttgttgtcttttctggggaaaggtgaagaaaggaacaaggtgttcagctaataacgtggtttgggaagggagtttgaaaagagaagataaagaaatactcatctaggagagtaggagtgtggatggactagaaaaaaggtaagatcgctgggaagcacttgagtttggtagacatggatttaaggacaaagcctatctcagtacatttcactgtggagagaagcaggacacaactccttcgtgcaaagtctgatctgaaaaaaaaaaaaaaaaaaagagagagaacagaaggagtagagccaaccatattcaatttcttcttcaaagaaagtggtcagataagtcaacctacttccagtacagagaagaaagccaaaggacagggaaaagctggaagtatctcttttctgggctttttctccttgggaatgaaatagttgaaaatgtccttccttctatgaaaacatgaaaaggaggggtaggtgtccccctaacgtgtggcatcgtttaataaggccccaatgggatatgcattctgcacactgtactacaggatttctttaaaatacttcttaaagaacccatccaattttatgcaagtattcaaaagtctctaatgggattcattttaattattgtaacagaaaaagaaattcttggtccccaacatggaaatccaagatgcaaggaaatcataggctctggtaagtgctttccaaaaatatatgtgaattttttttttttttggctcagttggagttacctgattcataggtcactagcagggggcacgtcattgtgggtcccttcagagactgtcctcatgcattcatcagtcacacttccatatgttaagtatcacatagagctggagctacagtacaagggaatttgaacacaaaggcctgaagttgaaagccccaaaactgaaaatgctccaagtaatccatgactcaccttgtttgtataattgcaacacacaaacatacaagttaatcctgtctgg

SEQ ID NO: 2599 - DNA, 4596 bp, Homo sapiens
attcacagctctgtagtccggggctgggcgcttcctctctgggactgaaataagagcgctctagacagatcagccttcaggataattccttcagcagcaccactgtaacagagcctgagagaaggggagagaggtgtgccaaagtgtgcatctgcaggccgaagatgaggcctggacttcctgctccaggtgcacaggtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcaggtaagatacagggctgggggttgtcccaaattgtactctcaaggtagttcagtctcttgctggttcacactcagcctgagcccctgagggaaaacagtgcctggggcaacatgaaagcccaagaggtgcttctgagttgcccaggagttgctgagggggagcaggaaggattgggatttgctataacatagacctgtctagatgcggccaagagtcacacttacacaaatgggtgtcatttgtgtaaggtgaaagtacccatcacaacatctagtcttcattttcccatttggtctcctgggacaaatgagtgctatgcttattttatattactggacctagataacctgtgctgtcttgaaattcttctttttgatgtgttgaggatggggaagtttccatactgctacttcctttcctgttaactgcttgtaagatgatccatgcatgcagggaaagtgggggtgagtggtccactgacagctcattctgatcctgtattgtcttgtttggtttccatttttttttttcattaatttccttgtcaaaaagtcccaaattgagtctcaattttctgttagtctctggctttaattccggggatggtagattggctagccaacagcaggcaaattaatgttcccaggaatatttggagaggaaagaaacactgatttatataagtgagagcacagcttatgttttctaacataacaaagaggtcacaagtttgcagactggtttccagataaatggtagaaataggcttagggagcattcttcatgaaaggtccttaatctctaggagttgaaggcaaagatttacacaggtaatctgtttcagtaccattagcaattgtacattttagatactcctgttgaaagcagaccccataaatatatacacctactatatgcccaaattaaaagtaaaaataaatgaacaatttaaacaaattttaaagaaaaaagaaagaaaacagacccacatagtctaagcaggtaaatcagtactctccagtgctggaatgtgtactaataatggtggcatataatagctactagtagtagctactatcattatttaaaacattctatgatcctggcactgttctaagcactttttgtgtattatattaaatacttaaactgacctgtgaagtactaccattcttcataagacactgaagcctagtatagcattgctggtgagtggtacattgtttccctatggatgcaggtggccagttggctgtctttgttgcccagtgagctctcctgctctgttggccattatgtttggatgagtggcaaataaaattgaacaggagccaacgtcaagccaattagcaatttcagtcagattatttagacaacatcccttttcttccctcaacaccagattccactccctgcaaacagacaacatatttaatacaaaacacataaagaagtctcaagccaagtacaagttaactgttgagttatttgatgatttggattaactatacaagtttctgacaaagtgttcagtaaaatatttgttgcatgttggatgtggatatattttttcttcttttcatcatgacttttatgtgtcttcccaacaattaagaatagttttggattttctaattcggcatgggcaagattttgtacaagcttattatcacttgttataaaatgaaaataaatacagggtttatgtagggattgctcacacggaggaactagcaatgcattccatgttaaatatcaaatggcagagatgtgcagaagtctctttagagaggaggcttgtgggttgcatgctggattttccaaaatgtagatgaatctgaaatgtctcagatctcccaagagagtctagaaaactagattgtagagacatctagaaaactgatgtttccagggacctaaggagtctcttcatttggcagggatattgccaaagtgacaggcagttgtaaggtgcctttgtgacttaaattatgggatggtttggtctcactgggttcttagatgcactcttacaggaagaccatgcatttttctaatcaatgagtcactcagggaagaaatttatgctcagatccatggttcttaactcagggatggatttctagaatgatctttggacaccttaaaactttaagttttttcatgttagtcctggtgagaggatggttgtgtaagatgaacacagatggccatagtccataaaagattatagtaacttataaacagttttctctttcttaacatctagcattatctctgagccttacatgtatacaaatattcaaatcataattgttataaaaattcaattagtaatttttgatgtcaataacatggacaaaatccgtgattttgaacacggatttgaacatgtgatatgaacaagtgattttcataagaatacctggatataatatgctgtcacttaaccataaatagcaaacattcaaaggataaattcatgtgacctagtgggtttcaaattcactatagacttgattggctttaacttgggtttatgggttgccaagatcagttccacctagtaagagacttgacatgctcccctgtcctagacaaccagttgtaaactgcatatgcagcaagaacgcatttcatggtacccctggggacactgtattctagatactgttccagaaccttcttacagatcataattaccaggaagcttttccaatgtggagattctctggcatcctctctagacagtctaggatgaaagtcctggaatctgtgtgtttcataaaccctcctgaataatagaaccacactattcaagtggacagtgtcttgaattgggagataatgtcaagttctgtctgactctgctgtacctcaattttgccaacgggaagaggctcacagatcacatgggacttgtaactcagggtctgtggccagttggctccatctgcttacttatttcaggaggagaaagtccaagggttgggagtgagtgggatggggatataggcagatttgaggaatagagggcccttagggaaaaattgatggagaggaaattggctgcaaggcagcttggggccatacaaagggtaaccaactggattggtttgcacaggattgtcctatttttagcactaaatatcccacatgctaggaaatcttcactcccagatattccaggacagttggtcaccctacttgtaggttgcaaaccacaacctgtgagacagaagctgttatagactgagtctttgtgtttccccaacaacttattaaaatatatgttgaagtttggaggtgggaccttgggaaggtgattaagccatgggattagtgcccttataagagtacagaaagctagcttgccctcttccctccatgtgaggctgtaagaagtcagccctctgcaagctggaagagagcccttatcagaagttgaccaggctggcacctgatcttgaacttctagcctccagaactgtgagagataaatttctgttgttaataagccactcagtctatggtaatttgttatagcagccagaactgactaaggcagaaacccacataataggctcaaaatacctctaactctatcaatatcttcttacagctgaagcaaatatttccagcatggaattagtaagcacctattctgatgtgattgaacggaaaatggaatgaggattgtcttttccactgcttatgattttagagtgtggagaaggactgttcatgttccacatgactcagcatagtagcctttgttctgtctgaccaaggatgattgatggtttggagttttagcaaaaactgtcaccagaataactgcacacctattactaaaaataataattcca

SEQ ID NO: 2600 - DNA, 6299 bp, Homo sapiens
atctggaatgcattgcttgtggctttgctgtctgctgcaggctggaggagcttaaaagcctttctaagtagctgcctgtccttttaggactggatgtaggtttctgcctctctttttggccctggcattgctggccccaaccacattcctgattgcccgggaagaacagcctttgaaattcaacatctgcttctgggtagttggtgagtgtcctctctgggcccagacagcaggatctgctcctctctacttgggaaacttttaaatacatttctgtttgcaggttgaacaagcccacctgaccaagagagggaagcacgctaactgttttcagtttggacactcttgggggctttttagtaattgcatgtgtttctgagcaagtgagtgtcttttgtgggtaccagacaacaggattgctcctctcaactagggacagtctgaagaattttggtgtgcaaattcatcaagctcaccccatggaaagaggaagctccgctgtttcagtttggacactcttggggtttgttggttgctgcagcacttggattgtattttggtgattgtttgtgtatgtcaatatagccatgggaagtaagaatttgataagctgataatcttatgtaatactgtttggcctcatatctttgaatctggataagtttggcctctccatgtgcctcgttttgctgctgaatggcaaagcagggtggagttttgtgtattcaggcttttatgctgttgttcaaagcaaggtcaggcttgattagtacatgatgttcttctgtggttttttctggctccagtcatccttggagtgtggagagatttagcctttaaaaatcaaaatgccacagaaactgctatacccaaaactttggttcacaaccttcattggattgcctatcaggtcaaaagaagtttagccatgtgaacgtgttcataagcctgtgagtttgtattggtatctcatggctagagttccaagcatttctgctgttcaaattctctctgcatttcatgacagcatctacattcaagattcccagaggcaccatccacaaagctctacagcatttagatggagttgcaatttgtttctaagacagaggacaagaaatatgaagaagcctttccctggaggctgatccacgtgattcaggagaggaaatgtttagagttagaaagactccatacagtgcctagctccagataaggctcatggttctttcacagttatgtgtgaatatgaatgtggcttttatatatgtgggctgctttttaaatgaaaggtaattttcttttttatcagtctgggagacaaaaaccaatggatgtgtgaagtattggagtgatgttaacaggagccctgagtgcactgactgtccgccttgcagtcccacactgtcggcctagagaccagaggaaggatctaggagcagggagagatctgtggctcctctttgtattccctctaatgaaggtgtgaaggttagaggaaaaatactgttacccaggtcattgaaaataccacaggtaattttaatttctactggattactgtaattttgttttcttttttagtttttagatttttttatcattgactcttgcttttttattattaatagtcatattggctacataaaatgtataacaaacattacattatttagtataatctgtaataagctatgtaaaatgagaactacatgtcccttaagagtttaaaagaactttgagtaaaactgcatttctttgaaaattttaaggaaaaaaaaaagatattttaaagttttacaaagtgaagtccctctaataccaaattttctttgcagtctcttagtcaggatagagttactgagcctctatttcagcattctagatccaaacaaaaagtggcaatcacctctttgattgatgatttactgtattggaggactttgagaatttattttaaaattaagtatatccaaaagataattttatttatgagaactgtaaatatctgcagacattttctctttcctattctaaaacttactaaaattttagatacaggaattctctgttgaaaaaaatatatatatgtatagatagatacacacgtatatatatacgaaatgtgagaaaaaatatatatatatattcctttgatggtctttaatatttagtttaaaaactttaaggaaatcataaaacttttaaatttcaactctctctaagattatatgggcagttaagtttaaatatagagcatatatttcttcagttaaaaggaagtgtgtatttactgctgttcaattagaaaaagcaattaacacctgcctaatcataagctacactgttttttatgtttagattttcaaaatagagcttgcccataaggacatctacctactggggaacatagaattattttgaaaagtttgttaagaattggctgattacttgacctaaggatttaattcagcatgaatacacaaaagaaagaaaatgtatatttgcttgtgttcaagtctgaaattaagctttggtctacggttaaattaatacagccctgagaacaccttgtcttaacttcctaaaaattaattttgagaaatagatttaatagtaccaaggtacattgttgttataatgaagaaggcgagaatagtttttattaccttaattgacgcgcttttataaaacgtcatttgcatctggattctaaagggaacgtgaattatttttgcacgattatgatttggagtaatattgaaatattaaaaaaattcatccttttattcttaattgaattccaatgcagtaacttcaaaacaatggaaatagcatgaggccagaaaggggaaagggagtagttgacactttgcataccaccagtaacatggaataggagggatgctacaattataggatgctactaaatatgaaaatttattcattaattcagcatttgtacactgagcatctactatgtgtcagctatcaagtatgtaatgatgagcgaagaaaaaaaaacaaaaaacaataatcaacccaaaaagtaatactgtcatgtagattatagcattaagattatccaaaacttaaacattctacaaatagatgtgaaattaattacaagtgttaaagtgttattactgctacaaaagaaaggtaatgttttgcaagatcatagaatagtcaacttaaccttgtagaaagatcaaggaagtcttcccaaggaattaaatgatactttcattatctttgctttacctgtgaagagctgaagtacagttaaataacttgctaaagttttcacaactgctaagtgataaagacaggactgggatccatgcactggtgccagagcctacaatattaacccctctaatatactgtccgccactgaattccttactataatgtcaagagtttattaggcaagcttcatcaggttgactaagcaatggtcatcaagggaacagtaaagagaggttaggagagaggaataattagaattataataactcaaatatgcagcaacctcacgaattaggaaaggaaaagaaaaagaaaaataaataaatgtataactagccttgaatctagtttatggaaataagtagttttcatctaacagtctgcataggaaactacataagctcaattcacagaatgaagataaatgattattaaaaataatcctcatctatgacagaatactttgtgcccactcccaatcatatcatttaaagctaaattaccaaaagcatgtcatttgtctttgaatttcaggtttattaactgtataatggcaattgaattacctttcctggaattaaaggtaaacagtcttttccccacattattctgaaattgattttgctttgaagataacatgtacacttacattgtgtttctgtttcatgaaaatctattgttaatgctaaatattttaaaataatgttttcattcattaattcaatgaatacttagaaaattctattgaagatactggacaaaattaagagaggcataattttggagcttacattctataggaggagaaagaaaattaacaagtagaccaagccatgtataaatacaatttatgtttataattgaatatggaacatgcagaagccattctcaaatggataactctagtctgggtggaaatcaaacatttcttgcccaatgtaccaatgagactgtaccataataatgtgtaaatattcctaatataaataatagtataagtaatatttgcttcagtgcttcaatttcttaatcaaatacactaaagaataattgtggatctttaatttctacattttacatttactttgctgaataattattatatttataatattaccaatatttaataacctactctactgtagtagggcttctacggtaggaaagctaagattgtaaatcctattataaagttttgtttttcccttaagcaaaacaactcctattttttttgtgtaaactcatttttctacaataattggatgttttaaagagacatagttattcttctggtattttctattttattttttcactgcaaattcatcacctcattctgttgactggatcaaatttattattaatgtatcacctgggctgtcagtaatttttaacatgtcaatattttccagtatttctagtaagtatgctttaccagaaacatacatattttatagtttttctttgcttcttaaattttcctttatttattttcagaagtctttgtctttcttttcactgagaaagtcaaccatggtttatgggtcagcttaattttttacttaaaggaggtctttcctaattacctaatttaaattgatatccactcagattgttctgttttattgtatcctaatgttttccttcatctgtcacatttcaaaagtattgcttatgtaagtcctcaaaagtattgcttatgtaagtgttttagcatacacttttcctaccacttggagtctcatggtcccagtgactacgtgggttttgttcactgatacatgcccagtttttagcacagtgccttgtacagagtatgaaatatttttcctgtaaagaaatgagtgttggatgttacagtctgtgataataaggaaaatcctgcccttcatttgttactttctcttgcataagaaatacttcactattatttaccttaattcttatctcaattctaatatgcatgctggtttgtgccattgctaagctcttttaattgcaaaagacaagaatatttgtttttaacagagtaatttgttatgattccacatcctccaacagtgtcatggtacaaacataaaatataatagagaacaatgaccaacttttatctccttattctagtttttatctccttgtgaattaattttagaactcaaaacttagataaaagtatctatggagatttcttccttttcattttactttacctaattttattggcttgaaagacctcattgtgcttaattaatatcagtgatcaaatctattatgttcactttcactatgtaggtctttaaggggtaccaaccactcaaatagtcaaaaagtccatgtataacttttgactaacccaaagagttaactactaatagcctattattgactggaagccttaccaataacataaacagtcaattaacacatattttctatgtgatatgtattagatacagtattcttacaataaaataaactagagaaaggaacatattattaagaaaatcatatgaaagagaaaatatgtttactattaagtggaagtggatcattacaaaagtcttcatctttgtcatcattttgagttggctgaggaggagaggaagaggaaggattggttttgctgtcccaggggtggcagagggggaaggaaatctgcatatgaatgcattcatgccattcaaacctatgttgttcaagagaccactgtaaattaaaaaggcatcagattttttccccttgtttcaatcttttctcctatgcctacaaataagatgtgataaatgttagactaagtgatctaaataacatgagcactggccaaggatattacttataacatgtgatgaacttacacacattttaaaaattattttgttttactctgtctgagatttgattgccacttcaccccaccccctcaccttaaaatgcttgtaccaagggaactggagtcagggaactgaaaagagtaaagtatagaaggaagaaaagtcactctaagagttgttgttgttgttgttgtttgcttatttgtttgcttagag

SEQ ID NO: 2601 - DNA, 346 bp, Homo sapiens
ggtgtggagaggagcctccccagggtctgcactcctcctcccatttgcagccttcgtaagtggacacttccaacccctacacctgcctgtcctcccagtccagccttggcccgagatgtgatctaattctcactatgctgctgtgggcagagcacatggcatcagaatgctaggagctgctgtcgggcgccatgggagggaattccccaactcaggaaagctcttccagcggaaaggagcaggtggcgagcctccctgaagagacagacactgccaacgctacaggcagagccaatcgtggggctggagtgcagttgtgcaatcacagtttgcttgcagccttgac

SEQ ID NO: 2602 - DNA, 4436 bp, Homo sapiens
attgttgaccaggcatcgtgctccatcattaaacacattatctggtttatctttacaacaggctaatgagttaggtattatgcccctcattgccaaaattaggaaggaaactaagacccagaaggaatgattttcaaggccacacaataaattgcagaatttggtttccaagtcagtctgaattcaaggtccatgttcctaaccacagtgttttgctgcaaacaaacacagttcactgggataagtgcagttatggtggcttgtacaaaatgttctgtggtagtacaggcagggagtgacagctttagcctgctaaacagtcaagacaggcatcacattcaagtaacgttagagctgagcctgaaggatggacaggattttgcaagtggaggtggggagaagagttttctgggcagagagaactgcgtacaaagacagaagaccctgaaagcacagagcttgtagttgggggcccctgagcatctggaagagaggacaggaaatgaggcaggaacagctgaagagcatcttctccagagattcttagattggcggtgctggacagcaagtgaccagaagagaaacaagtggtaacccaacctgcatgaagaaaattcagtagaaccttgctggtgtagagaagatggcacaaagaagagtgagaacacttttatgaaaggcttaggaaatgttgaagttttccagttttcttcctatgtgaaggaacatagtgaagggggaaaggccccttttttgcacatacctgtggagggtaacgctgtgtgggtgcatttagccctaatctctgccgtggatcaggatcgttggttgtggaggaggaagaagagagggaaaggcttgaatacttacaaaagattttgagagcctaaatgatgaaagctagcagttctacagtgtttactaagtgcaagaaactgttgtaagagttttgcatatattaactcctttgattcgattctaatgaccctatgaggtaggtgctattattatcatctccatttcacagagaaggaaattgagacacagagagattaaataacttgaccaagatcacacagctataatagtcaattgtggagctgggattcaagctctggtgtctgctttcagattcatacccttacccattaccctgtactacccatctggaatgtggagaacgtgctgataacattgctaataatcatctgtcgtttatttctgactactctccaatttttttaagagacctgtatctaacctttggtgataactaaactataggagaaaacttgagttctgatagtaagaaacatttacaaaatggtctgaaagttgatttgaagtcgaaaacccttatatgtgtttgtaaattctagagaagaagtggcagccaggcagatgagctctctgttctgtgcagagctgatggtactccctgccctggggagccggcactggcagcgattacatcactaagtcaccctccatactcagctgcttgctaagaattaaattgctggcaccagatctggtgagcctcatgttaccatggcttgtttgtggagagcacattagtgtgatatgttcagtcttcagaaacagttaaacatcagctttattaccaaaaagatagtgtatgctggtattactcctggttattcggttcagctcctcaagtgaacagtcccacacctatttagcccattgagtcaagctgacctcctttcccggttacgggtttgtggacaggagtgacaggcgggttcacttgcaagggagccagagagccgctcgtgcctctgctgccctctagaggcgtgtcaggccaaggccgctcatctctgagccttgccggcggattgcaccaccagtccaccttttgtctcccttttgaatctccactgaacaccatttgtcaaaagggttgaggcaaaaccactctgagcttccaaaacaataataagacttaattagaattccaagctaagccattgagagttgctgtttatattggggaagatgtaacacttcagtcctgtgtttttcagcccctacatctcaaccatcaaagggaaatgagtcaaggttgttttaaaactataaatagagctaacacttacaaagcaattgccacatgccaggtactattctaagcgcctcgcatatgatgacctatttaatgaggtgggtggtatgagcatctctatcttataaataggggaactgaggcaagggactgtaagtatttctcacagttcatgggtggtggaactggctttgaagcccggtagttctggctccatgaacttggcttataatcactttactgtacggcctcttttatagctatcgaggcatgcattgcaagtccaatttttaggtaaaggttttgttaaaaatctttaaccttaatcttgtaatgaggaaacaattggcccagaccctttaaaaatgtcaatgacgtaataaataaagaaggagaaggaggaggaggaaggggagaagtattttagagctatgacaactaaatataattcattgtccatggttagaccctggatataaagagacaaaactacaaacaatattattgggaaattaggaaaatatgaatatgggctatattttggataatcatattaatgttgcatttcttgagtatgacctcttattgctgttatatagcagtatgtccttgttcttaagtgatacttgaactatttaggggtaaaatatcatgatatcagcaaattactatcagacaattcaggaaaaaaatatacctgagaaagaaagagaaagcaaatgtggcaaaatgtaaaataattaggaaactaggtaaagggtatatggtgttcattatgctatttttaaaacttttttctaggtttgacatttttagcataaaaagtagaggcaaaataattacttatttcagaataagaggtagccatggctacacccaaggtatctgcctggacaccacaagtggtacaaataagcaaagtgtgttagttgggaatccacaggcaagctttgaaatctgtagacatatgttatatgaaagtgtatgagatattacatcttatttattcatgtttttccattagtactaggaattacatgcatcattatgtattttcaaaaaagatcaagtttccatccaatagaaaataaatagtgcaaattacaaagtcttgtatgaaactaaataaggtctaattgtagtcttgggattattctgtttttatcatcaacaaataaggcatttgtaggagagtgcctgccctatttattcagcactgtgttccaggtactgatttagtgctggggatacaccagtgagcaaaccaagatctctgaactcatggtgctcgccttctgatgggacagagagacaaatattatagctcagtaaactgcagagaatgttagaaagtgattattgccaaagaaaagtagaaaaatagagcagcatagtgggaaattgggacaggcagttgcagagaagagggtttcagttttaaagaggatccccagggtaggtttcatcaaatatgacctcatggcacctggaaggaaagtagaagagaacagagaagaacaaccctaaggtgacagcatgcccagagtatggctagagctgagtgagcaagggggaaagaggagaaggatatgaagtcagagaggaaatagaggatgagttcacaaaggtcaccatgaaggctttggttttcatgctgagtaaaataggaagccactggatgattttgagcagaggagtgaggtgatctgacttaacacttaaaaggatcaatctcgtagggggacaaaggtggaagcaacatctcccgttaggagcctattgcaacaatccaagcaagagaggagagtgactcagcacaggctggtagaattggtggtggagagatgtgatcagattctggatattttgttggtagagccaacaggaaggatttgctgataaattagatgtgatgtttgagagaaaaagacaagggtgactcaatatttttgtccagagcaactggaaaaatgaagctgtcattcccacagatagggaagactaggtagagcagattttgagggagaagattaagagttcagttttggacatgctgagttacagctgtctatcagacatccagatggagatgtcataaaggtagttggatatagaagttttgagattgtagagaggtcagggctagagatttaaaactggtcacaattggtgtattgatggtattcatagccgtgagcctggataggatgaccaagacagtgagtgtggatagagaagagaagagtattaaggaatgtgcccttgaattcttctcttttattgtttatttatacttgttatgtttctcattttgtttggaaaattattacgctgtgtaaaataaaaa

SEQ ID NO: 2603 - DNA, 2409 bp, Homo sapiens
ggggaggggagagagccaggaacctcccgctgcggtccagggttgccacgcggaccccagaggttcctgaatcgcactgagctccccggaaaggaaaggacgttcccagagttagagaagaacggagagcaaactgaagagagaccccgttccctttagcagtcggctggcctgtttctccatccccctcagccctaagcaagcacgaatctaccttttgtctttattctagacactgcatgactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcgggcatgccacaactcctcaggacacatgtgggccaagtagagagcgccggcccctcaaggaccatggcctgagcctggtggacgcccttccctctggtcggttgtggggctcaataaatggctctgtgaacttcccctgcactgccagggccgttcccatgagctgcttccctgattcacagggctgggcacaccctgggacagctgcccccactctcctcaggacaacaagccacatccctccactgggggccccagcccccacgcagtcagggtggaccgtgcacagggtttgtggggactgcagttgtggaggccccaagtccgtccctgagcaggcgctggtgcccacaagatagtctgctggctgtgttgggaaggaattgtgcctgggtgtggccccagctgtgccaccagccgccctgatttgcttcagcctcagttcctgctgcggccctggtaggatccaggagcactgaggcctgcaggggctgccgtgggggctggctcagggccttcaccacctgggggtctgtttcccttccagtctcccctgccatcctcagtgaccagggacacagatggccctggcaaggcccccggcctgctcctcgcctgtgggctgcaccccccctaccccacccgttgccctcaccctacccagctgctccacacccaggcagcccactgccttgctctgggggcggagagcagagggtccttctgcagggaggagacgcggagtgggcccagccctgaagctcttgctgacccggaagtgagagaggtcctcctttgttgctggaagccctgggatttgggggttggtttttggactgtgaatcagtgactgatcagtccttgttttcaggttgtggaaagcaagggggtggtgcgtccccaggcccctgaggcccagcttggctccccctgcccgagctccccccgtcccagggccctgcagggcctcgctggcccatgtcctgcagcggggctgggcaggctggatgtggtggtgtaccccactcagagtgtctgggaagtgcagagcaggaccactctcagctcccaggcgggggcccagcaccctgagccttcccaggctgcctggggtgggggtggtcccagggactctggggcctcctggctccagggcatgtgggtggcccctatgcacagcccctcttgttgtgagcccccatgatccgacctcctctggccttgctgcctgctcagggttcatagccccagcagccccgccaaggatgcctggcgagtgggtggccgaggcaagttggagcctgtgtccctgctgttcagtgtcctggcccttccctgacacgagcagacacggcatccacagagacagcccggacaccctccaaggccccggccgatgggacagacgggcgtacaggagccataggcagcagatcccacgctccctcggccggggccagcttggctgcccagccccagctccttagagaacgggcttctcgcttcagaggagctggtcacaaaccagtggtcgcgacaaaaccattcctgtggtggagcgcgtgtggggcgcgtgtggggcgcgtgtggggc

SEQ ID NO: 2604 - DNA, 4517 bp, Homo sapiens
gcagtttggaattctatttgtcttgccttatttgctttttaaaaatttctaccttagttttttcctggtttactttgagtgtttttttgtagtcggaggagattgttggtgcggctgggtgtaggtatgaggcagaggaggaagagtaatttattccatctactgagcctttcatttactttctgttttagcagtagagtgggatgtcggaagcttttgttgggtgagagtcaatctgtcagggtaaatcttaaaaagctggatttgtggtttagttactagttactgtgtctccagtggagacaaagattagtttttaagatttagccttaatggatgattcacaaattgcaatgcagagtattgaagttaagtccaaggtcaagcacacaagtgggtaaaactgaacatatgaaatgggtgtgtggctggcacccacctctgacctttactgaaataaatgaggaagacggtgctgtaagtggaatgccacggaccaggagttaagaccagagtcctctgctaggccctgcatctgaagtctgcagagcatggcttttcattggctcagtgaggagttgagtcctggttcagaaaaagttaccgaggtctgtaaaagtcagtaggataccggaacaagaaagagtgggagagtgtacagttcccagcgaacattgccagtggaggctaattttcaccagtgaagggcgattttgatagaaaagcacagtgtctcaactacttgtggtttttgattctgaaagaggaggctttggcaggagcaataatacacgtggcctaccacctgtttggctttttccccacaggttgcaagctgcagggagggccttgctaattctagtacctccatccccgaatcgtctaaatgtattttacccaggacctgtcatggtttatctgagtgaccagtttcctttcctctcttgcttatttatcatgttcatatttatatttttcataatggggcctatttatatattttgaagtagttctagtgattttaagatccagcaaaacttcaaggtcatctggattttggtgttctatttaagttttctaacttgatacagtctttttttttttttttgtattttgtatgtttttctacaaaatgtgagagagttaagcatgtataattacatatgactgctgttttcactttgaaattttaaatcctgcttgggagaatggaataagctattgtgttttttgcaggcagctatgggatatcccaatttgtccctccctcctccttaattttgaagcctgagagaggaagtaataattttcttttttttttttttttttggtagggatggggtttgactatgctgtgcaggttggtctgcaactcctaagctcaagtgatccgccctcctccgcctcccaaagtgctgggattacaggcctgagccaccgtgcctggtctgaagaagtaataattttaagattcagtgttgagtgaaataaatgtattcttaaaaatttctaagagtgtttaactctctgacctaatatttaatattttccccaatcattaggaagtgcttttttgttgttgttgttgttttttttccaggcagggtctcgctctgtcacccaggctggagtgcagtggcatggtcacggctcactgcagccttgacttcccgggctcaagtgattctcccacctcagcctcccaaggagctggaactgctcagctaattttatttttgtagagacagggtctggctatgttccccaggctggtctcaaactcctgggctcaagcagtcctccaccactcctggccaagaagtgcctttttttttttttttttttttaaagtagctgctgaacacaggagaatctgcctttttcttgaatcgtggtttttttgtttttttttttttcaagacggagtgttgctgttgtcgcccgggctggagtgctgtggtgcgatcttggctaattgcaacctccgcctcccagattcaagcgattgtcctgcctcagcctcccgagtagctgagattacaggcacgcaccaccgtgcctggctaatttttgtgtttttagtagaaacaggatttcaccatgttggccaggctggtctcaaactcctgaccttgtgatccacctgcctcggcctcccaaagtgctgggtttacaggcgtgaaccactgcacccggcctgaatcatggttttttgaaaccattggcatctgaacctgtagctctctctggtagtgttgtgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaatttttttttttttttaatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttcaataaaagaaatgtttcaaattggatgaaaaatggttctgtgattatggtttgtgggacgggttctgatgcttcatttatgttcttcatacggaattctgtctcatttccctagttctaaatatgaccagcagacccagagttccatctcgacttcataaaggagctgtcttggactgggaacagctgccaatgtctttgttgagatgggagttggaaagtgttagcactttgccagactttgccagcaagattaactgaggagatcaaattgagtcagggtcaaggctaatgtcttctgaagacttagcagagatccctcaactccaaaagctgtccatcccacatggcttccagaacaaggaggctgctagctccccaacaccatccatcacccttagccaggtgcctgacctccagcctgggtcccagctgtttactgagatacacctggccaagatagagaaaatgtttgaggaggacatcaactcgactggaggtaaggccgctctgtaggctcggtttttgtgtgagttctgcaacagggcaggaccgagtacctggggtgtgtggag

SEQ ID NO: 2605 - DNA, 3694 bp, Homo sapiens
gcggggtgggaacctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacgatgaggaaagtgaggcccaaagaagatttatgttcaggaccatttagtctgtaagtggagaagccggggtttggaaccagatggtctggctttggattttaactcttttactgtactgtttctcatactgcagcaatgatcagttcaaagatatataaggaatttaaagaacagcatgtagctccctgctttctaagctgaggatggctttctaatggcagattttggccaggagcttcattgagattatatccctcaacccagagatacacatgaattattgtaccataatttatgtgttcacactattttatgcagtctgagcccaactgggagatagattgagttctgttttttctggttcttaaaggagtagtcgtaggagatgctgcttcctgagcccctcacccactgaagcaacaatatgtgatggttaagagaatgggctctgcagtccaatgtggggttggggggttggaatcctgcctctgccacttgctagctctgtgaccttgggcaaattacctaacctctctgcctcaatttccttacctgtaaaaaggaaaaaataacagtgttgttgtgaagattgacttaattacatacgtaaagcatttagaatagctcctggcacatgtgttattaaaccagtaccctatgtcctagttatagtgtacttagttttccacctcttactctgttaaatatccacaaccttaagaagtagattatcatcaccccattttaaggtgaggaaaccatcttgaagagagcatcttggaaataagtgtcttcgtcaagatatgaatcagtctgttgacccgggcctctgaggctggcattgtttgcactgtactttccaactataaatcctctattggccacaaaacatcaggaaggcacattattaatatcagtttttgagtttgcaccattcatgtgtatttaaatttatgaggaagagtttatttctgtggaaaatatctggaaaatggcaccactcagaagaaataatttagattttaaattcataaagagtagattttctaagaggttggacttaatgtgtttctgtactgatgtgcgcatctgaacaattttaaggtgcagagatatttctaatggaattcaaagctacggtctcctttataacaaaatcatagttgaaggtggtattacagttttaaataattgtaatatatctagtttttaagagtcaatactgatgactaaattgttaagttttaggactgaatttgtaaaataggactaatgttaagtgacttagttttatcttcttaacccaacacttagttttatcttcttaacccaacagtgtggtaactctaactttgtgagattttagcaaagacttcagttagctctatttgtgaaaaattctgtgcaatatttagaagcccagatggtgtaaagttaccatgtccctctataatggaaagctattattttctgtcgactgaaattgttttagaattctgagtaggtaggcaattgtaccttctcaagtttgactttcaagtgaccttgaaaagaacacttaaagtactgtactttgtgagggaaatcttgtaatcagaatactgtgtttctgcagagctctctttcagtttgtagttgcagagatttgggggtgaagaggacaagacaaatgggaattgagagtaattcttttctgtaaaggattgactcttcttttgctacttttccattgctcttttcctttctccacctctacctgccagaatgaacatgttaatttgttatcagttatttgagtattcattgattatgccatcctttaagcttagtgggagggaggggatacagaaatgtaaaatgtgtggtacttgagagtgtggttgggaaagatgaaacaaaccaataagtatatggagggcttagagattgagctttgtgggctggagtagttggagaaggttatgtgatggggatggcggttgtgcactgttttgtaaaagcattagttttgaaatacgtgcaagaaggaagcacaggtggaggcacagaggctgaagtgagtgtgccacaagtgggactcggttcatattgtaaacatttactgagcacctgctatgtttcaggtactgttggctgcaaagatgcagacattccctgccctctagaagttcataaactagtcgggaagacatctaaccataatactatagaatgattaattgtaatactggatgatatcattgttaaaaacctgatcagtggcatttgtagtgtatggcatcatttttagttatgtttcagtaaattatggtttaagttttagaagggactccgaaatttctcaagaaatttatgtatatttaatatacatacttaaaaacttgtatgagttatctgttgcttcataacaaattactccgaaatttagcagctttaacagccagcttagaacagatgagtcaggaatctgagcacagcttagctgggtgctctggctcagggtgtctgactaggctgtcaaggtgttggacagggctgcagtcatctcagggtttgaatgaggtaaaatctagttctaaactcacttgtatggcttttggcaggcctcagatcctgctgacctcagacgtcagttccttgccacacggacctctcatagagttgcttacaacgtgatggcttgttttccccaggaggagggatttaagagggcaacaagtaaaaaaacaaccttaaatggaagccacagcctttttataacctaattttggaagtgaaatcccttcacttctgctatattctgtttgttggaagctagtcaataaatctagcccatactcaaggaacagaataacccaagagcgtgtccaccagaaggcagaaataactgagagccatcctagagactgcttacctaaagttctacaaggtattgttgtgtattgagaacctcttcgtctttggggtagaaggaaaaagatgagctagccaacgaactttactgatggaaaaaacagatgtgattaaccagaaaaaacaagatgtttttgctaaaggtctataaagttagtttcaatattgtgttgatatttacgatagagaagtataaacaagaacaaagctattgtttgtggccaagcagagaccaattttacaagtatgcctcaacttaattagtatataagttccagtgagaattgtatgctctgaatggactcattttaagtggattataagaacacaatcttctaaataaacagtggaaatcattttgattatattctattttcagttggatgtgcatgcacgatagagatttatgtgtacaaagttgaaaggttgaatagtgatagaatgaaaagagcacagagttgactgggcatggtggctcacgcctataatcccagcactttggaagtccgaggcgggcagatgacttgaagtcaggagttcaagaccagcctggccaacatggtgaaacaccatctctactaaaaatacaaaaat

SEQ ID NO: 2606 - DNA, 2108 bp, Homo sapiens
gttcagcttgctcgtcatccctaggctatgagccacaaagcaggactgtggcccagcttaagtccagtgctaacctgtgggtgaatgaacaatgaccggggaacagggccctaagtaggtcctggctaatgctgggaaaacaccaagctgaagaagacatgtttcctgccctccagcaaagagatagagtccaagcaaataactacaacagatgtgaacgcggaagcacaaaggaagaagctaatgcttcctgggagaggtgacatttcttctgggtttcgatacttcttctagtcctctcacatcttaaatctccattctcagtattctcagtggagcattttattctgcttctatgatttggggcaaaaagaagagaatctatttgataaagtacttctagaaagactggcagaaaagactctgaaagactttctcaggagtaagaaacaacacaactttcttaatattcctgtgctgttttcacatgcaaaaaatactttccccctcctacctcatcggtagggcaatggacaaaatggcttttcttatagtaaatagcatgttccatgtaagacgaggccatgatctcccttttttgcacttcaaaatattttaaaattgctggattattttttcctctccattcttccttctgtggcttgacaattactaaagctggtatgattgataacacgactcaagttagaggaagtcttttttttcttgagatggagtctggctctgtctcccaggttggagtgcagcgactgcgaactcggctcactgcaaactagaggaggcctttttttttttaaatcaaagagcctcttttaaaattataacccattgggaatatgctgtggggaggtctctcacagcagtgtgaaagagcacattatctttttttttttttttttgagacggagtctcgctctgtcacccaggctggagtgcagtgacgcgatctgggctcactgcaagctctgcctcccgggttcacgccattctcctgcctcagcctcccaagtagctgggactacaggcgcccgccaccacgccaggctaattttttgtatttttagtcgagacggggtttcaccgtgttagccaggatgatctcgatcttctgacctcgtgatccgcccgtctcagcctcccaaagtgctggaattacaggcgtgagccactgcacccggcaagagcacattatcttgtatgtgcctgtagcccatctgcagacatgaaacccaagtccctgttctcccaagtgcaatggaaacatctcctctcctgcggatgaactgaataagggatagtgaagcatatttttaaatgtttgctattgctcgttagccacagtaggaatttcaataccagtggcagtgggatccctcattttattgtagatgccttttttcatttcagcttacaaagcttccctccgttggagggtgggggccgcagaaataaaatggaaggcaaaggggggatgcgctgcgatttttctgctcattgtctcattttgaaactgccccaactgtatagaacttctaggaagcccgtacatgtcggcacattcccggggaagaatgcttctcttaggagccagtgccttaagaagtttcttccgtgttgcactggcatgcatgtctgcttaaatcgccactctcctcatgacatttggcaggactaggaagttcacgtgtcagtcccgctattggcccacgtgaccccatccccaaagacaggcagtgaacccctgtgtttttatgccatatgaactgagaagtagacgcattctgtgtaatggatacacactgaggctgcaatttttgaaaagtcattgttttgacttccctatattcacatcgaataacgcttttagtctttgccctcagtactctagaaggggctatatagcctgtttttgtatttgtgggaaaaagactagaagctgggcaaaatgccaccaggaagactaacatggcgacgtgatcccaagggaaactgaggtctcacactgtccagcaacagaaggaggttgaattctggaggaggtttaattttttaaaaactcaaactaataaaagatgttcacaaatatt
